United States Patent 6,812,339 (POLYMORPHISMS IN KNOWN GENES ASSOCIATED WITH HUMAN DISEASE, METHODS OF DETECTION AND USES THEREOF) - sequence listing, part 38

SEQ ID NO: 13845 - DNA, 152132 bp, Human
aatgtccttctctctcctttgtcaaggctgtaccccagcccctgtccgattttctattctcttctttagagacttcatctacaacccctttgctgacaactcccaaatctcaattctttctctccagttgctacagggcacttctaattggaggttgtgctgtccccgcttgaccttcctgtctttccagctgtatggtcctatagcaacttccctctggccggcccttggtgcctcatttctggagcactgcagacatcctgggctgttccagcaacaggccgcggcccctgcagcccagtcggcaggcagacccagctccctaacacagctctcaacagtggcctgcctgcgtgaaccctccaagcgttcctccatctccccccaagtctggttcaggctcctctgcagctcttggggcctctcttacctggccccttgccctcagtccagtcttatttcccacttgtctgcacaatgtctgcaggcaccgttccttctttcctcactagcagtgtcctgcccactgtcctccatccaccaagtcacagtcaaacccgcagcacctgtggcccttcagccttcactcacaatgtatcttcccaattaacaatcctgctaggacaggaataagctcttaaacttctccctctgcccacagcatatagcaccagtccttactaacccatgcactaaccgtgccgcacgcagagtgacagagccctgtccctcacctgccatctactgatgtccaagctgggcttctggaaggacaggcctctgagcccaagcgagacctacgagttttcctaattttaacttactcagttcttatttcacctactctattcaacctgcacaagttagtacctaccatttcagattttggcatggaactgaattatgactgatgcaacaggaagtgtaaacgttctgcagtctctttgggaccaagctcattcttgggttagatgatccattttatatattctaatttattgcttcccactcgttatttggcgcatctttacttactttactccatgggtataaaatgcgaaccattaacagcatttatacgtgtatggcctggaaaagttacaaactcatagatctatgtgtttctccgactgcgctattttctcctaactcttggtgtctttctgatgtagaataaatactgatttccttagtcctgtagcaagttaacaagcctgtaacgtgacagatctgtatcccaggggctgatcatagagaaaccacaaagcgatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatgtgcgggcgcgttgtccatgtttggtcgtggagctgcccgcgggcgcgggaacagcgcgtcgggggcgggtgggcttgggtgtccgtggcggaggttaccccgggccccacgcgcccgctctctcccggccttggtctttgtccccgcgcccccgcaagggccgcccgccgcgccccgcagcccctgagcccccgtgcgcggaggcggggcctggccaaggggacagcgggcggcagacgcgcccctgcggctcccaggccgcccgggccgcgctccccgcggggaaagaggccgcaggcgcggggaggctcggccccgccccgccacgtccccctcccggcccgggccccgcggccgccgaggccgccccctcgcgggcggagcgggcgctgggctcgcgcggctgcggcggcggcggcgggcccggggttgccatggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccacacttttttttttttttacatgttggatttattgctccatcaaagggccccaaaagtttgttaatgggaaaaaaaaatgtgtatttgatagaatttgcttaagtgcagtcggaataattttgaattctagaccctttgacaactggagcaatttattttgctattgtattgtgatttagggaaagttttcttgttattcgacacctgtttgtcactgtagcagtaaagagtaatgagtgtgttgattcatcctctgtagtggtattttttatctctggtgaaatttatcatcttgttcatggtagaatgtatactctgatagcttttgcagcttatactttacatctgaaccatttgtgggccttcatgaatttagtaattccctcttcagtggaattaaagaaagtttctgctttttctctgaatttaacgccagtttccaagagcagaacacctgtgtttttgagcctcagaaggtgttgagggcaggtagaatgtatttggtatgctggtggtccctggaatactttatagtatagagtcatgggaacggttttgctctccagtaggttaaatagattcctcaattaacattttgaataggttccttaattgacttataatcaatcatatttgaattattgtttttgatctaaaaagtagttatatgcttatggtagaattctccctatgcttagttggaaagatatgtggctgaaatttgtattaaatgactttgaggcatcaggtcttacaaatttaatctgtgggcgtattattgacagcttgatttgcgatatgaaaatgagcctagatatttttattggagcagttgtttggggcctggtcatactgttcctaaatagcagtttagtcatgaagttgacctacacgtctgttcatgaatgttttcgttttctgcattttccttttaattgccagcctagagatattggcatggtattttactggtggtgatgtccagaagaaagtaaaaaccaactcttatattttgtagaagtattggtttaaagaaaaaccaccttaactagaatcaaacaataagatcactttataactattgaattacttttctcaaaaagttctcagctctgtatttgttattttttttttaggttgtctaatgaataaagtttaaagcaagagtggcctatggggcagaagtcaatgttaactggtgatgtcttaggcaacagatgttttgatgtgaaacattttaagaggctttcattaagtgaagatataaatgaatacaagtcagttaattactatgatgattcaattaaagcagtggatcacagaaatgccatttcactaggaactaaattaaacatttggatatttcattagctacattggcaaacaattttttctttttaaatgagagacttacattacaatggcaagacagcagcataatacatgaactcatacattttcatatgttcagtatgcgtcatgctgttaatagtgacagaaactaaaaaatcatggttacagctttagaaaatataattcacacatattatttggatgactgtcatagttaatttccttctggtcaaataaagacaagatcaagatatgcgaagttgaggcgggaggattacttgcagccaagagtttgagagcagcctgggcaacatagcaagacccccctctacaaaaaatttttaaaagttggctgggcatggtggcttgaacctgtaatcctagctactcaggaggctgagatgggaggattgattgagcccagaagtttgaagctgcagtgagctatgactgtgccactgtactacagcctgggtgacaaagtgagaccctgtctcaagagagagagagagagagagagagagagagagagagagagagagagagaagataatgtgtaaatgagaagggagaaagagaaaagtttgttctaatgaatgaaatttctgtcttctcttatacttctttcttggtgtctctcctcataatttgtagtggacattaaatgcaaagttaggcagtatctagcctcctgaaaaggctcatcctcatctttcaggaactgtctttctcatttaagcagaaaatgtgtgcattgttttcttcagagtatttgaaatctgtaaagtgagctagaaatcacaagcttttttttttttttttctttgagccacaccttgctctgtgacccaggttggagtgcagtggcatgatcacagctcactgcagactcaaactcctggggctcaagcagtcctacctcagtctctcaagtagctgggactacaggtgcgtgctatcatgcccagctcacaaacttcttttaatgctgggaaaaaaaaaaaacctgaagtgttttaaaaagtgaacagtagctatcctttataagacaatttatgatttgggaaataactccatattttcttcgaggcctcattttgaagtaggtggtgttaccatccttcctttgtgcctgagaaaacggaggctcgaagagatttggcaactttatcaggccacagaactaggaagggcttggataccagtctaaatctttgtgtgtgtatgtgtgtgtgtgtgtgtgtgtgtgtgtgagagagtaatagctttattgaaatatttacataccataaaaatgtgtttttaaagtgtaccattaagtgcgtgtagtatattcacagaattgtccagttgttaccactctctgattttagaacctttgcatcactccagaagaaaccctagtacctactagcagtcactccatgttcccccatcgccctcacccctggcaaccattaatctactttctgtctttatagattctgggcattttatttaaatggaattatagaatgtttggtattttgttcctggcttctttcacttagcatatgttttaaggttcatccatgttgtagcctgtgtcatcatgccattcctttttatggccaaattatattcccttgtggagagataccacactgtttaaatctgttacttgttgatgggttatttgggttatttccactttttgactcttatcaataatgctactatgggcactcacatgcacatttttgtgtggacctatgttttcatttctcttgggcagatatctaggagcagaattgctaggtcatatggtaactctgggcttaacatttttaggaaccagtcttaactttttgaaacctaaatattaagcttgttttattatacatttttgataaaagaataagtaattaaggaaatggatgaaagagggaaagaagtgggagcaagtaacaaaatgttgctcatgcatttccatgagtcctttggatcctttgatcaatcacagctcaccaaaacgagtcagtgcacaactgcacgtggttgccacaggttataagaatctcagtgcctgaacggacctggcaagtaatctcatctcatggtttactttcttaagcctttgagctgtttcttcaaagtaaaggttacccaggaacccaatggtaaagcagatagatacagagctggcatagctgacagggagtggggagaggatggtgctttggccctcctctccttcccccacccctccagcttgaaatctctgccctgtgggggaagctggaaaggctgttcaaagctagaaaggctgttcaacctgtgcatgagcattttcaagagactggaaagtaactacctctccaggcaatccattttttctccagacagttcagactgtcagttcctacaagcagtgaaaaatcagccgaagttgtgttccttgggtccgtagagaataggtttaatatcttatccatatattaggtcatcacatgtttgaagacaatgattatagttctttctcacatcttctagctcttaagacgtaattttagacccttaatcatcctggttgcttcatctacacctgtttccttttgtctgtatttctttcttaacttgatacaactgaatgtggtattccaggcatgttttctacacaaagaagattagaattggatatgtcacctcccttattccaaagtctatactttttttttttttttttcgagacagagtctcactctgtcgcccaggctggagtgcagtggtgcaatcttgcctcactaaaacctccgccccctaggttcaagcagttctcctgcctcagcctccagagtagctggaattacaggcgtgtgccaccagcctggctaatttttgtatttttagtagaaatggggtttcaccatgttggccaggctggtctcgaagtcatgacctcaggtgatctacccttctcagcctcccaaagtgctaggattataggcatgagccactgtacctggcctatacttctaataatgcagcctaaggttatatagactccatttcttgtcacatcacattattaccttttactgattttcaagtaaaattcttgtgtactttacatgtactatggctaaatcttttcttaaatttaattaccttttttttttgagggtaagtttcctcgaacaggcagagccctatcagattacaacaccattataatctgtgttgtaatgctataaataatcccagcacttactaagatatttcagcattatagtaacattgaaattgaccattgccttacagggttgtgattgtggttaatagccttttttcttcttgccttggaaggtgtcatgagagaattatcagatgccctctaaggcctgactggagcgtatctgccatgtcccagatctggcctggcttcttctcctgcaggtgctacttgttagtaactacagcgggtcgagtccatgggacctgcccagtcaaattttgaaatcactataataatcctttgagcgactgaagtttattttttctagttttgcaatggaatgttgttttaatttctaaacatttatattttggaaattaacaataatttatttaataatcttaaacatcttttgacatctctaatactgatgacattctcttaactatgattacagcaggattttcaagttgacacctcgatggttataaacaagtagttggatttaaaaggaacacctgtaaggaaattatccaaactcaacgctccgaagtattttcaggcctcttttgcattctcatgcagtgacagaagactgactgaggcattctgtgatagcaaaatcggaggaaaacgctttcatggaaaagtgcaaagcaaaagcacccacgctaagcgagaatttctaattagtatacttggtgctccagccaggaaggaacttatagccaaaccacaaccatttatcacattataaacaaacccacgcattttggtggaaaaaaatcacaaaactgtgcttaaaaagtaaccattaattggttattgtccatttctgggatagtgtaaaccttttcacatattctcttaaaaaacattttagttgagtggaggttggataagagaggagaaataacatctttgtttctagtgttacagcttgttcatgctataaaactagtagcgtgaaaaccttcatcatggataacattgaaaacggaacatgaaagcattgctctctctagtaagacagtctctccaaggacttaaaatcagtggcattttgtactccttacaaaaatttctttcaggaacaactattcatccttaaaattttatcaagctcattaatagagggtttctagtattagcaaaatttttaaacaccttcagaagcattactaattacaaacaaaaagtgtgctgtaaactctaaaagctgtataattattattgataccacccgtcacccccagcttcatgtttttctcactagacgtttggcacatagatttcatttctgctgaaggctgcacattcattttaatctggcccaggactgggggtgtgcgaaggtgtcagcaggagcaagtgcatactctctttggtttactttttaagaaatacctcttcagaagagtttttctttctttaaaggacttgttttttttttaagtttaattaattatttattttttatttagagtcagggtctcactctgttgcccaggttggagtgcagtggtgtgatcatggctcactgacctcgaacccttggactctagcaatcctcacacctcagcctcccgagtagctgggactataggcatgcgccaccacacctggctaaattttaaaaaaattttttagagatgcagtctttctttgttgctcaggctggtcttgaactctcctcaagagatcctcctgccttggcttctcaaaatgctgagattaagcatgagcccctgcacccagctaatttttaagattcagtttagttagatacatttccatttttgtttactctaaggttctacctttactggcaaatactgttggcggggaaaaccattttttgcagagtactctcagttgtgtgttaaaatgcagtcatttatttattctgccagctttctggaaaatatttaaactctctatctttaataaaccatccccacagtgtaggggcaggttcgacctatagacttgggtgatgcctgagggcacttactccaagcccagggcctgcccgaggtagggagtcttacaggagaccttcccacctgccgaggccctgctgtcagagggaggggaagcagaggtgactggccccctgaggccagcggccagatccatgcatttatcatggtgtggtccaggactggtggtacccttcactctgcaaagcccctgtaagggagacccaccgtcctggactgcagattcttcccacaaataacctttgaaggacaatgggcagcccacagttaaagataacaaggatagaaatggttaggcgaatattcatggagagacttgagtccgtttggcaaatcgggctgatttccagtgaatacctacagtgggcgtaggacaattaaacatgtcaaaaatgtagtctcccctgtaaacattagattctcctagtaattggccgggcacggtggctcatgcctgtaatcccagcactttgggaggccgaggtgggcggatcatgaggtcaggagatcgagaccatcctggctaacacggtgaaaccccgtctctactaaaaataccaaaaattagccgggcgtggtggcgggcgcctgtagtcccagctactcgggaggctgaggcaggagaatggcgtgaacccgggaggcagagcttgcagtgagccaagatcgtgccactgcactccagcctgggccacagagcgagactccgtctcaaaaaaaaaaaaaagaaattctcctagtaatcattttagactcttctacccactgccccatatctcagttggctcagtggattctgcaccccaaacgtctcatcatccatcccttcctccctggctcgggccctcatcagttctcatctaggctagggttgggtttggttttggcagcagacctaaagcagtcttcctaactctagtcttccatccgttcctttaaacaagcactcaagtactcacagcgtccattattacactgttttaggggttccagcgaaatgcgaggatgacatggtccttagccttaggaagcctaatttgtttctcaggagctaaacatccagtgttattttcacactcacttcatgacaacagtgataggttgttctaagaagtgtaaggaacaatggtagggtattgcagcactggggggcatgtatcagggcgggcttcctaagagaggcatccgtgagagcgtctttctagtctgctcactgcaggcgggtaggtgggagtggggagagccattcgggccagggaagcgtctaagaagccctgggtgggaaagaacctttagagaactgaaagaaggttgcctgtggtgaaagggaaaggagtagcgtggcttgcagtaggactgggagcgtgttttggggacatggtaaggagtttggtcttcttcctaggagcagtgggaatacaggggagaattttgaggcaagggagcgacttgttcacattttttgttttaaaagatcactctgcttccagggggagggcaggtgggaagggcagtccagggtggaggtaggagggtagaggtggggggccatggcagtaacccagggagaggcaatggtgattcaccctgggcggggtgttgggagcaagacgcaggagatacttagtgggtaacatcctgtatttacattaagagtggggagagggcagaatcaaggctgacgcccaggtctctgatgcctgcaactggagatggcaggacaggccagggggcctgtgcagagatggcagtccaggccacgggggaggtggtttgggcttgtggggtaggaggacatatgggatacaagctgaggtgctgagcaggctgtcggtgaaggtctggagcccgggagatggctgggctggacataacatttgcgagccatcagcatccagatagtaatgggatccatgggcaccgatgagctcacccaggggaaattagacatttcgaatgtgcctcctgcaagacagatccaggcaaaatggcctcctgtttaaaagctgacagcagccctccctcccactttagcacccagggccccacttatcttcatccctgagtgcccccaggtgcccttccttcgtcggtggctatgtggtatttagtataaacctctgtcatcatgattatcccagaggcctgtcacggaggtttattttcagtctcccattagatataagctcctctgggcagactttcctgggatcgtctctgtgtcttttgcacctcagcagtgcctggcacgtggtgagtttcctggtgaaaggtggttgaatagattcagggtccatcttatttatcttatagcacctcctcaaacacacgcaccaggcgccaccaggcaccatgccacacatgtgacaggtgcatgccaaataaagcacgcccaccgcttccctgtgtgcttgaaacaacgtgtatcaatgtgtatagtatataccacatgtgcatataactgtatgtatacctgcgtatctacgtgcattatacacacatgcacacatgtgacattgaactctacccttcagcaaagaactggtagacttagacattcagaagagaaggctttccagacgagggaccttattggtagaacccagaaacatatgaatgcaggcccaggagactggcttagtacagagacaaaacttgccaccacagttgctgctgaatgcctctcgctagacaccgcttcactggaatcaataagtagagacgtttgcaaaaagcatttggtggtttcactggcttaaaacaaattattttcagccaaagtaattgacacaatgaagtggtttttggcaactccagcatttttaacagtaaaaaggatttgacttaaatcgccccccaaaaagttatgtaacatgaattttaccattcttagaaaaatatgttccagttgagaaacgattgaatggaattaggactctcttatactgcagcattactgtgcactttagccccagctgtcttcatcacaaacacttgaaaatccttaggaatagaacttagtgatgatgctttatctactattgagtcgcttatgcttaccaatcctgtatgcaaaatgtggcagccgctcccaggggactgtatggagctataataaagataatgatctgttagctcggcttcaccgaattagtcctttagaaagtaattaagcaggattgcccacactccactgctcccaaagactgaaatctggcttggtgtgtcatttctttgccttccttgaaaatggccttttattgagttgatataatttaattatataaaaatacgtgttcagattgcatcttgtacttaattatatcttacgccacggagttatttcccagccagagcttgtgctgttagaaggtggggtccatgtctcattcatgcgtgtatgtgtgtgtttaggtgcaggagaggaggggagagaaatgctggctttaaagagtgctcaccaagcatcaggtgttgggctgagcatttttaatgtattcttttgtttaattctcacaacacccttttgaagtgggtcctattattgtctccattttgaccgacaaggaaacagaggcccaaaactttgagtaacttgttcaagattgcctggccagtgtgtttcagagctggggtttgaagccaagcattctggctccactgtccatggtatactaagtactcagttatgctcgatgagtgaatgatgggaaaaaagatgggacagctatagacctgaaagggacttaggagattgttctggtctgcccttgcctgtaggagaggccacacatggtttacaagtgcagagcaaaggcctttcccttggattattggaggagtctctgaacagatttccttgtcttcacctgtttttcttcaaatcctacttcttcagcacttttaaaaatggaaacctcatttatctctgaattgcccagcatcccccggaagttccccatgactcttggggttcagggccgattctgggaaccacttgccacctgcttccctgaccctttcctcccagggccctggatgcagccaccctggacttctggtagcttctgaaggtgccaggctgttgtgtacaggattccacatgctgagcgcccttgccttccctgcagcgtcccttcctaccccttcttcacggagccgctcccttgtccttcagaaccctgctcccatgccacgggaaacctcagggcaggtagatgtaggcgcagctcactgggtgccccttaggccccaggccacgtgtctcagggcatagccagctccacttaaccgaccagaccaggaggacctgtaggatgtcattctggctcatgtgactcagtgggctctcagtactagtttgttgaacaaaagagttcagagtggaaatattaaatggtactttgagtcgtgcctacttaggacattttaacttttctctgttagcagcccgcaccaactgctgtgacttagtgtttgtgaaactcttccgtctttctgttaacagttgtagttctttcagtgtttcatcagcagccatattctatttacttattctctttcttttcttcttcttcttttttaaatcttttgaggtagggctcagtctgttgcccaggctggagcgcagtgatatgagctgggctcactgcagcctcgacctccccagcccaagcagtcctctagcatcagcctcctaagtagctgggactataggcacatgccaccgtgcccagctaatttttttatttttttgtggaaatggggtctcgatttgttcctcaagctggttttgaactcctgggctgaagtgatcctcctgcctcaacttcccaaagtgttgggattacagccatgagccactacacccagccctagaaccctttttttttcaaaaaaaaatttaatcatggtaaaatacatataaaatttagcatcttacacatttttaagtgtacagttcatggcgctaagtacattcacattgttgtgcagccatcactgccatccatctgcagaacttttcatcttcccaaactgaaatctgtccccattacataattccccactctcccccgccagctcctggtccagcattcgactttcttgtctctgtgcatttgactactttagatatctcatgtaagtggaatcacacaatatttgtctttttaggagtggcttacttcagtttcagaatgtttttttgaaaacaatagtttcatgaagttacagaatcctaaactgaatgtttaactaaaaggttcaaagccctgggcaagaagtgggataattacctgcacatttgaggctgtcagaacgcctgaagatgtgtcaccggatcacacccacgtgcattacaagcagccctgctcagcctcctgtgtaaagttttggtatccgatctccagaatcttttttttttttttttttttttttgagacattcttgttgcccaggctggagtgcagtggcgttaatctcggctcaccgcaacctctgcctcccgggttcaagcgattctcctacttcagcctcccgagtagctgggattacaggcatgctccaccacacccagctaattttgtatttttagtagagatgaggtttctccatgttggtcaggctggtctcgaactcccaacctcaggtgatctgcccaccttggcctcccaaaatgctgggattataggcatgagccactgcgcctggccagtctctggaatctctaatggaaagtgtgctccttcccccaagcaagagccagtacaagaccactctcaagaagggtagtgccaagtatgaggagacagggcatggattcagagctgcccttcacacccaagcacagcaacactggctgctctgacaagccaagaagggtgacaagtgtctaagctcttttaggaatggagagctgggaaaaaatttagagctgtttagaaaaatgatgaggggcatatgtttgctaaagaaatttcatgacatatgccttctgatcgccaataacatgcattctctcccaattagctaagaatctaagaagagaaacagcagatgcaggacccgggatctaggaaggatctggactggagtcttggaatatctctgagtttttgtttttttttaaggattgcttttgtacgtttggcaccgtttgatgccgtgaacgcctgattggagcatctcatttgcaggactgtttaaagagacaagcaggcacaggctgcacacgtgcagacgaataatgaactcttgagaattagcacaaaagattacgtgcattctttcgtgatcctctgtaatctaccaccaaattactttcccagagttggagtgcataggctttggagacagacacatctgggttgcagccttgattctgctgttcaatgaaatgactgtgtgaacttggataattacttattctttcctggcctcagtttcctcagctctaacaaggagagctggctgcaaggcgattctagagagtcctggcaggaagcaatggtgccctcaatggccaatttaaggcgattgtgacaaagtcactgttgtgaaggttggtgcaaggtatagggagaccacaagggctggggtagtggccaggactggtacagcaggcacagtcccaccctaggcctgaaggggcagaggggcagttaccagacctgggttcagagagggctgggtggacagagccgccagacaggagctgtgacagcaaccctaccccaggaagaaaccctgacctcactcccctccctccttcccctccactgctcctacccaaggggaagcctgttgatgcagcccacgcaggggagagagggtggagacggggtctgcagggcaggcttgagagctccagcacagcgttgtctagaatcaagatgctaggacttagtagtaagtgtcaccttagtgttgtcttgatggttacagctgggttgacttatcctcattcctgatgcctagtaggtatctcataaatgttagatttgtggtcttaccacacccctctgcttactgtgtgccaagagtttccaggactctgtggtcatgctttatcagtcacgagcccctcctttttccgtatttaaatactgttcatgccttaagacccggcctacagactatccctggggtgaagtcttccctcatctgtcccggattacttggtctttcctctgcgtttctgaattatgatacatacccctctgatcactgctggtttccctctgccctgcaccgtggtcagctgtgagggcctttgttgccaccatcagctagtgagttccttgagggcaggggcgctgtgttgtctttttctttcgtttgcttctttcccctgctctgcacagtgcctcgcagggagtttgtctccagtacattcttgttgaatgaaaaatcagatgctgaaattatgcaaagagctgtgttatctttaaattattataagagacaaggagagaacttctggatcctgagaagcttttcagtaataccagaaacatttcttcattgtgtacggtaataaaataacacacagtcataggtggcaaagcctcctaattactgtaggttggagtcagagtgtaagaacttccagcattcatggatcacatatattatatacgtatttagtgaaaaacaatatatattatttaattttgtttatttttctatttttgttcaaaatggtctctaaatgcaggccaaccacggtgtgtatttaactccccaaacaggaatctattccagtcttggagggatttgctgagagatgatacagtttacacaaaaccacgtatgctccacactgtggactatctggggaatttttcaagagtaatttcaacacactctattttccatccaattcactgcccttagaacataaccccaatataaaatgatctcctttctaatattttacagtttttaaagcaccttcagatctgtttctcacttaattctcacaaccaaactctaaggtaagtaaaatactactttatcatatttatcttacatgtaatcagggaagctgatgggtgctgagtaacttagccaaggccaaatagttcagtgaggaccacatctcgatcctaggtctcccgaaaaaaaccccaggtttctttgaactataccaagtggctttctatttgttgtcttcatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaacattttctgaacattttcaattcccctatctgcttaaatatcatatttatcaaactttgaccttgttcttcaggccacattgtaggtaaagtggcttgttttttattttatttatttatttatttaattcctcttctccctcaaagcacaatctgctgtatgttaaaggggcggggaagctgctgactttgcagtagcgcatacttactcacgcaattttccattctggctgaagtaagggatgagacagcatgcccagaagctgtgtccagcacttggacaggcgccctggtcggcaccctgggaacctcggccgtgcactgccagctttctgggtccatcccagccctgggtgtatggcagatgccttgagatttaacagcccttgagtcaggcctgcaacgtcttatctgcgatttcaacatccagaaagctgtgaaacccagatgttttttggtaacttgtttgctagttggatttggcctgatctgaaatcatttgatgggtggggagaactcctctgaattgaaacatgtggcttttaatcgtttgtgttcatttcttttagtgtgaaagttctgcttttctgtagaggtatttttgaatgtgactatgggtcttgtcctaggcccttctgggatattggctaatgtatggtgtatgccctggacttccgttttaaagtctgaatctgagttcaaaaacatttcaggccccagggatttgaggaagggtttccagaccagtataaccagacagccgagccggccctgtaccgcgtctggttcctgggtggttcctgctgcaatgcggcccagtcagggcactgctgctgacttgtatctgcggacactccccagtgtttgagtgatgtttacgtggaagcctggcgtgtaggaagctggcgcccctgggggaactgcaaggccattttacagcattcacctgtcaccgtgtccttcagaaccagccagatgctacagagccaggctgtaccagagtccaggcccatgaaaacaaagttcagggagactctgttgactttgctaaattcatgggttccttccttccttcatttctttgttcaacaggaatttatgtatctgccataagaagacctgtgcttggcttgtgaaaagtaacagtgacacttcacatgagtgtaacatctgcggtttatggttttgttgcagtgtttcatttcgtcctcgcaaccattcagtggaccagctggtgttggcccttttcatagatgaggaaactgagggctaaatagcttctccacatctgcagattccaatcctcgtggcttttcctgttctgcggctttcataggccctctgcattatttgttaagactcagctattttctaaccccaacccacttgaagcagtggctttttcagatacccgggacaaatcacgtgaccttgtggctcagttttctatgccataaagtgggattccttcctaatccttgcaactcttaagtgaaataatctatgtgactgctttgtgaattgtgaaactcaatctggtgactatagttaataataacatattacatgtttcaaaattgctaaaggagtggatcttaaatgttctcagcacaaaaaaatgatacatatgtgatgtgatgggtatgttaattagcttgatgtaatcatccacatacatatacatgtatcaaagcattgcattgtaccccctaaatatatacaattattgtcagttaaagaaaaaactctgatcacatggtaaagtatttctgattcttcttcctcttttcctacatccagatatgtctgtctgggatcccatatggtggttctccccgtctcttatgatgttcacctcatacacggttgacccttgaacaacgcaggggttagggggtgctgagccctagcacagttaaaaattcatgtataataggggttttttttttgtttttttgggtttttgttttttgaaacagggtctcgctctatcacccaggctagagtgcagtggttgatcacagctcactgcagccttgactcactgggctcaagtgatccacccacgtcggcctcccaaagttctgggattacaggttcgagccactgtgccttgtgttgagtgtaacatttgactcctcaaagtcttaactactaacagcttactattgaccggaaccttaccaataatacaagcagtcgattaacacatattttgtatgttatatgtattgtatactgtattcttacaatacagtgagctagggaaaggaaaatgttactaagaaaatcaagccgagttgggtggctcatgcctgtaatcccaacactttgggtggccaaggcgggaggatcacttgaccctaggagttttagatcagcctgggcaacacgacaaaaccctgtctctaccaaaaaaaaaaaaaaaaaattagccaggctttgtggcacgaacctatagtcccagctacttaagaggctggggtggaggattgcttgaaactggaaggttgaggctgcagtgagccaagatcacatccctgcactccagactaggcaacaggaatgagactatgtctcaaaaagagagagagagagaaaggaaggaaagaaagaaaataaagaaaaatcataaggaagagaaaatacatgtactattcataagtggcagtggatcatcacaaaggtcttcaacctcattgtcttcacattgaataggctgaggaggaggaagggttggtcttgctgtctcagaggtggcacaggtggcagaaaattcctgtgtaagtggatctgcgcagttgaaacccacagtgttcaagagtcacccgtacttatttctctactctcctgtctgacatctcaagagctaagcccccttggtattcattcatctttgagaactctgcattgcctagtttaataggtgaacagtacgtgtgtgttggagtttgtacagtggggagatgtattgctggtaattcagggggttagggttgctgatgcagtcagggaggcctgactgtgcatgcccagccccttcatcaccaggcgccatgtgggtgcccaaccaaagacattcatgaggctgtctctctgtgataacgaaacagctggacatacactgagaaaggaagtcagccaaatgaatattttctaacctaactctaaaaaggtagatgccaggcagcatccaggtgacgatgcttttttgaggctgacatagtggtacacagcattgaggtgctgtcagatctcttccctgccgtccacctcccagtgaccattcctcggctgcacaatgcgcctccccacatgcattgtcccacggccctccctgtacaatcggctcttcactttgcctggctcagaggtgtcttccataccaaagaggctcagagtgtcaggatttaggggaggttggaagcaggtggggtagggaggggagtcagccttcctcctctgcagggttgcagaaagtttcaggggtcaaggaaataataaacacctttgaatagaggctcagaattgtttgtttggagttcccagtgactagtatctcagctgccaacagctttggtgcaatttacttttctttagctgaacattcttacgtggttttaaaagcaagtaaacagataaagtgtttctaagtgtaataattctctttcctgatgcatagctaacaagcagtgagcaggcagaggggccctaaaccaaaggctctctcatttactctgtaaaaaatctgttccacactgcgtaacctccacatccttctcctaaggctgaataaattgggtgccaccctttgaaatgtagtactctgtttggcccaggaaccgtagttagccgtctttcttgaggaaagctgattaatcttgttttgccaagcagaaggattatgggtatgcctgaaccacttttgtacgctttgaaatatcagccctgtcaattttgtgtttctcagtgagggaggaacaggggacggtctcacgcaagagaaatcctggcttttgatttaaggaaaaaacccccagccacttagctttttttctttttaatcattatcttcaagacaaaaattcaaataccctaacatgtacaattatatagtgttttggttgtagaaaatatcatttggtagattatcaagactgacaaaaataactatctttacctattaaaaacgattgagatggccaggtgtggtggctcacgcctgtaatcccagcactgtgggaggccgaggcagaaggattgcctgagcccaggagtttgagaccagcctaggtcgcatagtgagacccggtctctataaaaatttagccagttgtggtggcgtgtgcctgtagtcccagttacttgggaggctgaggtgggaggatcgcttgagcctgggaagatagttgctgcagtgagctacaatcatgccacagctctccagcctgggaggcagagcaagactctgtcttaaaaaaaaaatttttttttaactatagagatggaggaggactggctattttgcagatcattataccaatcctaatcaatagctagttatcaacaatttcatcaactcaattggaattgagacttgagtttagacaagctgaatatttatttttatgctccagaaaacctgacccaagaatcccttttacatctgccaggaggttgctggtgcctgggtcagctgcccggagcacactgtgcctgcgtggagacctttcttagcagacgaaggccagcagcatcagagcagtgcaaattgcaagcccaagatctaaaacagatgatgaagagctatgtatttgtcactgtatccttccacggtgttttatgctattgtaacttcaagagttgacacagttctttccccaacactaaaacatgaaagggtcaggtagagctgttgccattttcatggaaacctagagttgtaaaggacctcggaagattcaggactagatttcatcttaaaagagacattgaaaaccagtaactcaaaaggaaggtcaaaggaacttattttatttttatttaaatttttttagggaccagatctcgctttgtcactcaggctggagtgcagtttcttggcatgatcctggctcactataatctcgaactcctgggctcaagcaatcctcacaagtagctagactacaaatgtgccccaccaagtccagataattttttttctaaattttgtagtgctgggatcttgctgtgttgcccagaccagtctcaaactcctggtctcaagtgctcttcctgccttggcctgccgaagtgctggggttacagacatgagccactgtgcctggctggaaagtattttattgtaaagcattttaaaattaataggtcatgaaactataaaacaaagaatagattgcataatggattgtgtgaaaatacaagttaaagctattttacagagcagttagaggcttgtctcatacctcatctgaggctccagtgaatcccaccccaaatggaccagttagcatgcagccaataagacatcttcctgggccacagacaggtcctcttgtgcaggacagctgtcatgcacatggggctcaatggatgttattcttacagcgacctcgtgccaagcactatgctagcatatatgctcttcatttattgcagtaatccttggagggtaggttggattaccttggatttacagatagaacagctgagctcagagagggaaatggaattactcagggtcacacagctagggaggggcagagccagtattcagcctggtttgtgtgattccagaaccttcctgtggagcccatactcgtggcttgagcattgcctagtcattttgatatctgcgagcttgagtttccccttatgctaaaactgggatctgtgaggcttggcttttttttttttttttttttgagacagagtctcgctctgtcgcccaggctggagtgcagtggcgcgatctcggctcactgcaagctccacctcccgggttcacacttttctcctgcctcagccttccaagtagctgggactacaggcacctgccaccactcccggctaattttttgtatttttaatagagacggggtttcactgtgttagccaggatggtctcgatctcctgaccttgtgatctgctcgcctcggcttcccaaagtgccaagattacaggtgtgagccactgcgccctgctgaggcttggcttctaagaactgcacaccttctaatagtataatgatatgcccccttgttgtgtcatgactaacattgatttattttagagaaaattgtaattgatctatttttcttctgcaaacaatggtttctttttgactttgttaaaatgaagatgaatagctttttattttagagagccaaattgtagcagctctttgtaaatactttctgcattctagaaaaacaactttgattggatggcagaactggagattagtagaattaggaaaatttctgagttactctttgttgggtttttgtgagctaaggggatttttagggtgtttgtgatgtttctttatgacttgaaaggtaaattgcgtcggtgacatcagccttgattctgtcataaagatgcttacaagatgagcatcttgtgtcatgctcagaggtaaagggcggctcctggaagatagaaatctgacaggggtaagaatctgacaggggtaagaatgtggagattcttgtgaagcaagcacttcagttacggcagctgctgttgttcagagcacagatgtttgcacattgttttactttctagtcactggctttcatcaatggaatccttccttttggaggattattattgatgtcaaatgttgtcagatgaaactcaaggcatggcctggggtacctctgtggtcagagagatccgactagacgtactttcactcatatttgactttattattttttttagacggagtctcactctgtcgcccaggctgcagtgcagtgacatgatcttggctcactgcaacctccacctcctgggctcaagcgattctcctggctcagcctcctgagtagctgggactacaaacgcccactaccatgtccgactaattttgtatttttagtagagacggggtttcaccatgttggtaaggctggtcttgatctcctaacctcaggtgattggcctgccttggcctcccaaagttatgggattataggcgtgagccaccacacccagcccatgtttgatttgattcccacaaccacagtctgtctgtaggcagataggcctcgtgctacagataaggacatcaggagcttagaggctggatggatgcttcactcagctcgcctggtgacagtgggattcctggtccataggtcttcttctgacccacattgcttcttagtttggtccaactttgaaagttgcatgtttcatttgaaatgaagaaggcctaagccagaatggtacagctgtcacatccaagtgtaagatccatttctaactgccagaggcatggcagatgcctcagagaagggaggagtccatttggatggagctgtgtgtggctgacatcttcctactccatgtccttcactttggcacgtaggttagcagttctcaagctttttggtctgtcttgcgtttaaatggctgttctcccaggcttgattttgtaacaccgtgctttgattccttgagaacattgattctctgagttatgcagaccttccaaatgtgacatatttcattatacaatatcaaaaaagcacatgggttaatatcaacccccaatgtcatcaaaacagcatgtaggtgttggggagctgtcaggcttacagaggctggtacaagttttccaaagttctttcttttttttctggaaagctcaaatttatccttggcagcaaatgctgttgtttttcctggagtgacgggcttactacattcatttttttgagaaaatgattatagaacactcaggtgtgaagaaccctggtttgtccatcagttgttctttcaagtgaaaatgatgttccctcagaagaagctcacagcttgactgcacagtgctcagtttggctggtgtgcagcaaaagtgcttcataaagagacctgtactcaagggttgagctttaataaaattaatattgtttacagcgtcatcaaaggcctttgtatatgaacttggcatctttcttgtaggtggcagtgaagaagagcacagcgacgtggtgcctgtcccggctggtgctgaggcagcccaggtgccgccaccatggctcccgcagtattagtgcaggtgtcacacaacgacaaaggaaattagagcttggcattgttaaggacgtaattctgacctcagggacttcctgaaggggtctcagggactcaggggtctgtggaccacacttttagaactgctgctgttgagtattggaaagttccccattcggcacattccttgagggccgactctgtgccaggtgttgtgctaggtgctggggatactcagatgaacggcacagtccctgactgcaaggagctcacggtctaatggagaagggggtcaagtaaacagatgcttgcaaaaccttctcgtaagtgccatgatcacagtaagcagaagggatgctctgctagagtgtaggtggagcccccagcccagcttggtattctggtggtggtgataaggggtgtttcctggaggaagtatcactgagctgagtttggaagggtagaagtagaagtaaagccagttaaagaagatgggggaggtgttccatgaagatagagtggctcgggaaaaggcttggaagcaggcgaaagtgtgcagtgttcaagaaaccacaaatagttcagtagggctgcagtacaagagttgggggtgggggctcagggataagagggggccaaagaagtatctggaggccagatcccaaagacaatggagatccactacaggagtttagcagggatgtgaggtgatcaaatctgcactttggaaggatcactcagacataaagaagaggaatgggatgcggagtgatgagagtgatggataaaccagttgaggttgttgccggagtccagaaaacaccacttaggcccaaagcaaggaggtgacaatggaggtgaatgtgtggatatttagaagatatttaatgtcctatatctgcagatattcgaataggcaggatttgatgattgattcaatgtagagggcaaaaaatatggaatcagtcaaagatacaccaagatttgtagattgatggctgcacggtggtgctttcatagaggtgaggggtgtgggaagaggattagaggcaagatgaccatgcgaacttcatgtatcatattcacacacacgtgtgcatcgctctatcttcaggcagaagtgtccagaaggagtcagagctggagcttgagagggttctggccttgaggtgtcagctgaggagtcatcagtgtaggtcgtggttgagggcccccttgttgatgagatcacccagaaggagagtgtggacttgccgactatagtcacagggctcaagtcaggagagaagtcaaagcaagccacgggttttaggaggagggaaacctgaggcctggatcatcctggtccttcacgtctgcagaggagagcagagaagaattttaaattattaactcctcaactaaactacatatcgtcagaacatgcttttcaaattaatttaattgttgattttatttagttttttagagacagggtctcgctctgtcacccacgcttcagtatagtggtgcaatcatagtttactgcagccttgagaaactcctgagctcaagtgatcctcagcctcctgagtggctgggactgtaggcatgcaccaccctgcttggctaagttttttaaaaagttgttttagagacagggtcttgctatgttgcccagattggtctttgaactcttggcctcaagtcatcctttcaccttggcctcccaaggtgtggggactacaggcatgagccactgcgcctggccagaacatgcttttaaatgtaacatactaaacatgatattttatgagaatacagcctatataatatacgattttgttcctgagctcacacagactttaggtctgtaaaggatggtaaaaataccaattacagtttatatttccttttcccaccagaacatttttattttaaaagtagggtggtttttccttcccatctatggtttcatagttctcggaaatgttaacccttctttctctatacgaataaggtgtcctggtaattttgcaagtgatgatttccattatggtgggtggccacgacggaaatgatgttagaagtgccagcgtgcacgtgaagtttagacaagatctgttccttggccctgcggtgacgggaagaggggagatggaggtgttcactctcgtcttagagcttggtgtcaggaagctctgtctggaggtttccctccgtggtgggaggggtgaagcagacatgggagggggaaaaggcgggtctgcaacaggagcccagcctctcgcaccgagcatccctcagtgaagcgcccaggcccacaccacgcagccagcctcactgggctgggggagggctcacgattactttctgtttctctgcgtttgaaaatcttgtgtaatgtgcttctgcacttttaaaatcaagaggaataaaataataaccaaataaaatgactcttagccctgagcttgtgacacacaggcaatttgcttatcacctaggccaccaattaatagtacttccctataactcagggcctggggggttccaatggaagagctgagcatgtctggaggatgttcctgtctgataccagccatcctaacttccagaatataggcaacttggcagcaagagttttaaggttattatcaacctggtatgtggttgtggaagttgatatatctttacatatttttacttaaagctttttagctctacctatacatgggagcaggggctaacacagtattttgttttattgatatatttttcgttttgtggttactgaaagtgaattgtatggcacgttgctctcacttgtaatcagtgacggtgtagcctaagaaacctggtcactcaactgcattgctcagcggagaggaagcttctgtacgtcttggaccttactattggtagcccgtgctcagcagctggcctcttgcaaagggaggactattgaggatgaagagaagaatcttgacatctcaacctcttctcaccctggtttctgcatcatagttttaccatttggttagaacaccagttcaatgcacagtcagatatacagtgcaggcaaaatacgaaaccaaagatacagagtaattacttttccattatcccaatgtactttttctgtgagcaaatgaattcctaaccacagcttgtataccggtgtcttaacgtcaggtaaaggatccaggggcaggttccaaattgaagctatattttgctttagttcacctccattaacacttaggtccaagtgtcgtctctagtcggttgctgtaaactgaactgaagtgcctccactacaaggagatgaggaaaagcatggaaggaggagccatgtggtgggaaggtgcacggaggcccggtggcagatttcagctgagatttttcaaaagcctacacactttctaacagtggaaccacttgccttagaaagtgcccgcccccaattgcatttgaaggttcaagcagaggctggatgatgcctaacatggttattgcagcaggacttcttacatttactttttttttttttttttttggagacagtgtcttgctctgcccaggctagagtgcagtgacacggtcatagctcactgcagactcaagcacctgggctcaagtgatcctactgcctgagccgcccaagtggctaggaccgtaggcatgtgccaccatgcctggctaattttgttgttgttgagacagggtctcacttggttgcccaagctggtcttgaacttagtcctcctgcctcaacatctcaaagtgttgcgattacaggcttgaggcaccacgcccagcctcttactttaacttttaaatttttcctgcttttatatagagctttttaaaatttgagcctctccaagccgggcaaagtggctcatgcctataatcccagctgttgagaggctgagacgggggaatcacttgaggccaaaagttcaagaccagcccgagcaacatagcaagaccgtctctccctcccttttgtctcttaaaacaaaaatgcctcccagtagccttgcaaaacaagaccattatccatatgatacaggtgaggaaattgggtctggctgagtgacttgttcaggataatttgactccacatcttttgacatccagggctctttccatttgtcacacctgctgccttctgctccaggagaagcagattgtgccactgcactccagcctgggcagaaggaaggggacaccggcccttttgactctagagtgtctgtgccatgtgacaacacatgatgaaatggaataggaatggatctaaaaatcattgagattaggatctacagatacatttctacgtgctaatatgtcggttttataatgtacttctgtggctaaccacagaccactggcagggaatgtatctgtggttagatagctagagtgtttgttcactccctatcaggagggcagtaaatcaagaaggcaggttgaagcacagcttcaaatgctgccacgtggctgtggaagactgtggaataagcagcagccagccagcctggtgtgtgagatgagggatccgatcggttgctcgtgttggaacaaaggcattttgcagccctccaggtggttgcagatgattgcaaggggaagctctgatgtcctaccagagggcaggttgcatgtatcttcaatatagttaggagtccttagtatcctaggacatatgtttttttttagttccaccttttgagaccatagctccatcgttaatggtgtttttgaataccaaatgcaggcactatatatgagaatacatgtgcatgtggctgtgtgtgtatgtgtgtgagagagagaggggaaaccctggtaactgatgaataatcatttaacaacactcagctgtttgaataacaatagtaataattctttgtatttgtaagctccattcacagatatgatttgaatggtaatataactagggttaaaaatcattattgttctcaccagtgctctgaggaagttgagcccccagctggaggatgagggcagggaaataaagatcttgtactgcaccttctctgtcttcctttgatttatctttttcatattcatttatattatttctccacaccccctccatctctctcattttctttcttagcccctcttgtaggtgatacctcttggactgggacttgcagagccagtgattgtgccaagaaatgccgtttcttttttctttattatccccatgccccacatgaaaggccattgaacttaaacttgcctgcagggggtggcagtagaggaagcccacttggaggggctttgccagccaaagccacactcctcctttcttcagttgcgtttcttatttccatttctttggttcccgctcaggctgctgaagcgtctctccagtcttttcctattttagcacgccttctttttggcctgctttgccccaccagacatgctgttgtcaccagtccaatccatctgtgttttctggatacacactgggtgtcaatgctttgacaagtgtgggttccagcaagcctaagcgccgggccctacagagccatctcctccgggaagaagacccagccccctgtgcccttctggtttgagatgcgtgatcctgccgtgccctccggttccagggtggggtgggacggccagcttatgatgtgtaactagctgcttgtcgtccagactcagttgcttttaataaaattgccacttaagagaccctgctgctggcagagtagcttcttttcttctgcttgtgctagttcccggctcacagcagcatctgccctgcacgtgggtggtgtcggccttgccctggccgcactgtggctgtgtccccacttagccatcagaaccaggcatttccagtggagtgcagtgttgcaggagggtcaccaggcttagtgtgatgaggcctggattacacttcgggtctggacgtcctctctgagcctgaatttctgtgatctataaaattggataaagtatcaaataataccgatcctaacagtcttgatcattgtagaaacaaatgaaccaatgtctggttagagcctggactgtgaaagtgctagaacgtgttcattcttcctgcgtagattgagtgtctccagggtgccaagcccagttctaggctctgggaaagagcagtgaagacaacaaaccaacaaaacaagtcctcacattctagtgggagagggacagtgggcaagcaagcagataagtgaacaagagagttccctggagggttgagtatggtgaagaactaaaacagtgactgaagggacagagtgtgtagcctggctgtcacttggtatctctctacttaaactggagtcaggcgccatttcctccaggaagctttccctgattcttccaggctaaagtaaccacagctgtggtgcattgtgtagctactaggccccaaggactttcccatgcatcatctctctctcttttttttaagatggagtctcgctctgtcgccaggctggaatggagtgccgtggcgcgatctcggttcactgcaacctctgcctcccggattgaagggattctcctgccttagcctccctagtagctgggattacaggcacccgccaccatgcccagctaattttttgtatttttttagtagagatggggtttcactatgttggtctggctggtctcaaactcctgacctcaggcgatccacccgcctcagcctcccaaagtgctgggattacaggcgtgagccaccacgcccggctccatgcatcacctctaatcctcattctcctctatgtgctaagcgttattctcaccatgtttcctctgtgtcttatttatttattttttagatgcatcacgtttttattagggaaatgtaaatcaaaatcacaataatacagcatggatccctgcatacacatactatgtacacacatatgtatgtcagtaattggcctcggaaatgcaaatcaaaatcacaataatacagcatggatccctgcatacacatactgtgtacacacatatatatgtcagtaattggcctcaacacagtaagtagcttttcaggtcttatcagtgaaaatttcttttttttttcttcttgtaaaaatcgctttaggggtacagtgcaggtaggtttgttacatggacatattgcataatggtgaggtttgggcttctggtgaacctatcgctggaatggtgaacactgtaccctgaacagtggaccccatagtgagcacaataggcgattttcaatcctcccccctcctaccctccacccttttggagcctccagtgtctattattccactgtgtgtccatgtgaaccactgtttagctcccacttatgagtaaggacgtgcagtatagaattttctgtttctgagttactgcacttagaatagtggattccagttccatccatgttgctaaagaagacatgatttcattcttttttatggctgtgtaatattccagggtcatttttatttttttgagacaggatcttgttctgtctcccaggctggagtgcagtggcacagtctcagctcactgcaacctctgcctccagggttcaagtgatactcccacctcagcctgacaagtaactgggactacaggtgtgtgccactatgctcggctagtttttgtattgttttgtagagatgggggtcttgctatgttgcccaggccagtcttgaactcctgggctcaaatgatcctcccaccttggcctcccaaagtgctgggattacaagtatgagccctgtgcctggccaccacattttgtttatccagtccttcattgatggacacttagattgattccatgactttgctgttgtgaatagtgctgtgatgaacatgtgggtgctgatgtctgtttgatacaatgatttcacttcctttggatagatacccggtagtgggattgtgggtggaacgtacctcagagagatcaagctactgcccgagatcacatactatcaaggggcagaactgagtgtcctaactcgagactcagccctttctaccacatctccttgtcttctctgtcccaggccttatgttcacctctcttcaacctcaccacagtctggaaatttatgtttctgtgtttttcctgtcagcctctgaactcctgaagggctaggaactgttattgtcagcacctggagccacactaagcgcttactaggagtttattgcaagtttactgagttcataactagccccagccccttgccatgtatttccacttagatgccacagatttctccttcagagtgcttgtagactgcaaagggagcagtcgaggtgaatatgcttggagaggacataagggaaggttttttcatgtaaacgaactcattttagatgtaaggcatcacttttcagtgaagcagggactttttacaaagtcttgcctctgaactttacagtaagcaagccgagatccatgcttaccactgcaagaaaactttggtgggccgttgtacaacagtaggcaattgtgttggcttaatgtgagttcttgtgaggttgacctttgtatgttttgaaagtctttagcatttaaagtctgcttctgtgcattgatttttttttttttttttttttttttgagatggagtcttgctccgtcacccaggctggagtgcagtggcgtgatctcggctcactgcaacctcctcctcccaggttcaagcaattctcctgcctcagcctctcgagtaactgggattacaggcatgtgccaccacgccctgctaatttttgtatttttagtagacacagggttttgccatgttggccaggctggtttcgaacacctgacctcatgtgatccgcctccctcagcctcccacagtgctgggattacaggcgtgagccactgtgcccagccctatgcattgattttgagcaagaaagggataggactaaattatgtggatgcactgtacaattcccaagaagggttagaattctagtcttgccaactcactcctccaagggcccaagtttgatcaccggaggattattccttaagcagcacgccacagccttctgcagttccccatgggcctggtgagaatgagcccctgccccattgtgaatggacacttctttgttcattgactaacgccactgctgtgtaacaccgtggtagggtccaattttagtatcatcttgcttcttgggaaaaaaaaacaaaaaaaaacaaaaaaacaccttaggtcagaaaaagacgagactattgaagaattccatgcatgttataaatgtgattaagtccacactgctgccaaggagtggaaacaaatcaggcacagaactcatggtaggacttcatcaggactggaatattctacacaacaaaggacttcatcttgactagggacagagcaggatggagctcagcacatggagaagactatttgaggcagagagtgtcagtaaactcatccattaatttttttcattcattcagcgccagattttgtacacgtactaagtgctgaataaatacagcagtgctgcaggcagtcccagggagccagtcactgactgtaaatacgctggggggtatttacatgtagagggggatgaccacctgaagacatggggagaagacagccagtgagagaggcctcagaagaaactaaccctgggccctaatccagtctggctagtgtccttataagaagaggagattagtcacagacacgtagaggaggatgaccacctgaagacacagggagaagatggccagcgagagaggcctcagaagaaactagcgtaactggaccttgccggttttgagtatcgtgagtaccctggcagcatagctggtatgagtactcgaagtaccccggcagagtagcggcacctagtagccacaagtaaggtgcaaatacccttgcagcgtatccaggcccagtaggcacgagtactataaataccctctgttatgggcttacttgtgttaccccaaattcatgtgttgaatctctaaccctagtgcctcagagcatgactatacttggaaatagagtctttaaagaggtgattaagttaaacgtggccgttagagtgggccctactccagtctgactggtgtccttataagaagaggagataagacttagacacatagagggggcaaccacctgaaagggagaagacggccagcgagagaggcctcagaagaaacgaaccctgctgaccttgatctcaggaagctaaacttgatctcagatgtccagcctccaggattgtttaagccccccagtctgtagtactttgttatggcagccctagcaagctaacatgccgctgtagagtgtgcagacccgcaggcatgggtcccgtgagcacccagcagggtgtctgggtgcagtagatgcgatggttggtgtataatatgaacactgtctctgcaggattcttgcctgtgaatgaaatggagggaattgaagatttcggtgtgcttgcagtctaggtcttgatctcaggtcatttcatagatgtttgagagttagagttctttcttgttatgattctagtcatgtatgtgttacccaacaatatttcattttatattaaaattacagatgcttgttagctcttttgttttgaatatttctgttcgctattcttatacagcagtcttccgttattcagttttgctttctgcagtttcagttacccacagtcagctgcagtctgaggatattaaatggaaaatttcagaaataagcaatttctaagttttaaattgtatgccattctgagtggcagaatgaaaccttgtgccgtctgctttcatccctttgtcccatgcacccacactgtagacgcccctacccatgagtcacttaataggagtctccgttatcaaatgactatcatggtatcacagttcttgtattcaaggaacccttattttaccagtagtggcctcaaagctcaagagtagtgatgctggcatattgttataattgttctattttattattagttatttattattacttaatctcttacagtgtctaatttatgaattaaacatcatcataggtcaccataggtatatatatacacttgacccttgaacaatataggggttacgggtgctaatccccacacagttgaaaatctacttttgattccccagaagttaactacaaatagcctgctgttgaccagaagccttaccagtaacataaacagttgataaacacatattttgtatgttatatgtattatatgctgtattcttcaaataagctggagaaaagaaaatgttattaaggaaatcataaggaagagaaaatgtatttactattctgttagtggaagcgggtcatcataacggtcttcatcctcgtcgtcttcacgttgagtaggctgaggaggaggaggaagaggaaagcattggtcttgctgtctcaggagtgacaagcagaaaaaaatccacatagaagtggatccacgcaattcaaaccagtgttgttcaactgtctaggaaaaaacacagtgtatatagggttcagtgctgtccacagttccagtaatcccctgcgggtcttggaatgtatctcctgtggttaatgggggggccactgtacagactgggcccttctttgggcgcccctttttctctgtttgaccaactcctttttattctttaaaacccagccaccagtgtcacctggaccaagaatcctttcctgtgtcatccagggcccctctcagtgcctctggaggaggctctgcctttttctttgctgttgcactctcatgagtgacagcatctgtccctcaccccacaaagtctctggcccagaaggttctcttcattattgctttttgagtgaacacttgaatgaatatatcactttcttgaaagccagtctttcaaaatggttgaattattttgttatttttaaattgtggtaaaatatatgtaacaaaatttgtgattttaaccattttaaatgtataaattcagtgacattaattacattcacaatattgtgcaaccatcaccactctctacttcaaaaattttcatgaccccaaactgaaactcagtactcaatgaagcagcacctccccatccctcccgcctcccagcccctggtaacccacagtctgctttctgtctctgaatttgcctactctgtgtatctcaccttactctgtagtagtgacttagatgaaatataatatttgtctcatacaatactagtctttttgtgactggtttatttcacttagcataatgttttcaagttccatctgcttaccagaactatattcctttatggccaaataatattcgattatatggataggtcccattttgcttatccgttcatccatccatggacatttgggttgtttctaccttctggctattgtgaataatgctgttttgaacatagctttgaaatacctgttcaagcctctgttttcagttctattgcgtgtctacctaggagtagaattgccggatcatatggtgatcctacgtttaactttttgaggatctgccaaaactgttttccacaatggctgtaccattttacattcctaccagcagtgcaagagggttctaatttcttcgcattcttgccaatgcttgttattttcattttttttatgatagccattctagtatgtgtgaaggagtagctcattatggctttaatttgcgtttctgtaatgactagtgatgttgagtgtcttttcatgtgcttattggccatttgtatatcttcttagagaaacatctatttaaggtctttgcccattttgaaattgggttgtttatctttttgttattgaacaaaatggttgaaatttaaaagaaaaaagggtgctacttgaaaggtggacccttcctaatacctggctttccaggaagcttattctctgatggtgctagattgacaatgttattttaatcatcgtttcctcttccctcctgctttcttggctttttttgcactttttggagcattcatgttttgcctttttgttttttttgttttttgagacagagtctagctcttgtcacccaggctggagtgcagtggtgcaatctcggctcactgcaacctccacctcccgggttcaagcaattctcctgcctcagcctcccaagtagctgggattacaggcacccaccaccgcccccagctaagttttgtatttttagtagagacggggtttcaccacgttggccaggctggtctcgaactcctgacctcaggtgatccgcccgcctcagcctcctaaagtgctgggattacaggtatgagccactgcgcccattttggattaaacttcaaatagtactcaaagaatcagactgccgataatgtaggacaactgtccagaccgggccctttgtcagatgtcccttttctctctttgaccaactccttttgattctttaaaactcagccaccagtgtcacctggatcaagaatactgtcctgtgtcatctaagggccctctcagtgcctctctaaattccaaattttcactctggaaaattcaacaactcaaatgtattttcaagtgtattttaaaaattagagaactagattgtcaattcacgttatgtgaatgctctttaaaaagtggtaatgttttataaacgtactctgagcagtgttttccagtatattttggtgtgggatttggagcagggctttgaagtggaaaggcaaatgttttcttgggtagatctgaatattccgcaaaatgattccattgatcatccggtcgtagtctcactctctgaactataatgaaaagagagccaggggagagtgcagctgctccagggacccgggacaggtaccctggaaaggcatgggtagaggttccccccatcgttgggcccactggcatcactcctgttgctcccatcggcagctgtgggccagggcctctcatcctgtgtggaatctggcatcaggaattttcagtgggattttgaaagctattctaagagagtaaaatggtgggaggcatacacttctgtgctggctgctgaaatatgtggtatactggcctggaatacaactattttctctttttttaaatgaacgagttcattaagaaaaaaaatctgctgcaacctatagatccaaacacagttcaatacatcttttttttctttgtccaaactgaatattttcttatttttaatatcctgcctcattccatgaaggatttatgatatcttccagcagttgagtaggtttgctgaaatcattaacaaatatacaatttttttcttttcattttttactgaatgatgggattttttttttttttgctgcttcctccccttaacaaaaaagctttcttgaggtatcaacctataataatctgagcatatttaaatgaacaatttgataagttttgacatctgtatatgttcatgagaccataaccacaatcaagataatgaagatgttcattgcccctaaagtttcttttgtgcccctttgtcagccctccctgcccccctccactccaactactgacctgtcactattgattagtttgcattttgtgtaatcttatgtaactggaaccatgcagaatgtactctattttctggctgctttcacccagcacaattttgatattcatccgtgctgttgcttgtatcaatgttaatatgtttttatcgctgggcgccattgtatggacctaccacagtttatttatccatttacttgttgatggacatttgggctgtttcccaaatgtcccagtagtttttggctattacaaataaagctgcttttaacatttgtgtccatgtctttgtatggatggaggctttcatttctcttggggaaatacttgggcatggaatggccggactcaatagtgggtgtgtgtttagctgtctgccaaagtggttgtaccacctgacatccccacagccatgtcagagatgcaattgctgattcacatgctcaccaaaacttggtgtggtcggtctttttattttcagaccttctaacgggcgtgaggtgataactcatttcggttttaatttgcatttccctaatgactaatgatgttgagcaccttttgatatgcttatttgccatctgtatatcttccttggccaagtctctgttagatcttttgcttcgttttaaaattgggttattcactttcttgttgagctttgagaatgcttcatatattctggatacaagttctttatcagatatgtgatttgtaaatattttctcttgttctgtggcttatcttttcactctcctaacagtgtcttttgaaaagcagaagttcttaaatctaatttaccatttttttcttttttaaaaaataatttcaacttttattttagattcaaggggtacatgtgtcggttcttacatgggtgtatttcatgatgctgaggtttggggtatgattgattctgacacccaggtagtgagcatagtactcaataagttttgttttgtttttatggattggggttttgctgtcatatctacaagatctttgcctaaccaaggttataaagatttcctcctcagttttcttctacaagttttatagttttgtttcttacttttaggtttatgatccattttgaattaatttttgcatatggtgcaatgtatggattgaggttcttttgtgtgtgtgggtatggatatgcaattgttccagcctaatttgttgaaaagactgtcttttctctactgaattgcctttgtacttttgttaaaaatcagttgcccataaaggtatcggtctgtttcttaactctctattctattctgttgatctgtttacaccattaccatgttgtcttgatgactgtcacttaagttgggcagtgtaagtctttcagctttgctctttttcaaagttgtggctagtctaggttcttcacatttccatgtgcattttgggatctgctattgagtttctacaaaaatcctgctgggatttttattgattgcattgaatctatacattaaatttttctgtagggaaaattgttagcttaacagtaatgaacagcaatgagtcttccaacccacagacacggtatatctctctgtttatttaggtcttctttgctttctctcagcagtgttttctgagagtaaaagcagtgttactttttggtgtgcagatgttgaacatcttttgccatatttatccctaagcatttcatatttttgataatgtaaatagtcccaattgtttggtgcaagtatatagaaatacaattgatttttatgtcttgatcttctatcctgaaaccttgataaacttacttattagttccagtaacttctttgtgtattccttcgattttctggttggacagccatgtcatttgtgaacaaaggcagttttacttattcctttctaatctagagagcttatatttctttttatttttcactgactaaaacctccaagataatattgaaatgtgtgatatttgttgtaggtgttctatagacacccttcatcagattgaggaagtccttttctcttcctagttcactgagtgtttatcagaaatggatgttggattttgtcaaatgctttttctgcatttattgacctgattacctcatttttcttttttagtctgtaaatacggattacattgatatttgaatgttaaaccattcctagaataaacctattaataggtcatgatgtattcttttttatataagactttcatttcctaaaattttaagaatgtttccttttttttttttgagacaaagtcttgctctatcacccaggctggagtgcagtggtgcagtctcggctcactgcaagctccgcctcccagttcaagcaattcttctgtctcagcctcctgagtagctgggactacaggtgcatgccaccatgcccaggtgatttctgtattttaagtagagatgggatttcaccatattggttaggctggtctcaaacacctgacctcaggttatgcacccgtggcctcccaaagtgctgggattacaagtgtgaggtactgtgcccggcctgcatttattttcatgagggatattggtctgtagttttcttttgtaatgtgtttgtctgattttgatattagagtaatgctggcctaatagatgagttgagaaatatttcttccttatcagttatctgaaatagtttgtgtgaattaacattattttttcctgaaatatttggtagaattcaccagtgaggttatcagtgatttgtggaaagattttgtttttgtttttgttttgttttgagaaagggtgtgactctgtcgcctaggctggagtgcagtggagtgatcttggctcactgcaacctctatctcccggcttcaagcaatcctcccacctcagcctccctagtagctgggactagaggtgtgcaccaccatacccagctaatttttgtatttttttttgtagagatggggttttcatttgttacccaggcaagtctcaaactcctgagctcaagcaatccacctgcctcagcctcccaaagtgctgggattacaggcgtgagccaccgtgcccagactgtggaaaggtttttaactacaaattctattctttaataggactctttagatctatttcttcttgcatgagctttggtacttttttttctttcaagaatgtgtatattttatctaagttactgaatttattggcataaagtttttaaaaatatttctttatccttttgatatctatcgatctgtagtaatgtcagttctcttatttctgatattgatattttatgtcctttctctttttttccttgatcaatttggctataggtttgcaaattttattttctcagtgaactagcttttcattccattgattttctccagtgtttttcctgtttcattgatttttgctctaatgtatattgcttcctttttttctgcatactttgggttcctgaaggtttggttttcttaagtggatgctgagatcattccttccccatcccctacttccttctcctttcttcgtttctaatgtcgatgttgggtgacataaatttctttctaagcgacagctcacaaattttgatatgctgtgtttttatgtgcattcagttagaaatactttctaattttcctttctgtctaatttgagttagtatttgtgaaagttttgtgtctagatgcattattttgcatgtggacattcaatatttccaacaccatttgctgaaaatactcttctttctctgtttaattgcctttgctcctttgtcaaagactagttgactgtatttgtgtgggtctatttctggactctctgttccattgatctatgtgtctgttctttcaccaattacatgacgtcttaattactatagctttataagtcttaaagtcaggtagtgtcagttctccagctttttactcttcttcagttttgtgttggctattctgggtcttttgcctttgcatataaactttaaattcactttgttgatatttacaacaaatagcttgctggaattatgattgggaatgcattgaatctgtagatcaaattgagaagaattggcatcataacagtaatgagttttctaatccgtgaacatgggatatatctccgtttctttagaacttctttaatttcttttattattattatgttttagttttctgcatttaaatcctgtaaatattttggtagatgtatatgcacctatttcatttctggtactattataaatgccattgtgttttaaatttcaaattccaattgttcattgctggttcgtaggaaagtagttgacttttttgtgttaaccttgtatcatgtaacagtgttacgagagggtttttttggtcaattctttgggattttctacatagacatttatatcatctgcaaatagacagttttgtttcttccttcccagtctgtataccttttacttccttttcttgactttttgcactagctaggacttgcagtatgatgttgaatgtatatagtatagtcataataactatttaattgttcttgtctactaatcctattgtctgtgttatttctgggttagttttgcttggttgattcttttatttattttgggtcatatttttgtgcatctttgaatgtccagttgttttttcgtggaggtcagacattgtgaattttgcctcgttgggtgctggatatttttgaattcctataaatatttcgagctttgtactgggtgtagttacttggagacattttgatccttttgggtcttgctcttaagtttgttagggggaccagagtaggatttagtcttgggcaacatcctctgagtcctctccttccatgaggctgtggattatgaggttttccactctgcctgatggtgtcagggtatcaagaactattcccagctctaggtgagctctggtaattgttctaatttttttttttttttggatgatttttttttcagtcttgggtaatttcctcacatgtaaatgctgataagtactcaccagaagacttgagggcagggtgtgggagggtaatctttccagatctctgaagttttttctcttggcaatgctctcttccccattaccctctctgcgaaccccaatcgtcttggctgccctggacttacagccgtgtgtctcagcaacttagggagactcaggctttacctgggttccctccctgtctcacatcctggaaactctccagactatctgctgggctagtcctagggttcacctcttttgtttaccatctttcattgatcactcttcctcattgtctggtgtccaggtgtttgaaagctgatgtttaatatattttgtctgttcttttagctgtttaaggtaggaaggtaatctaatcactgttactccatcttggctggaagcagaagttgatggcactttttaaaaagtagctacagaatgtcaaaaaggattaaaaatttttttacagtaacaacgaatgtggatgggaggttagaactcaaactttcctttagattctaaccttaaaccgttgtagctccaccttttgataggaacctaaaagacaagttctaccataaaaacctaggtattttagtatcttccatagccgaacatatctattgttttgtcctgaaacagtaccaccagcctgttttagaaagttttttcttggaaaactaggtttctggctttggccccattggtgattttaaaccatttgaactgtgcttttctttttgttttgttgttttattgtttttgagagaggcttactctgtcccccaggctggagagcagtggtgcaatcacagctcactgcagcctcaaccttcccagctcaagcaatcctcctgcctcagcctaccaagtagctgggactacaggcatgaaccatcatgcctggctaattttttaaatcttttgtagagacggggtctcactatgttgccctggctggtcttgaactcctgggctcaaccactccccccacctcaaccttccaaagtgctgggattacaggcataagccaccatgcccggctacactgtgcttttctaaatttttatctcaattattaaaggacaggctcttatgcaggggaatattgtctgaaactaatcaaattattaagtcaggaagacaactaaatttttggatgatgtaaccatatagtactttaaatagaaaaaaattgtactaatagaagttagtagaaaaaatttagataataatagcttttattttattctttttgctgaaagactttgaaaccatggtgtaaaataaaaaatcattaaagctacctttttagatactttttgttaagtcagtttataaagtgaggatgtctatctggaatgtgtgacagatgtaacaagtgaaagttgcaatagtctccatgtaaaataaaatttggactgacagttttagatctttttcaagttttactctaatgctcattattttgtcttctcttcccttctccatctgcataattttaatctttcctttcatggttaagatttggcaacctcgtgtgccttgccaggatcattgttaaaaagctgtagtttttttttttctttctcccgtccaagctgtcccagagcctggtgagccacccttgcccttggtgtggtgtagctactgcgcctcatagcaaaaggccaggttttaaagcatagtgcttcacacgttatcaggaatttattttctgctcagctgcaggatctcttgtttgctttaaaactgtaaagtggagtgggggaaagctatcaacaatcttcaagtgcccaggtcttttagtttctgacagaaacaagagcatttctgcaaaggttggggagtgcgcgcgcgcgcgcgcgcgtgtgtgtgtgtgtgtgtgtgtgtgtgtgcgcgcgcgcgcgtgcatgtttgtagtatttagtaaacattccaaagatttcaaagtctccagggctccacaggatgtctttgttgacttcataactgtggttaggcaaaatgaaatgagagtccaggataggtcaagataaggtaattagcaaattccctaaatactcaactagagaatttcaatggccagtctttttacagatgattgttcttatttttcctcttttgttttcaattacaattcattaattgaaacgtagtaacgggcctgaagttgtgttctgtactcacctgtgttttgatctttatctgtctagtcctcatattactttctggcaagcttgtgattctggcatataacagttggggcagggtgggggctattgatttgatccctcatctgtgttcctacatttctgttatggttatttgttggccagtctcttcttgctagactgagtgcccttggattgggaagatcgcattgcccggcactaggtctgccccagaaggatgctcaatatcattgtacagaattaaactgaaagtttgtttcctttaaactccatgtcatccaaggtaaacacagtcacatgttgcctcttagggtgatcttgagtattttttctcatctccatcaccaccattatccaacctaaggcttgtaaaagatctttataccatttctttccagattcaagaggctctgctgaagttcttttaatcaatattcgatgacaaatttttatatcaggcaaaggttgttgtagagctctttaagattcaattatgtgaacattagttcttgagcttcatttgaaacaggtttattttgaggtgggatcgattcttgtcattttctatgaagtgatgaacgtcagagctggagctcttgtggcaggtccagcttggaggtgagcaggacacagggttcctaactgacccagatgatccaaggagaactgggagtctgagaacagaaataaagctggagcccagccaggagtggtacgcagggctgcgaatctgacagcaaggccgaaatccaggcccgcaagtggcagagcaatgacagttaattgcttctctgtactgattgcttgtttcttttgctattggatactaataggatgactccgaatatgacaatagagtataactattccgtgaacaacgtataatatggaaagtctgctttatgtgaaatgtttatctgcaaattattgagcaaagggttattatttgttactgcttaaatgattggttttaaactactaaatctggtaagttttttttctaaatagcatttgtgtaatattttggaaaaggcaaaatgatgtaaaaattctatgtgtattttacttagtaccacagaaatctcactggaattaatacctgtcatttggatggagaactcatatggtgaaaagagcctaggctcacagctcaccctcggctggccacattctagccgtgcaaccttaggcaaggtggaccagaaactcaggttctcctacttcatctgtggcatgagggtggcacctctgtgggagggcgctgtgtggcgtggggacactgggcatggggacactgcaccacaaagcttaggccctgacatacagcggctggtgaatcaagggtggctattattgttttggtgctatcattatcttaaataattaaagaaaataagaacatctcacgataaagggaacagattctaagttaaccttttaaaattactaggccactttaacctccgggaatagcactcagataacaatgtcttagtattactggaagatttacagagtcaagagcctgctcttatccctggatagtgagataatcacatgaatggagaaaaaagcatgcttctctcaccttttaatagagtgaaacacatcatgttaccggaaacccttttgttctgttttttacagtaagagaaaaagtaattaaacttcaaagtcagatctgtaaatagctacatgaggacctatggtaaaagcagagctacaaggtcttctttttgcttctgaaactgggggtgatgtaggggctgcccagacccatggcatcccttgaaactcagaaagaagccagtgcttggctgggttctcatgagagtcaagttggagctggaggctatgagaggtaacacttggcctgtccttttgccactggtcgtgtgctgccaagtgagagggctcgtgtggcatcaaaccatgccttatcttaaggctaacatcacatttcctcaacttggccagaggtgctgcagagagagacctgcacagtatttgcagaatttgttcaataattattgttaatcgttgatttcactgaagatcaatgtttgctttttgctcttataaacaaaacaggaatattcataacaatggattctagtaaggctcaagtaccatttgtgttgagtgtctgtatgccgtcatagtattagaagtttcatacacgctaacattcatcttcacaggaacgtcagaaggcaggtggtattaggtcacatagctaataggggacagattaggaattggctactgctcaatttgaatcccaaatcagtgctctctctcttgtgcctctaaagccccaggacccagacagggcagtataggtaacccttagcagactactctcaacagtgtttggcccttgacaaaatgccacaaagttggaacgtgtagccctgagaagggttgttggcagaggctgcagagtggctttcagagtggttggccagctaagacatctgcatcaatgcctcgcaccactgggtgttcagttttccctctgattaaatcttgtctaccctgtgcccatagagtcagcatgtgctgcgagatcacaacgtgggagatcgttccccaatactgagatagagacaccgccccatagacgcagttacacactgccatgtgtaaacagatcaggaaaggagcaggtgcccagcccaaccagagctccagttcacacaaaagttttagaaaacccaagaggtaaaagtttagagaatattgtcttcttcaaacctccctctaacactgtaaagtgataatagacaagaatgtaaaaaaacttgggggaaaaaaagctaaagctcaattattgacactgttttaatgacctccacagatagatttgagaggtataggagcaaaaatgactttaaaataaataagttgttaaagttttattggtgctgcattcccaacctgaggttttctttgatgaaattcagatgaagtttcacatcttgtgctgtggaatcctatgaaatgcttagagattcaaatggtttgtgttggttaaagcaagctttaggctttgttcttcattatgctaatcagtttttcccccagcttaattgaagtgtaaagtcatttgaacaacactggtcttttctgtacacaagaaggttaagaacctcagacagctcatgctgctgccaagaagtctcccagtcgtattcttcagattaattacctgcagaaacagaagtaagaaaatccacaggttaaagcaatgattttggcaggatctgaaaagcactaggattatgtcatggggaaaacttcagcaaatctcacaaatgggggctctcctaagcagatctgacatttcggtttttaaccatttgtatttgaaggcaaatattgaggtggtgggggtttttattaaaatattaaaatcaaactttttcctatataaattcagcaatataatttaaatattctgatttgtgcagttttattaaagccactgagaccacagtgatgctaaagtttttgaatgcagggagcaggccagtcttgccttactctgtatgttgttttataatattgatttgaaaatgcaaggttatactacagagaccaactttttcctcctcaatcctgtgctggcagccacaataaatgtgcttgagtcccagcagtgagcgtgtgtgccttctctagaagctgctgtctgcacgaacaacccaaaaatgtcatagaaatgcacagttctaggctgggtgtggtggctcatgcctgtgtaatcccagcactttgagacgctgaggcaggataatcgcttgaggctaggagttcaagaccagcctgtgcaacataatgagaccccatctctataaaaagtttaaaaattacctagatgtggtggtgtgcatctgtacttccaactactcgggaggctgagataggaggattgtttgagcccaggtcaaggctccagtgagctgtaatcgcaccactgcactccagcctgggcaacagagtgagacactattgctaaagaaaaaaaataaatgcatgagtctatgctacagattctttcatgatttaaaaagcaaatattattaattatgcactaatttctaattattcagtgctaatttgcataaccgttgagacagcacataggaattttgttaaacttggatttgttttggtaatttttattggaaacaacaatagtaacaataacttaattacagcttatatttatttatacatgcactatatgcaaaaagtattctaagtactctaaatgtgtcaactcatttaatattataacaaccctatgaaatactcttgttgcacctgttttatacatagaggcagatagagattaagtagtttgtcctaggtcatgtagctagtaagtggcagagctgggatttgaacccaggtagcttgactccatagtccgtgctcttaaagactgaagtctatgcctcttctgccagtgctgtcaacactgacttagctctagaatgtcttctcctaccttagtagaactctccctgccttccgcctgaggccagagaccttcccaggtaggtgtgtgttgacccagcgtcctacacaatggttgttacaccaacctgactctgccttcttttattcacacattagaagatttcactgaactgtttaattactcctcagagggaagacagatataaaataccttcttatcttccccacttctctctcccagtggcatgacattttgaagtgagattttctttccctcctatccaaagtcaaaggagaaatggagaaattccccagaactactgtccattcacaagaagttacatagcacttaaggacagtctctttcccttgagcaataagtacttagttttcattgaaatatttctctgctgagctctcatagtataatagcaaccaatcccaacaagcaaaaataacttgtaaatttgcaaaaccaggccaggcgcagtggctcacacctgtaatcccagcactttgggaggccgaggcgggcggatcacaaggtcaggggttcaagaccaacctggcccacatagcgaaaccccgtctctactgaaaatacaaaaattagccgagcatggtggtgtgtgcctgtagtcccagctactggggaggctgaggcaagagaatcacctgaatctgggaggtggaggttgcagtgagctgagatcataccaccgcactccagcttgggcaacagagtgagactttgtcaaaaaaaaaaaaaattggcaaaaccaatgagtggaccttatcttacttaaacgctcataaaattactttattttatatgttaacattcaataaaaactgtcatttttgagataattctatgtgttttaacaaagtatggtttaatgtaacaaccaccactaaggatatagaacattccaattaccttcaaaattcccttgtgcagtgtccccaacccagcatttggcaaccactgatccattctccttcattacagttttgtctttggagaatgtcatataaatggaatagtacaggatgtaaccttttgagatgggctttcttcattcagtataatgcctttgagacccatgcaagttgttttgtgtatcagtcattcatcccattttattactgagtatattccattgtatgagtgcaccacagtttatccattcaccagttgaagggcctttgagttgtttccagtttctatcaagtctgaacagagccaccagaaacattggcgtatcggtttttgtatgaatattgttcatttttctagagcaaatacttaagaattgctaggtcatattggaaatatgtgtttataagaaaatggtaaactgttttccagggtggtcgtgtcattttgtgtgcccaccagcagtgggggagagtgtgtttcatttgctccatattctcactgcacttgcttttgtcagcatttttacttttaaccatcctaatagatgtgtaataatatctcattgtagttttaatttgcatttccataatgactaatgatgttgaacatcttttcctgtgcctgcttgttacctgaataacctctttggtggtctatttaagtcttttgcccatttttccccttgcctatttttaaaattggattgttttctcactgttgagtttgtaaagttctttatatttctcattcaatagagagaaacagaaaaaagaggacgtgcacacatccccatcagtactcctaataaacagtatggattctacattgggagcataaagaatggtatatttagttctaggagaggaggagcatgagaaaaggatatttgcaagttgttcttgctttatagttttacttctttaaagagatatgcttaagacatagttttaaaaagacttacacaatattttttttgtaagagcttagcggctctcttggttaatagatatgttattctctctcagaagtgccatagacacacttgaaaattatttctatgtgtgaaacaattatctgttacttagaaaattgacagagcctggctgggcgctgaggctcacgcctgtaatcccagcactttgggaagccgaggtggttggatcacctgaggtcaggagttcaagaccagcctggccaatgtggtgaaaccccatcctactaaaaatacaaaaattagccggcgttggtggcgggtgcctgtaatcccagctactcaggaggctgaggcaggagaattgcttgaacccaggaggcggcggttgcagtgagctgagatcacgccactgcactccagcctgggcaatagagcaagactctgtctcaaaaaaaaaaaaaaaagaaaagaaaaagaaaaaagaaaattgacagagcctgaatttaagggcaagacagaattatttatccaggaagcagaagttacaaggtggcagatttcaatgtcagaggccacttattattatctaaatattccatatgttttcatgtttctgcgtttttgtttaaattgcttgtttcctttgcttggaatgccattcttatttttccagctggtgatttttttttttttttttttgagacagagtcttgctctgtcacccaggctggagtgcagtggcgcaatctcggcttactgcaaccttcacctcccaggttcaagcgattctcctgcctcagcctcccgagtagctgggactacaggtgtgtaccaccatgcccagctaatttttgtatttttagtagagatggggttttgccatgttggccagactggtctcaaactcctgacctcaggtgatccacccaccttggcatcccaaagtgctgagattacaggcatgagccaccacccccagccctggtgaatatttttattcttcaaggccaacccctgcttgatcccatttttccaaatacagctaatattttctttgttcacttatcactttatatgtttatataacttatcaaattattttagaaatttgtaggcaggtgtcttctccactaggcagagagcttcttaaggatagctgtgtgagtgaatcatcttttatccctaacaactaatttaatgcatgcttcaaaagagatactcatttacccatttattcattaatttaccaaatatttattgagttctcactgtatgttaggttgaggggcagagtagtgaaccaacagaaaagattcctgctttatggagcttacattttgttgaccttttcagataaccagattctccttttctaaaacagtggttttaaagctattagttttcctcaaagccctgctttagctgcatcccatgtattttgctatgttgtattttcattatcatttgattattctaatttctcctgatatcttctttgatccaatgattatttagaaatgtattgcttcatttccaaatatttgtagttgatttctaacaatatcattgtggtcagagaacatactcttcccatctttaaatttatttcaatctgtttaatgacccagaatatgatgtgtcctgaaaatgtaccgtatgcactgctattgttagctaccgttttctctacgtatcagttaagtcaacacggtttatagtgttgttcaaatattctatgtctgtactggttttttgtttgtttgttttaagatagaatttcattctgttttcgaggctggagtgcagtggcgtgatcatagttcactgtagacctgatctcctgggctccatgattctcccacctaagcctcccaagtagctaggactacaggcatatgccaccatgcctggctaatttttaaattttttatagagatgagatcttgctataccacccaagcttttatttatttttttattagttgttctatcagttgctgagagagggacattaaaatcttcaggaaaaattatagaattgtctgtttctaactttaattctgtcagttttgcttcatgtattttaaagctctattaggcacatatgattgcagtgtttttctgataattgacccttttttcattatgaaatggccctttttatttctggtaatacattttgacatctattttatctgatattaatattgccatccagcctttttatacttattatttccatggtatatattttttccattcatatactttcaatctatctgtgtctttgtatttaaagtgtatctcttgtagacagcatatagttgggttttgcttttttaaaaaaaaaattattctgccatcctctgccttttaattggtgtgtttaatgaaattattgctttaatgtaacatgtaatagaattattgctatattgggtttgagtttagcattttattttttgttttttacttgtcttttttgtacctctgttactcttttctttccttcttttgaattatttgaatatagaatttcattttaaattttctgttggctttttagctacactcctttgcattattctttagtcatttatgagggatcacaatatacatctgtgacttttccactacagttaatactaaccccttacagttaataataactgcttacatgagatctattgtacaacattgtgactaacatatgtataattaataacatgtatgtatccttgagaaccactaagagagtagattttaagtgttcttaccacaaaaataagtatgtgaggtaatgcatgtgtgtgttagctcaatttagccattccacaatgtatatatatatattttaaaacatgttgtatacaatatatacaatttttgccaattaaaataaatgaaagccacttataattaatgacatatacttcatataaaatactgaaatcttgcaacttgtagatccatatttaccccatcttttatgttatggtacttgtatttattacataaaaatacattataaatcctgtaagacaatattttaatttctgtctttaaaagtttgaaggttcaaggctgggcacagtggctaacacctgtaatcccagcactttgggagggtgaagcaggatcacttgaggccatggattcaagaccagcctgggcaacacagtgagaccctgcctctataaaaaatttaaaaattagccaagcgtggtggggtgcgcctgtagtcccagatcctcagaaggctgaggtgggaggatcacttgagcctagggagtgaaggctgcagtgagctgtgatcacacccactgtactgcagcctgggcaacagagtaagaccctgtcaaaaaaaaaaaaataataaaacttaaggtttcataataacataaaaggaaaaaggaaaaaaatgagtctttgaactgatgcaggtatttatcatttccagtgctcttcatttttttctgagggtctgagtttgatcttatataatttttctttagcctgaagaactttcattagcatttcttgcagtgcaggtcttttgatgattaattctttctggttttgttactctgaaaatgtctttattttgcttgctttcttggaagatattttgctggatgtaaaattctgaatttagttttttctcacgtggtactttaaagatgtagttccgctctcttctggtctccttagttcatgataagtcagctgttaatcagactgcaggtcttttgtatttaatatgtcatttttctcttgctgcttttggtatttgttctttatctttggttttcaacagtttgactataatgtaccttgaggtgggctgttttgcatttattttgcttagtctttgattagtatctcataattgtgtgtgtgtatttgtgtgtgtgtgtgtgtgtgtgtgtgtgtatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctattggccaggctggtctcgaacacctgaccttaggtgatccgtttgccttggcctcccaaagtgatgggattacagacatgagccacggcacctggcctgtaattgtgtatttgtgttcattaaatttgtgctatttcagccatttatttgtttgttttgtttttgcgccactgcgctccagcctgggcgaccctgtcacccggggtcttgctctgtcacccaggctggagtgcagtggtgcaatctcagctcactgcagccttgacctctcgggccccaagaaactgccccacctcagcctcctgagtagctggtactacaggcacataccaccacacctggctaatttttttttttttttggtattttgtagaggcagagttttgtcatgttgcctaggctgatatcaaactcctgcgctcaagcagtctgcctacctcagcctcccaaagtgttctctgtgttctctggttggagcacagtaagtgaagggaagaatgatgtacaatgagattggagaggcgaagaagatcacggagaggtttatagaccctgataaggagttggaaattatgattctgagtaagaaaatatgattaccataattgtaagggtagcttgccaaactcatattgctttatccttcagagtcttgaccgatggatagggtggccttgtgattgtatgacctacctgtcagttaacataattggaacagaagctagaagaccatgcagactgggtttctgcagtgtgtgggaagttgaagtggacgtattctaacatcccttccactgctaaggttctccggtatcgctgaaaacaagttggcctccatgtagaaaagtataatgtcaattaaaaccacagtttataatgaagagtgcaaatgtagagaatgaaaagaccattgtagaatgaagagttgtagttacacacagctaaagatttcatgtgatttctgcttaagagcagtatctgtagtccgtaagtgttactatgttaaaacaatgggcttaaaacagcatgctagatagagtatgtttatagatctgatttccggggaacacttaaagctcacttgatcctttctttggtttagatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaaggtgggcgtttgagtgacacaggaacttcagtagaattggtctcgtggcagaatcttgctctagcaaacacattgtgctctttaatattgacagagaatcgaaacttagaataacaataaaacagtcttagcactgtcaacataatcacacgacgtatgatagtattttggggcttgatgttggtgaattgtacagcccagtgatgtacatttgtaggtgatcattaaatgcttgttgagtcaaggaaggaacaatccaaatggaccactgagaacagttcttttttttttgagacagagtctcgctctgtcgcccaggctagagtgcagtggcgcgatctgggctcactgccagctctgcctcctgggttcacgccattctcctgcctcagccccacgagtagctgggactacaggcgcccgccaccacgcccggcttattttttgtatttttagtggagacagagtttcaccgtgttagccaggatggtctcgatctcctgacctcgtgatccgcccgcctcggcctcccaaagtgctgggattacaggcgtgagccactgcgcccggccgagaacagttctttatcaggattctctgggatggagagagcttgcagaaagaaccatgatcctttgggccacttttggaggttgttctacctagcttttttttgaaaactgttatctctttatatgcacttagcttatactgtcattcagttcagcatagcaacactcgatcatatgccacattcaaagctctgagccaagcactgggggtgcagaggtggcgggcctccctctgaggagctcagagtcctatgttatcattagctcttcccctcttctagctgcaaagcaagccactctcatgcaaagcccagtgttccttttgaatctcctctgctgtccacaaggacatcacctgctacagagctctgtccctggtagatttctagcaaatttaagtcatcatttcatgtccctgtggctcttgggaatgagatattaaaaagcaatatttgtattaaataatgttgtcattatcttcttagaagataatggaattagacaattagacaatgttggaaataaaacgcctcctaacaatttctgtccagctagctggcgccctcatgtctacatgaacttgcaaatggctcgtctttagccagaatcactcttcctcgtgactaactgtagaaaagagaattcgtcttggctgtaagatgcctttggctaaaacgttttttgagattacaacatttagatgttcctttaaaaatacctttcattggctgggcacagtggcacacgcctgtaatcccagcactttggaaggctgaggcggtcagatcacctgagcccaggagttcaagacccatctaggcaacatagtgagacctcatccctacaaaaaatttaaaaattagctggatgtggtagcaagtgcccgtggtcccagctactcaggaggctgaggtaggaggattgcttgagcctaggaggccaaggctgcagagagcaccactgcactccagccgggtgacagagcaagaccccatctcaaaacaaaaacaaacaaaaggaatacctttcattgttatttcaatttaacaaattatttcacagttaatgtgtattttccttagagttgggagggaggactgtctaaggttgcgtctttgagtttttttttctcaagtacttggctgcatttccacacatctgtgggaagaaatcaatttctttgtcatcccagatgttatcaccagcttcgtgtgagatggctggctacacctgttgggctgatgtctgcattttgaataatcattttaagtaatcttttttcctcctgagttacaaagtgattcaggtattttaaatagaaaccgcattattttaagtattcttgacctaccagctttccaaaaataaatctgatgactgctgtgtctgaaagggtacatttgaaggagctgttttatataaatcttcagacctctaaaacttccttatttttagaaaactacaggaagaaaataacagggtgtgcccaagagttttgttttcttgattaagaatgatttgaatttcataactgcacagaaaaataaatgttttcatagtcatctgatatttctttataaacattctttttctaactgtaagcaaatcaaagcttagttgccagaaggtcacaccaagaagtaaaaaaaagattcacaagaaagcaggtgaatgggctgcatcccctgagtggagggaccttgggctctctactttctgtgcagctaattagagcacagtggaaacaggggcaggaggggcgtgcccgtgggaggggcatgcccacgggaggggtgtgcccgtgggaggggtgtgcctgcagcagctgccctggctgtgctcatctttgaggcagctgccacgtgggcacttgggaactggtgcccacacctctgtctgtctttagagctggctctctgtggtcatggttggggtggggagtcttttaggcaagatggattttaggcaaatctcctttggttttaagtggccacacaattatcacttcataatattttggcctgccatgctcatatagacttgaagtagcctggacacatgacattcttatttttatttctgagacagattcttgctgtgtcacccaagctggagtgcagtggcgtgatcttggttctctgcaacctccgcctcccgggttcaagcgattctccagcctcagcttcccgagttgctgggactacaggcacacgccaccacacctgctaatttttttgtatttttagtagagacggggtttcaccatgttggccaggccggttttgaactcctgaccttaggtgatccgcctgcctcggcctcccaaagtgctgggattacaggcatgagccaccgcatctgacctgcattcttatttttaaatatcaaatgattttttcccccacagttagttttttaatgcttaggtctcactcagtatgttgaggtttgggtgtacagcttttgctgtctgcccaatgctgggcgtggctgtgccaccaagaagcaggcaggtactcactgggggtcctgctcaaagccagtgcgggaagagcgcgtgtctttctgctgccgtagccgctagctagtttttagactgcagtcaacactcactggcctcagcagtacctgtggagccatagataatcattctgattcctttccacaataatactccacttatttgaagaatgttatcatgacctctaagctttggctgactatcattcttcatatgccttgactagtataacgatgagaactgcaggttcatggaaataattcactgacagctaaggtcaaggcttcctgaaatgggatgagattgtggcccactgtaatgtgctgggcctgtggataggtattctgtagagagggagctgtcacttgttcccctgtccctgcggttggcctgcttgcaccagttacccaggtcttctttcccttgaggatactgctctgggtcttaggatttcctcagtctctgtgagctccccagactctgctttctccttttcctttgatattttttaaaataggaagaaccggctaccatatcacacaccttcactgtggtgaacctcagcccataaagctggcttggttcatgttggatttactcttggatagaatgacttggaatgtttccactttgctgagcttggattaccatgtagtggagaaaagagaatcaaatcgttcacgaagggctgtattaaaattcttgctaatacggaagtgtttcagagttgtggttggagtggggcaatactctggtagcagaatacagtgaacagaccccttagatattgctgttgtgaccgtaaatacagacaaatgatggatgagtaagggaattcattgcagcactgtgcgcaacggagaaaaactggataggaaacaataagggagcagcaagcagtaggggcatggccaggagatgatggtgcctccatatgattaaatgctgtgtggtctttaaaaatgtttgtgttactggtacaagagggaaaatgcttacgcattacattgagtcaaatgcaggctataaaactgtatatactgtatcatttcaactaaatagacaaaatttatgcaaagaagactggaatgaagtactgtatagcaaaagtaattcacgggttttttcctgagtaataggattatgaatttttaaatacttttagttagtttctaaatgttctgtggtgtgtatttcttaataagcagaagaaatttgtgttctaaaaaatcacttctttctttgcattgaatctgaggtcaacagcagggctcatggcaaatgtcaggaggccaggggtttactcacatgtgttttcaagaagacagggagtagtttggagttcagtcaatccattgtatacacacacagctgattttcattttagtgcagggatttttaaaatgtaaaatgtagatgaaaatatagtcattgtgccatgtatctgggattgtctattttgttatgcattaaccagtgagtagctcatatttcccatttgaaattttgcttgtttgttcagactagttaggcagcttcccttttaaagtactttaatatgaaatactttaatatgcctttgcaacttttacaatcagttataccaactagtggatctatgaattagaatatcaaagaattataataattattggcttcattaattaatggatcagagaattactaaatataaccagaaggcttctgttggggaggttaataagcaagtcagtcctgtcattccaagacatcaaaaccctctagcctcagtacatagcctctgcaaccactgtcaaaagccaactacagatttttagctgtgagaagcctgtgctacactggcacttaacactgatattcagaatactactcataggtaccatgtattgattgactaagggctggactttgcagcagacattttggatgtattcactcatttcacccctccacgtttctgtgaggcaactatcattgtgcccattttatagatgagaatgaaacctctgggaggtttagtgatttgcccaggctacacaagggctaaatctgggactggaccccagggcccggctggcatgttctttctgccatctgcattgcctcactgtgcatgcctctagcagtattccataagttagcattattcacattaaaccaaatatttaaaacatgaatataatttgaaaatcttttttcaaggtttaatttgatttgcaaagtgtgccaaatacactagatcatattcagcacatcattgtgtgaaatactatgttacggtctcttcacaagttttattaggtaggtgcaactgacaaattaaaatttttaagctcttggcagtcaatgacattaatgaataattaacttagttctttatcctggttaaccaaaattaaggagcaagtggcttttgctttttctcttgtctactgcaccttctccttacaaattggcaaattacagaaaaaaatcttttctcttttgctcttttagatagaacatactatagtttcttttgtttctctcattagctgccctctccagtttagatagatattctgtagtgatttatagaaaagggtttagtagatgtttgtagtttttcagagattaaaaaagacgtttcaaattttgtattatgaaaatgttctcaaatgtgtacaaaagtagaaagaagagtaccttttacctgccattctcatttatcaatatgtggtcagttttcattatgaccctctcccactacccctcaccccatattggattattttaaagcaaatctaagacgctatatcattttatctgtaaatatgtcagtatgtatttctaagatatagactcttttttaaagtccataatggctgggcatggtggctcatgcctgtaatcccagcactttgggaggctgaggcaggtggatcacttgagcccacgagttagagactggcctgggcaacatggtgaaaccccacctctacaaaaaataccgaaattagccttgtgtgatggcgtgaacctgtagccccagctatgctggtggccaaggcaggaggatcacttgagcccaggaggtcgaggctgcagtgagccgaggtcacacactgcacttcagcctgggcaacagggcaagactctgtctcaaaaaaaaaataaataaataaagcaaaaataaaaataaagtctataataccattattacacttaaaaattaataatttcttaatatcatttaatagcaagtcagcattcagatttccctaattgtccaatgaatgactttttaatagcagttttattgaaatataattcacataccataaaactgacccttttaaaatgtacgattcattgattattagtataagttgtaaaaccatcaccactatctaattttagaaaatttgtatcacccggaaagaaactcctcacccatgagcggtcatttccagttgctccctcctcccagtccctggcaactgctagtctacatcatgtctccatagatttgccaccttggatgttttctggaaatgaattcatacaatatgtggtcttttgccactgtcttctcccacttagcatacttgttttcagggttcacccatgttggatcacacatcattccttttcattgtcaagtaatattccactggatgcaacattttgtttatccatttatcaggcaatgggcatttcagttgttaataaattactttatgaaatcagttcattaatgtctttttccccatttatatttctattatattgaatttttaatgttacaggattcttgcactcctagacccatgcctaagaattcaaatgaaaacgcatggtacaatggacagccccatctacatgtaccttttgataatttcgaaacctttttaaagtgatgcagtaagagacagtgttttaactctgctgcagggtttcaggtttctggacagtagatacaaagtagcatgctctcttgttctgaaccttgctctttttacttagcagtgtggcctacaaggcattcctttgcagtgtctagagctcctcctcattccttttttttttttttttaggcagagtttttgctcttgttgcccaggctggagtacaatggtgcgatctcagctcaccacaacctctgcctcccagattcaagcgattctcctgcctcagcctcccgagtagctgggattacaggcatgcacctccacgcccagctaatttttgtatttttagtagagacgggttttctccatgttggtcaggctggtcgtgaactcccagcctcaggtgattcacccacctcggcctcccaaagtgctaggattacaggcgtgagccaccgcacccagcctcctcattccttttacagctgcacagtgctcccttgctaggagatgccacagtgtattcaaccagtccctgcaacaggctttggttttgcaaattgtgctgcagtgattggccgtatgcgtagggcattttgtatttttgccagtctctttaggacaggtgcctagaagtaggggtgctgggtcagaggatacgtgcacctgtgattttgctggatgttggtgatggtgatgataggaatctcctccagcactcagctaatcatctactttgtcttataacttagcaaaagcaggttgccttttccagttctaaatacagacatcttttaaattttgaaatggataattaggaattctagcttcatagtggttagatatgttaaaagtaaactttggatttcctcatataatcatatatgtaatcatgtttttaagcctaatgggagttttatatatcaaatagtgcacattgcattattgatgtgatgtaagttaaaagcatttcttgatcattagattataacttaatatcaaaaaaatgcattagtagatttggctagctttactagaacttctagatttattcatatcaactgtagttttgaaaatatattatcatggatagtgctttttgaagtctgggtattctaattcaaccatttagaatgatgaaaaaaatttatttcaggcttaattatgaatgtgtttggacctgagatttttaataccttagttagattttcagttaccaaactatggagtcatattgcagggaatctaactcaaggtggtttaaatagtatgaaatataacaggaaactgctgagcataaataccgcacctgttactggaaaccagtcttcagcttggttgcccttctcccttcacttccagcgggttggtagggtctgttctcagagaggccaactcattgggaaactcaaatgttgctttacagaacacgcttctcacatgaatgaaagacaacagatttcagagtgggaagataccttaaggaacatttttgagcaaaggctttcctttatgggtaaggaaaattggacccagaggaccttgcctgtggacacctggctaggtggggacacagcagggactggcgccccggcccctgaatcccaggcctgagttccttcccctcctctccactacctcccccactctgccttggtgtaagcacaggaagtaagtggctggttttgggggagaatgtgcctagggttctactccaaatctgtgtacaggatatgcagcccatgggttctcactggctctgattctgcctctggtaccacttgaccatagcattttattctcttcacattatattcacgatacaaaattgcacccattgtccacaacagagcattttattgtcgggatgtagccaggggataatggctaccacttctagggtgtctactatgtgccgggcactgtactagaaacttcgcattgctcattcctagtcctcacagcagccctgcaaggtgggtgggcactctgaccttattttagaaagaatccaaggcgtgtgctgtgtcttccagctcagctgaggatgagtccagtcctgtctgccttgaggacccttgccctccttcacctgggcacctcttacccccagagacaggattccagccatcctgcaatccttccaccggatgcgttccaaacacagcgtttctcaggctcctttcatctgagaaattctccttttggtgctgtgtttgttgtcgtgttttgcctctaggaaaaagttaattttttttttaaaacaaccctttcatgaaccaaaagaatctctcatatcttagtgtcatctggaagctagggatccatttaccttagcacatgacgagcagaaaattgtgtttgaaacttccctgctgctatgtcacttctgcatttttaaagagcacttatctgaaaatgattcattacagctgctcctctttcctgtcatcttcaagatccaggctggcacctgttcagactcaacactaggaggtatttttccttccaccaggttttcttaccgcagcgagctttcttccttgagtggctaataatttttatacatggtaatgtgaaagaaacctggcgtgatggcatgtgcaaaataggtacttagtaagcgtgctggtggtgggggttacgatgctatttaatcagtcagtggttacaaaaacccaaggatgttatcaagacagggatgagcagcaattggatcttgccgaagttgggatctatccaacttctcagtcattccaagagtagtcagtgtgtgtccccctcccccttcccatccctctcctcttcctcctcttcccaccctctatttttctttcatgatctctcatcacaactttaatattctacttgcttctgatgctactctatgatattttaagatataaaatatacactctgggaatgcctcctgcattgcatctgattttcttttcatgggcttttaaaatcctattttctatttcttcttttgagaaaaggacaacaatagattattatgagattgaattttgaaattatcactcaagaaagaatgaacaacttagtagtaactccaaaatggcaacataatgtctgctcttagaagcaaggctttcgttactgaaattaaaccaagttacatttccagtgtatgttcactcccttctgtgtgtaggcctgggagcaggtactagcttcaaggatcctgcagtcagtggagtagacagactattggatttagcgttccaagtgtgatgacggtggccagggcaaggcgctgtgggagcatggaggaggccccactttcttttacattaaagagagaaggaagattggccctcagctttagggactggaaagttccagcaagttaaaaatttggcataatacacagttttgttgttggtaatattttaagagcctaaatggaggcagatttaattctatgatgaacaaaatctgctagcttttttgtttgattggagatggagtatcactctgttgcccaggctggagtgcagtgacaggatctcagctcactgcaacctctgcctcccgggttcaagcaattctcctgcctcagcatccttagtagctgggatgacaggcgcatgtcaccacgcctggctaatttttctgtttttagtagagacgaggtttcaccatgttggccaggctggtctcaaactcctgtcctcaggttatccacctgcctcagcctcccaaagtgctgagattacaggagtgagccaccatgcctggcctctgctagcatttttaaatgaactttttattttaggatagttttagatttctagaaaagttgtaagcacagaaggttcccatagacccagtacccagtttcccctgttattaccgtcttacattagtatggtacatttgtcacaactaatggatcaatattaatacattattattaattaatgaccatgctctattgggatttccttagtttgtcccttaagcccttttggttccaggttcccatgcaggataacacattatctttagttaccctggctcctcagcctcctccaggctgacagtcttccttgtttttgatgatcttgacagttttgaggaatacctgttagagggttcattgactatccttcaccttggcttcgcctgatgtttttctcatggatagactcagcttatgggctttagggaggaaggcacagaggtaaagtgccattctcatcttatcagcacatcccgtccaagggtgcatgctatcaacatggctcatcactgtggttgttgaccttggccatctggctgagggggtgttggtcaggtctctccactggaaagtaacttctcccccaacttcgtcatgtggctgttagaaggaagtcagtatgtgccagctacatttaaggagtggcagattatattttaccttcttgagggtggggtagccacataaattattcagaatacagctgtatggggatttgtccgttctcttcatttatgtatttacccaatcatttatttatatatactgtagcataaacttacagatactcgttgtgtactttgggttataatcgaatactatgttatttgttttgtggctcaaattgttccagctttggcctttgggagctctttcagttaggttttgtgtccgtttgacttgcccccaccaaaatagtgtcttttggttttgttgttgttgtctgagcacttctttactttctggcaccacagaagactccagattcatgtgctccctgccccagccgtacgtgctgctgcttcccctgaaggcatgctttcttctgctgtagaatggccttggaaaccaaggtttgggcattaggtgtcattgctttaggccctgtcagcagacagagctcagaaacatgtgtttatactaacctgtgtgtgtgggtgtctatgtatgtatttatacttacatgtctgcatctgtgttaagggaaacctgagtccacactgatgtctctactctagtggcacatggttcattcccgccatctgcccttgcttatccatcacctccctctccaacagtgagagacctgccgctgccatcctccatccttttatgtaattgttccatcctgatgttcctgtgtagtggtttcagaattgttagcctccacctttgtgggaagcacccttactaactagaatacagtgctgatgcgcagttcctgttatctttagttttacagtctctactcatttccaaaatgacttaggtcagcatcttcctgccccccactaccttcagtgaggttgtcatatgtttgtcatacaatcttcattccatcatggggtttccctgtctcctagatggttttacttgcatacttcaaggttcactcttggtgctgtaagggtctctgggctttgacaaggcatcatgtcacatatgccccatgatggtatcttacagaatagttttatcaccctagaagacttcctgtatgtcacctattcagcccctgccctgcaacctctgacagccacaaatcgattttctgtctttagtttacctttactcaaatgtcatataaatgcaatcatacaacatggagcctctcagacttgctgctttcccttagcaatgtggatttcagatgtggtttgcttcattccttttatcaccaactcatattccattgtatggatgggtcagtttgtttatctgttcacctatcagaggacatcttggtcgcttcccgtttttgacgattgtaaataaagcagctctaaatatttacatgcgggtttgtgtagacataagttttcagatcaattgggtaaatacctagtgtcagtacaattactggatcatatggtgaaactatatttagctttataagaaactgccagactgtcttccacagtggctgtactatttttcattcccaccagcaaggaatgagagttcctgttgatcggcatcccggccatcaattggtattttgtctgtctttttggatttcagccattctaataggtgtatagaagtatcgcattattgttttaatttgcatttccctaatgacaaatgacgttgagcatcttttcatatgcttatttgccatctgtatatgtcttctttggtgaagtgtcttttcagatcttttgcccatttttttaattgggctgtttgttttcttaccattgaatttgaagagttccttttatgttccttatacaagtcttttatcagatacgtgatgtgcaaatattttctcccaatctatgccttgtattttaatcctcttaagttcttttgcaaatttttaaaaatgttaatgaagtccaaactatcaatttttttctttcatggattgtgcttttggtattatatctaaaaactcatcaccaaaccactttcttctagaagttttatagttttgcattttaaatttaggtttatgggctgttttaatttttgtgtagggtgtgaggttagtgtctaggttgcctttgttgaaaagatgatcttggctgggcatggtggctctcacctgtaatcccaacactgggaggccgaggcaggcggatcacctgaggtcaggagttcgagaccagcctggccaacatggcgaaaccccatctctactaaatatacaaaaattagctgggcatggtagccagcacctgtaatcccagctactcaggaggctgaggtaggagaatcgcttgaacccaggagaccgagttggctgagattgtgccactgcactccagcctgagcaacaagagtgaaactctgtctcaaaaaaaaaaaaaaaaaagaaaagatgatcctttctccaaggaattgccttcatacctttgtcagtgctgctggtgtttcaaaattcatgtccttttcctttctacttagcttatgttctgtaaaacagtggtctccagcctttttggcaccaaggaaattgtggaagatgatttttccacagaagtggggcgggtggtggggatggttttggggctattcaagcatggtacatttattgtgtaccttctttcttattatttattgtgtaccttctttcttactattacattttaatatataatgaaataattatacagctcaccataacgtagaatcagtggcagtcctgagcttgttttcctgcaaccagatagtcccatctagggttgatgggagacagcgacagatcatcaggcattagattctcataaggaatgctcaacctagatccctcgcatgcacagttcacaagagtttgcactcctatgagaatctaatctgatctgacaggaggcagagctcaggtggtaacatgagtgatgggtagcaaccgtaaatagagatgaagagttgctcactcgctcactgctcacctcctcctgctgtgtggcctcatcttcctaacaggcagttgaggacccctgctgtaaaatgttacctttgcaaaggggaactttctgatattattttctgcttgtcttacagcaagaccactgatgcagaccctgcctttaagaaccacggtcaacaatggcactgtgttaccaaagaaacctactggctctctaccatccccctccggggtcaggaaagaaactgctgtgccagcaaccaaaaggtgagccagaagcagggccttaaatgaactctcaaagcagttctctcttagattccaacatgagtattactttttaaaatgacattgtacaatttcttctgtgagttaaagcttataaaagtccaacattttatatggtgccataacaagaactagttaagtttattattattcttgttttagatttacttgtgttgcctttgaaacctcactggctaaaaccacagtgtggtgttttgtatttttacttaaagttctcttttgaaaaaacaaatgttagtataacctgggtaaaaataaatagctgttcccaagtccatactgggaacatggcaaaattcagattgccatagcaaccttagatttttctctatgcaatttggataagctcatactttcaaaatgtacccaacaatggagtctaaatattgatgttatctgtcacaaagagcacagtttgctcttaactttgctattattttgtaattatcatttaaagatttttatattttagggccaggtgcagtggcttacacctataatcccagcactttgggaggccaaggtgggcggatcacttgagctcaggagtgtgagaccagcccaccttaaccatttttaagtgtagagttcagtagtgctggccgggcttggtggctcatgcctgtaattccagcactttgggaggccaaggcgggcagatcatctgtggtcaggagttcgagaccagcctgaccaacaggcgaagccctatctctactaaaaatacaaaaattatctgagcgtggtggcacatgcctgtgatcccagctacttgggaggctgaggcaggagaatcgcttgaacctggaaggccaaggttgcagtgagtcaagattgcaccattgcaccccagcctgggtgacaagagcaaaactccatctcaaaaaaaaaaaaaaaaaaaaaaaaaagagttcagtagtgttaagtatattcacgcatctattgttgtgcaacagatctctagaactttttcatcaggcaaaatagaaactctagacccattaaatagtaactcccctctactctccccactgcccttggcaaccacctctctactttttgttgctatgattctgactacattaggtatttcctaggagtgggatcatctaagtagtgcttgtccttttgtgactggcttactttgtttagcatgatgtcctcgacatgcatccatattgtagcatgtgactgattttaaggctggataatattgcattgtgtgtatatatcatattttgctttttatcttaattttaggttcagggggtatgtgtgcaggtttgttacaagggtatatttgtgatactgaggtttgggcttctgttgatcctgttacccagatagtgaagatagtaccaaataggaagtttttcaacccttacccacctctctcccaccctccttttggagtccccagtgtctcttatccccatctttatcatattttgtctatacattcatccatcagtggctattctgtaccatttatctgcacatctgtccttatggccaataccctaccatcttgattactattgctttttagtatgttttaaaatcaggaaatgggaggcccccaactgtattcttctttttcatgattgttttggctatttagggtcccttgatattccatatgaattttaggatagtttttttctatttctgcaaaaaaatgcctttgggattttgatagagattgcattaaatctgcatatcactttgagtagcatggagattttagcaatattaagtcttccaatccataaacataggatgtctttctcttttttgtattttcttttagcaaagttttgtagttctcagtgtatgagtcttctaactccttggttaaagttattcctaagtattttatcctttttgatgcttcagtaaatagaattaatttcttaacttccttttcagcttggtcattgttattatatagaaatgcatctgatttttgtgtgttggttttgtacctgaaactttgttgaaattatgtattagtcctcacagttttcttctggaatctttagggttttctaaatataagattctgtcatctgtagaccgatagttttactttggatcctttcctatttggatgcctttcatttctttctcttgtctgattgctctgggtaggactttgagtactatgttgaataatagtggcaagagtgggtatcttgccttcttcctaattttagaggaaaagctttcagtcttttaccattgagtattatttgagctgtggccactcaaatatggcgtttattacattgaggtagtttccttctattcctagtttgttgtgtttttttatcatgaaaaggagttgaattttgtcaaatgctttttctgcatcagttgaaatgatcatgtggtttttgtcctttattctgtgaatattgtatcacattgattgatttttatgtgttgaatcattcttgcattccaaatataaatcctaatttgtcatggtatataatccatttaatgtgctgttgttttcagtttactagtattttgttgaggattttttcatcagcattcatcagggatattggtctatagttttcttttcttgtgtctttgtctggttttggtattagaataatgctggcctcatgcaatgatttggaagtgttccctcctcctcaattctttggaagagtttaaggagcattggaatttatccttttttaaatgtttgatagaattctccgctgcagccattgggtcctggacttttctttgttgggaggtttttgattactgcttcagtctccttactagttctaggtctgttcatattttttgcttctttatgattcagtcctggtgggctttgtgtttctaggacttatccatttgctctaggtcacccaatttgctggcatatgcttgttcacagtggtctcttatagtccttctcgtttttgttatatccgttgtaatgtcctttcatttctaattttagttatttaaattttctgtctttctttgttagtctagctaagggtttttcaattttgttgatcttttttaaaaaaaacaattcttggttttgttgatttttttcctattgtttttctattctccacttcatttatctctgctctaatctttattatttccttcgctctgccaacttttggttttatcttcttcttctagttccttgaagtataaagttaggaggctgatgtgagatctgtcttctttttatgaaaactttgatcactatagacttccctcttagtacccctttcactgcctcctgtaaagttttggtatgttgtgttttcatatgtctccggatatttttaaaatttctttgtgatttcttctttgaccattgattgtttaagagtgagttgtttaatttaaagattgactttttattgtagcaaatacatgcatgcctcattttattgtgtctggctttattgtgctttagagataccacattttttttacaaattggtggtggtggcaaccctgtgttgagtaaatctatcagcatcgtttttccaacatgtacccacttcatgtcacattttggtaattcttgcaacattacaacttttttgttatcattatgtctggtatggtgatcagtgatctttggtgttaatactgtaattgttttggggcaccaaaaacagcacccatagaaggtggcaaacttaatccataaatgtggtttgtgtcctgactcctctgcccattgtttccccatctctttccctctccattggcctcccttttccctgagacacaacaatattgaaataaggccatttagtaaccctataatggcctctaagtgttcaagtgaaggaagagtcatacatttttcactttaaatcaaaagctagacatgattcggcttaatgaggaagacatgtcaaaagccaggatagaccatcatgtggtttagatgtttgtctcctccaaatttcatgttgaagtgtgatccccactgttggagatgggcctgggaggaggtgtttggttcatcagggtagatccctcatgaacgtattggtgctgtcttcacaataagtgagttcttgctctgagttcactcaaggtctggttgtttaaaagagcgtggcacctcctccccacttgctccctctcttgccaaaggacgtgcctgctcctgtcttgtcttctgccatgattgaaaactccctgaggccgcaccagaagctgagcaaatgccggtgccatgcttcctggacagcctgcagaactgtgaggcaattaaacctcttttctttataaattacccagccttgggcattcctttatagctgcacaaaacggactcatgcaggcctgttgttccaaacagttagccaagttatagatgcaaagaaaaagttcttgaaggaaattcgaagtgctactccagtgaacacgtgaatgataaaagaaaaaaataaaaagcaacatccttattcctgatagggagaaagtttgagtggtcagaatcaaagatcatacgaggcacaacattcccttaagccaaagcctaatacagagcaaggccttaactctcttcaattttatgaaatctgagagaggtgaggaagctgtagaagaaaagattgaagccagcagaggttggctcatgaggtttaagggaagatgccctctccataacataaaagtgcaaggtaaagcagcaagtgctattgtagaagctgctacaggttatgcagaagacctagctagctaagataactggtgaaagcagctacactaaacaacacattttcaatgtagatgaaacagcgttacattggaggaaggtgccatctagggcttttatatgagaagtcaatacctgacttcaaagcttcaaaggacagactgactcttgttagggcctgatgtggctggtgactttaaattggagctagtgttcatttatcattccaaaaatcctagggcccttaagaatgatgctaaatctctgcctgtgctctataaatggaagaaaacctagatgacagcacatctgttgtagcaatatgatgtactgaatattcttagcccattgttgaggcctactgctcggaagaaaaagcttcctttccaaatattaccattcatttacagtgtacctagtcatccaggagctctgatggagcggaaattaatgtttttatgctggctcacacaacacgcattctgcagcccttggatcaaggagtaatttcaactgtcaagttttattatttaggaaataacattttttttttttgagacagtcttgctctgtcacccaggctggagtgcagtggcgcgattttggctcactgcaacctccgcctcccgggttcaagtgattctcctgcctcagcctcccaagtagctgggattacaggcgcacaccaccatatccagctaatttttttgtatttttagtagagacagggttttgccatgttggctaagatgatctcgatctcttgacctcatgatctgccctcctcggcctctcaaagtgctgggattacaggcgtgagccaccgcacctggcaaggcatttgctgccattgatagtgattcctctaatagatctgggcaatgtcaactgaaaaccttctagaaaggattcaacattttaaaagtctttaagaacatttgtggggccaagcacagtggctcacacctgtaatcccagcactttgggaagtcgaggcaggaggatcacttgaggccaggagtttgagactgcagtgagccatgattgtgctactgcactccagcctggtcaacagagcgagaccctgtctcaaaggaaaaaaaaaaaaaagaacatttatgattcatgggaggaggccaaaatctcaacatgaacagggaagtttggaagaagatgatttcagccctcatggatgactctgaggcaattcaagacttcactggagaaagtcactgcaaatgtggtagaaatagcaagagaactagaattcgaaatgcagcctgaggataggactgagttgctacgatctcctgataaaactttaatgggcgaggaattactgccaaaatagtagtttcttgcgataggatctactccgagagaagatgctgtgaacactgttcacatttcatgacaataaagggtttagagtagcacacaaaccctgatgaagcagtggcagggtcgtgtggctggagcgtggggaacgtggcccgggctgtctggctccaaagcctgtgcgccttccattgtgctcggctgcttcccgcacagatttccaggtcagccctgacatctgctcaggaaaaacgcttgatataatgactgcttgcaaatcatccttcttttatgccccatcctgtctgtgtactatttgtgggagcaggagcagcagtcaggagtgagggtgactctcagcaaagatttctcagattgcaggtctgatgttgttaaggggatgtcggggccaaacaccaagtaaggaaacaagtcctggctatgaacagaggcctgggtcttacacccccacatttcagccacatatgaaagggctcctaggtggcaattactctcagcaattttatcttagggaagaagggagggaggaagggagcaagacaggaaggagtgaacgaacacgtgaaaaattatgctttgtagccatcgtgttatatctaagtgtgtacgtgtgtgtgctagcacttaaatggtaaccctcctcccagaaacattctaaggcctctgtagacttttccttataatttacagaatatccgtttgattactctaataagctattgtcagcatatagctgccaactagaaatacatatttttctagactgagtgtccaagactctgggttttgagtgaaagtgtagtgattcatgtattttggttcgtttctggcatttatgggcttcggtggatgggacttcccttccatttggaagctagaaataagaacagtagcatctaattgctactctgtggtaaagttcctatagatctctcattaggagagaattttgaaaacagaaagaagcaggctgggcattctgaatattaggattaaaataacttccaagtcatttcaaatatgtttacaatcaggtaggaatttttctgtaatcagagttccaaattaaatgagttggggcatctgtggtgtgtggatgggtatatgtttgttttcttttctccgggggtttttcagcctggtgcttaagaacaaaatcccctttggaaatagtccagttcccagcggttgtgctttgtgttgccaattaagacttcgattgagggcttgatttggaatccttgggaaaagctttgtttccattaggcaaaggaaaaaaggcagaaaatccagggaagacattgtaggtcataccttgctcagtggggatgcggaggctgacaatggagtaacatttctactggttcaagaaagagacaatcactgttctctgggctcataagtagagcatgacaataggccaagctatgtgaacagagatcaaaagaacaaaactggtacaaaaagcgttatttaaaaaatgctctgtgacaaatgtgagatagactggtaaatatctcttgcttccaaacaaacagccaatagtcctttggaaaaatagttccacttgttagaagtacagcatttgtaattgcactgaagccagtgctgggtacatagcgtgatttgaagaatagaaagccaaaatctggcttcagttgatttttaagaattatttctaatatatttctctattattccgatccattgaaacgtaggtgataaatccatgtttgagtctgttctcagtagcaaaatagaggtggaagtattgtcctgttgaacaaaggaagacctgcgggacctgtccccttatcagaagtgatatggttctccccactagctcgagtagttgactttgtattgtagaaagaaagacttatgtatatagaattctctaagattctcccagaccactagccttcctgaaaaatgacttggattttgccgaagatcagtttttagacagtgaaagatatgagcatttgttaatttaattactgaagtgcgttatctcagtctgtcagaattatctcctaatttgagggacaaaagccaggtgggtcctggtcccttgtggaccctccagcactcagcatagcgcacagtggatggttgatgcctagtaagtgtctgttgagcagatcactgcttttatccagtgttagtcgccccagctgtcaggacaaatgaaatcatcagaaaatctctggtcacacataagagctgtctgtcagatttctgttttggttgtaaaagtttgggatacttttgcaaaattttggaaaatcaatttttgattcccaatcacatgatgaaagaaaacctaattgtagcttcttatgcttagaattcttattaaccataagaagaaagacatctgtttttcttatggtcaccagtctccctgcagaaattttattatgtctaaagtgttaagtggcacaaattgttgaatgcatatgcaatgtaatataaagaaccatttattttcataacttacaaggttgcaggtttgggtgtgcggacagagagcagaagggaaaacaaaataagtggtgatgtctatgcatttctatacaaaaaatacttgccttaagcactaaaaaatatactgcattattgcacagtctctcacaagccagtacttctaccactttcaaaataaagagcattatttttcactcgccgtccagagagaacatagcttctttgatattccctgctggttatttgaggaggcttcctgcagtgagtgtacggtattgctctctctggctgcccttgttactgcaaatgtcttgtctttaagctttattttctgtccttcactttgagtcctagtaaatcctctttaattcataagagcccttggttctcaaaaggaaatgtcttgttttttattctacgtctgggacaacagtaagatttttttaaaaagtttaacattttaatgcaaatatgggaatgacaaatatcttggaagagttgtgaaggattatatccacgtctatatttgcgaaccaaaatgtctttcgattttgatgtgtgcgtcctgcaatttactgaagcttatcaaaatacttttccacgcttttattaattgcactcacatttattctgctttatttctgtgcctcttatatgtagattaaacagatctgtgagtcttctcaatgcttgcaaactgaatagatcgacaccaaggtgaggggaacttagatttactttgtcaccatagctgttccttccattgtttccatctctgttttaacgtagtagcttcaaggtcttgtccagtgcctaccattcgtcaagtcatcaatcatgtaactatattaatcattgacatttattgtttttttagatgctcaactggtcctccaaaacagtatactttggcggttcataaattgcagatggtgttaattaggggcctaatagagagaacacagggttgaagtcaccagccccaccacttgctgtaaccccaaacaagttgcttcacactcctgaattcggttcttcatctgtaaaatgaggataatgatattgctgcaggggatttgtgaggtttgaattaagtaatacagtatatgtaaaagtccagagtatgccttaaacgttaactgtggctgctgctgctgcagttttcatcactggcacccccgtgaactcttccagccaccaggttgagtgttaattattagaaaatcagttagtgtttgctgtaattgatgaacagttgtggtttttcagctctttaagggtgttttatacagttctttaagttgctatgaacttgccatgaactcccacaaggacgccccagaagctgtgctctgggctcttcttgcggctgcagaatctcccagggccccggcagctggttgggcaaagtgtgcatcagagccttgtactaaagactgggcggagaataatcctgctaagtcaaattagcttggtgtttgtcgtcatgggaacatcttgaacttgaagcacaaaggctcctataatttttagactttaatcccaaatttcagaaatgtaatgctctcttaaaatctgtaatttccttgtccccaaattgagcattctaaaaacacacattttgaccttaaggcacaccctgcagattgcagttgtaagattctggcactgtccactcaagggttccccagttaacaaaaagactatgtggaaagtgtattcagataatcaccctgagagtgatttcaaagccagcataccatgagggtttttaaaaacctgcttggagattactaactgagccactggaagttgcaaaggaaggaagagtgaaagttgagctaaggagggtgtatagacagaggagacagagaggggaaggaaggaagagaggagagagtcactggctaccaaggagagtggccagccccaggcaggagctgcctggatgggaggcttgtcatttacttatgaggagggaggacgttgagcttcagtgcaggcgcaggggtcttgctgtgttaagttcctcagctcctgcgtgctccttgttgagatctggtccccgtgcacccttcactgaagctgtgcccactggcgccgcctgagactccccacttcccagggctcaccccctcctctgtgcagcaccagcacatttacctaatcctgcgctagcctttgcgcaccactccttctctcctggtgtcgctgctacctctgactcctgtggtagcttctcagcccacgtctttaaacattagtttccccagggctcttctgtccttggtcacctcctccctcggtgatttcctctgcatccgtggctcagcacccgccagatggatagagtctgtcctgagctgtctcgcgtgttgcaggcttgtattctcacccacccacacctccagctccaagtgtcaagactagagccacccaagtctgtgtgtgttcccagagccctggccctagaacagccccctgcctgcccctcccctcctccttttttgcttacagagcaggtgctgcattaaagcagtttgtgtctcttctggtgacagggtcagtgtgtgatacttccatttatttcatcctttcatttaataaatgtgtaccaaacttttgtataaggctctgcaaagctacgaaaatgataaatgagataagatctcaagaaatgcgtggactaatgatgtagatttttaagtatgtacagagatacctatactagagttatgtgctctgtcttagtgagtttgggttgctgtaacaaagtccatagactgggaagcttataaacagcagaaatatatgtctcaccatcctggaggctgggagtccgagaccaggggggccagcatggtcaggttctgatgagggctgtcttccaggttgcaggcggccatcttctcacatggtggaaaagggtaagagagctctctgggcctcttccataagggcactaattccactcatgagggcttcaccctgctgacctcatcacctcccaaaggccccaccccctaacaccatcacattgagggttagggtttccacacatgaatttggggaatacaaacagtccatagtgtgctctaagaggggaacaatcagcctccactccatacctgggctctggtttacccctcatgcctacgaatcccctgtgtataggggatcccttctcctagagcaggctctttccatctgtgtcataacaacacattcaagccattcatttgatctttcccggaatttcgcagtctttgggaagacttccccaggctgccttcccaggcctctgagcactctagtccctcttgtcctatgaatgaagttggccgcttaacatggacaccacctccaaacaaaggcattgtacacagggtggaacgtttctgtcgttactcgtgacgtcctgttagcatttgtcccacgcctgcctttaggccagatttcttcaacctcagcactatcgacgtctggggccaggtgctactttgtggagtgagccatcccgggccatgcaggatttctagccgcaccccgggcctccacccactacatggcagtagcagtccctccccagctgtggcaacagaaggatgtcgccagacattgccagatgtcttgggggcaccatccccccgggttgcacaccaccatctggaccaaggttgtccaacccatgggcccatgggccttgtgtggctcaggacagctttgaatgtggcccaacacagatttgtcaactttcttaatactctattttctttgcaattttttttttgtttaattcgtcggctatcgttagcattagtatattttatatgtggcccaagacaattcttcttccaatgtggcccagggaaaccaaaagattggacatccctggaaagtgaagcctactcaagggcaggattgcttccctggaagcccctggagtgctctcacacggtactgttgaagtcttaatgcctcagtttctccatgactgtgaactgtgctagtggcctcagttaaaaaggcagagagagagcagagatgttattctatgtgacactctgaaaagctttttgatctccgtcgctaggcctgtcttttgaatatccatgtggaagtatgacgttctatgtatatatttgtatgcttagcaataaaataaagtcacgatattaaggagttcactgtcacttccattccacccttagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaaggtaaggacgtcttatctctcagttcctgctgttcagatatgttagtacggcttgtccccagagaggagtcagaagatcccctcatattccaacaagctgggagtactcttggagaagaagaccttctcctcaggtatttataggactaatcaaacagccatttgagggcagctgccaggcacagttcacacaaactaccgtccaggtggaaaaactgtcactcagattcccagcactctcatgtagacataagtagttcctgagaatttcttagtaccaagtacctagaactggggaagccattctgaatttctacctgagcgccttcgatttctagtacactctcctgacctttttaagttcattttaatggactgctttaagtttgtcagcagtattttctgagacacagtggctgaaaagttgtaattttatgatttatcagaggctatgtttaatattgatgctaacaccagaaatgtgaaccatttttctttatggtttcatgaaatacgtggactccaaatttttgagtttttctatgaggttagtttgtaatggattatgataagtatcggtgaaactaatagtaacattttgttcctgaatgctgctttttggcattttagcagcttgttttgtgtctatataatatatttatatctatataatgtactttgtaaagaaaatccagtttctctgtgtatttttacctaacattgtactttgttctcactttttaaacattgtactttaattttattctctctgtttagtaaagctgaggaaggaatttcagcttcagaggctaagcatgtgttttttttcccaaatgttcatgtaaggagaaggcttagtcataaagcaatcgactccaacccacaggctataaaacttccaagtttgtaaatccatggtgattcagtcctataaaggaagcttaaactctttttcagttttattcctaaaagatgtctgttgtagaaaacatagagacacttctcacatctataacaggtcaggtccacggtctattaacaatttaaaaaaccattaacatgggttctgtcttcttctcatttagactattagtacttcttatcagaagattatgctaatggggtgataataccttggaaatgaggccaagtggttacagtggcaacagagtgtgaattagtgggaggtgcaacgtagcccaaagcttctttgaattcagggtaagcttggaagttgacctgaaatgtctagatcttggcagttcttagagacttggctcctcctctgcacatctgatttttattaagaatttccaaaaagaatctgcattgtgtaaactccagatccattttatctttaaaatcctatggctttggtaaatgtgctgggtaaatatttccatagaagatatttacaaagagatttttgagaaatgccacagtaggaaattttgatttggaaatgagggactgggaaaatttactaatcatgttcccaaactaattcaggcaactaaacatgtccatttaaaaataaattctttgtcttgttagaacccaggcgtggttgaggcgagcatagcacagagctggctgagtttcatgcatcatgcactgaaggggtttcagagacagttactgtctcctcttaggcaattgctggtcttgacagggacccataggagtaagagctgcagtaactcaaaagaagcagctaagactcggtagaagtgaaggttaagctggtaattcagtggctgcctgaccccttcccgcctttcttcctctgtattcccacgtgcgcagccccatgctcaggctgccttgaccccagcaccaaagcagatctggagtcttgctgagaaatgccaccctcgaggatgggacacagggaaggaaaggagtagggaggtggcccccatgtaatttctgtttttaaacattactgcgttcagtggactcaagatggcatgcctcgtccccatcgctcactcgacatgtccattgttcctacaggctgtcctgtgatttaaaaaattgcccttgttgggttcctgtaggcagcaagacatggtggaaagggcagaggctctgcagtaaaagaaagatctgggtgtgtatccagttctgccttaatgtctccaagcctcagttttttcctctacaaattagagattttatacctaatgcccttgaatcttataaatgagctaacttgtaggaaattatccagcgtagggcttggcactcagtaaatgatcgtcatccctgtgatagttcttataaagacaggcttgtgtggagcagaggaaagtaatcagtgagattttctacaattcctcactttttattttcctcatttgtaagatgaaagtgttagattttgtcacaatccgcgttgcacttgtgtctaacgtagttgggggaaataaagtattataaatccttgtgaagctcacagttcttaaataaggcatcgggcgggagctggtctgtgggctgcttgcgatcccagcctgcccgctgttccagagccccattctcttccactcaggaaggctagttagggtgcatgtgagtgagagtgctgacgtcatagggatggcttccaccctgtgctgctttgtagaagaagcaaatcattcacacaggcagtgctttaacttgcagccacaacagattattagccataaagctcacagcttctcacacgccatgtgcaaagctgtcgttagcacatatggcacttaggcgcaaattagaaaaaggctccctttacttcagaaaaacagttccatctcagcactatttctcaataataatacttacagcagatagaaaaccattctgtataaattatacaaatcttactattgaacacaaaataatagtgtttgtggagtcctaaatattaaccttttctgagatactttattttaaagtaattacctgttttgctttcataaaactatattctttttctttttcctttttttttttttgagatggagtctcgctctgtcaccaggctggagtgcagtggcacaatctcgggtcactgcagcctctgcctcttgggttcaagagattctcctgcctcagcctcccgagaagctgggactacaggtgcgtgccaccatgcccagctaagttttatatttttagtagagacggggtttcaccacattggccaggatggtctcgatctcttgaccttgtgatccgcccacctcggcctcccaaagtgctgggattacaggcgtgagccaccgcacctggccaaaactgtattctttatgatagtttcagtcttcttgctcccatgtctcattttctttacaaatggtcactggattcgagtctttcttgtgatatggaagacctttatcttagaatgtttaattttttcaaatactttgtaacaagccacaaaattttaacagcatttaatctttgcaccaacaaaacctctattaaaaacaaaagcaatatatggtagtattttactttatgtattattgatgataaatgaacgttaataattacatagtgattcatgtcatcatgaaatactacatttaaatagagaattggcaataacatcgtgatggaaggcttgtaaaatgtagccagtgaactaatctgatggagatatttttcaattaaaaaagtattttatacctgatagaaaattggctgcttatttagaagcacagttcatgttagatgttgctagattgataaagcatttcaattatcaaactggttccccttttgtaagtcttaagggaatgagctatgtcagctctataagcaagacactgtttcagctttactgaaagttgttgaaatgagttgattttgttagaataaggatgtttcagtcatgtgctagaaactttgttgtcacatatgtataaatcaggggtgtccctggacttcggcctccctggacttttggcttccccagattaaaagaattgtcttgggccacacacaaaatacacgaacaataatgatagctgatgagctaaaaaaaaaaaaaaaaagaaaaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtcaacaaacatgaaaaaaaaaaaacccacctcaaaatagtgaagacgttggcatgttaggtgtggtgcccttttgtgttgtgccccctcaaccccgggatcagacagccccgtagtacagctgtcaggtcgagaaccactgggctggacaccttgagcgcctgtcctttctaaagctctagcatttggtgactatttcatctcagggctcttcagggcgcaaagttgtttttcctttacgatagcatcactgctgccgtcggctcaacagtactccttggctggggctccgggcccttcatccaccagctcctcattcccttttgtgccctgacacgcatgcctctccaacacattgcgcacttttccccagcacaacttttttccttttttgaggccatttatttattatacaagtaacttgttttagaaaatctaggccgggcgtggtggcccactcctgtaatcctagcacttcagcaggccgaagcgggtggatcacttgagcccaggaattcaagaccagcctggacaacatggcaagaccccatctctacaaaaaatacaaaaattagctgagcgtgttggcacatacctgtagtcccacctacttgagaggctgatgtgggaggattgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataattttgacataaatgccattcttgtgcatattttgtgatcccttcttcatttgctaaatgagcatgtctttgtgtgaataaatgcactcttgcaatgttattttagatgtggttcatcatgtttccagcccgaagtacttcagttggacgtttaagtaccaaacaagtttcactaatccactcagaccaggccaccatctagaacaatgcccagcacacagtaggtgctcaacaagcattagtcgaatgaatctttttgccctgatcactataacaaaagaaggttaaaatgatgggcctttattgccacagccaagtgttaatcccagctctgctgctttgctttgtcattgtgaacaagtgacttaatctctttggggttttcctcagtagcagtaaaagtggtacctgcctcacagggtgcctaagatcccatgcataggagcctcagtgcagagctggtctgcggtcggctcgccacagtggcagctgtgagtgtcatgtctgcatcccagactgttggagttgaggcctgcacacttgtgtccctcccactcccctgcttgcagggctttttttcttggggatgtcttggaattccccagcgcctgtttctgcctttatcccagcctgaaaagcgaggaatcagaaattctgaaaattgttctcaccttgctctttcagtttcactgctgtgctggacttatggagcacctgctgtgtacagaacgtagtccaaggcatggcagggagtgggaaggagcagcacagaaagactcattctcctaacaaatgtcagtggcacaatgcctgcagggctgctttgcttaattcccaaaggactcacaaatgggagaacaagataatccacggaatagaaaaatggtaaagggtctgcacaggcgctcactgagaaggaaataccagtggcccttaactcatgaataggcaatcaagcccagacctaattaaagacatgccgatctaagtaagaagataacatatttagaaaattctttttactttactataaaataaagcacagatgcagaaaaccacacaagcaaattcgtagcttaatgaattgttctaaggcaaacaccttctagcacctaggaggaggaggggttttcccctctcccaagtgacaggtggatgtatctggaactgggggtgggggcagggaaggtgactgtttttgatgaactccagctcatccttcgagacccaactcaggatcccctttttctgggagcctcccctggctctctagtctgagagcagtgcttttcagatggtgtcgtaactgcctgttaactttatctgtgactctgtagctctcctcccttcaccatgctgcacacaccgcttgccctcccttaggctctggaggcccaggccgtgccattcttattctttgtatctctagtactttacacagcacttggtgaacatgagtgctcaataactatttgttgaatggatggaaggatattgtatacgatcaggcatcacttaatgacaggcacattctgagaaatgcattgttaggtgttttctcattgtgtgaacatcatggagtgtgtgtttacagaaaccttcatggtccagcctgatggtctagcctgctgctcctgggctacagacctgtacagcacatgactatagggaatactgcaggcagtggtaacacagtgttaaatattggtgtatctaaacatagaaaagataccataaaaatacagtattataattttgtgggaccacagacatctatgtggtccatcattgacagaaacacccgtgtctggcccatgactgcatttcatttgaaagccacagccattcaagaactatgtaaacagcaccacctatgggtagacaattttaacaccacattttacactggaagatgagacttaagcattttttactgaaaaaaatgtttcactcttcaagccatggggtcatttatgttttaataaatttcaaaatgataagtgctaatattcttcatattgttttagttttgagactgttagctgaggagtctggaaatacaaaggtttttgcagtgaaaggaggaggaagagggaagccatattaattaataacatgttggacgcattgtaacatatcttatttaatcgtgccaataacctgttcctcacagtggttgtattcccatttttagattaaggaggttaagctggtggaggtgaagcccctcacccaagccctagaacacggatccagctggcctcaaaatctgtgctccttccaccatgttaagctgggaagtattggttggaaatgtctatgaagcagtcgcttttgtcccaaataaagtctccagcaacttctaaacattttgaatagatggttcttaaatgaccctatttctaataaaaagctgcttaaggacaatttttgtagagtcattatttccatggtggagtattctgacttccagcaggaactttatttcatcacgtgaagtcatttttaaaagcagtcatgtggctgagcccagtggctcacacctggaatcccagcactttgggaggccaagacaggcagatcatttgaggccaggagtttgacaccagcctggacaacatggcggaaccctgtctctacaaaaaatctaaacattagccgagtttggtggcatatgcctgtagtcccagatacttgggaggctgaggtgagaggatggcttgagccaggaggtggaggttgccgtgagccgagatcacaccactgcacttcagcctgcgcgacagagccagaccctgtctcaaacaaaaagaagtcatgttattccaagagccaaagttgttctggattaataaattgtagggaaatcacatgtttaactttggaatggactcctcctctatcaagccttattaatcactttcaaaagcaagtatctctgctcaaacagcacgtggctcctattagttccactctgatcctagttgcccaggacttcttacacatgtcaccacgtgtcgaagacctgcaagatctggccccagagccccctttcaggaacatggggttaggttagttaatgtagatgaaagagataagagcagatccccgctctgaggtacagtgaatatctgttgagttgcagcctggacacgtcgtccactggactctcctccttataaatgccagtctatggtgcagcaaataggagctttatcagatgagtaaaaaccaaccactcttagaccatccctgtgcccaaagtccacagtgaacacattcagggatttggacttagacatacgtgttcacagctgcctctgcggtgttgaccgcactggtgtctgttggtgtgagcctcccagctcagactgcactgctgtctgttggttgactgcactgctgtctgttggtgtgagtttttccttggggcagatgtctagtgttctcctgccatctccccatacagctgctggtctggtgaagattcaaatgtacctcatcctccgttgagtctccacgactgcttatatcttatatcagctctcgaaccattcagctcaagggagcatacagccgagctctttcagcaaatctccttcttataagcaataagaactgcgctggagttcgtcttggagatattggccacaacttaacaccagaatagccaagcgctgagagtttgttcaccgggggggcaaatcctttctctcctccaggcttagttctgtcatgggcttcaggggcaggtgcaggacatcttgattgactccacactgggcaagggatgaatggagcctcattctgcagctggtgctccttcacccttcctaggacaggactgggcattctcccccgcaccccgccaccgccatggagccacaccccagctgctgaggggatgttaagtcacccacttaattttttccaccgagctcacatcaagaaatggggaatcagagatgaattacgtaacaccttgagaagcgatcatctcccactccaagtgaattcaccgcccaagcatgtttcaaaatagtgctgggtctgaaggacccactctcaatttgagtggctgtgcgttctggagagatgcactttctgcattcagctcccgtcaacagactttgttgagaggccacggtggcttcaatgttctcttctggttatcactgcacatctgtgtgtttgcctttctgtcagttgttcagaagatttgtcatcattttgtgggcttatatgccaagatttgcatgcaagagtgaaattacctcctcccaggcttgccttttagaaaaggtggtggtgcattggcaggagtaatgggttctaaacaaataagctgggtttttttcaataaaaactcaactttctaaaataataaaatgtagcagtagtatattttctaaatacagcataccacaaagtgatacattgtttagagcatgatttaaagaaatgtaagcattttagtaccacctgatacctcctctctcaatgaccttagttgttaacattcctgctacctaatctgttaatagaaatctttcattcttcctcttacagttcttcagtgtcgaaggtccacgagcttccctgtatgaagcgttcagattcccttgcggattttctctttgcaggaagaacatagttcataattgcttttttctgtctctagggcaagttctgaatttctcatttctgtgttcatagcttttgcatcattctacttttgtgatcaaagtcatgataaaaaaatagttttcttatcttttgattccatacctggcttccctttgattatgtttctgtaattagatttgcctcgtagtcttttgtcagctttccttctgtcctcacctccttctgcctgtaaatttaatcatatatgtgaaatttggagttaagatttcttctgcttctgcttagcacacagaaaatgacaagaatgtcacttccaccctaaaaatgagaacaattcaggtatctacagtatcatagctattttaaggccaccatggagctgaggacagaaagtagtataatgaactgaagtgttactgaaaagtggcaagcccatctgaggagggacaggccccacggctgcttttgtctctggcagagtggcggggagaaaaggggagccctcttagatgggagtaggaaatcacctggagctgtagaattgggaaaggctgagtgtggactggcaggagagttcagagtcctcaggggctctgggcacacgagaaccctccccccgctcagacgcactccgcttttccccagacttccgtgagtgtgcatggtggattgggagccggacaggcggctgagagagacccacggaggcagaggcatgccaggaggaaagccgagagacgttctccacgctcagggcctggaactaagtgccaggcagcagctggccacccccgaaggaaggatgaggaaagctgagagagagccctttgaggggtgggtgtgtagtgaggtctggggacctggaggatggagagaaactccatctgcacaccaagccccacaccaggttcttggcagcagctgtgtgtgccccggggagaggcaggattgctgagagccgaccccaccaccacccaccaggcacagatccttggggcctgctgaaggctgaagacggagaaccaagaggaattccacaggagctccaggcctcacaccagggcagccgctgtctattgtccaaggccctgggaatatagccatgaacagaaagatccctgcccctgtggaattgcctcctggtgggagaaacaaaatgaaggcagggggcaaataagtgctatagagaaaaataaagcaggaggggcgggggctgtggcgagcagggcgtgaggagggtttcagtatggagcagcgaacatgaatccgtacgcacggctacagcagtggcctgagagtggctgacttcggggaggatggtccaggagggcccatgagccaacgcctgacacggagcctgctgggccaggttcccagaacagcagggaatatagtgaagggagatgagctctgaagaatacaggggtcaggtgcagattggatagggccttgtaggccaatgtaagacccaggctttcaggttcaaaggctgtgccatggctttttagtagtattttcaatgaccatagtttagagtttaggaaactaagcctatagcttacaaaactacttaaaacacatttgaacagagtaaaacacttttaaagcatcaggaaagtagtaggctctaccaccccaccccatgtgctgcaggaaattatctggaaatcaagaatattaatatagaatattacttactacatcttgggattaaggatagtttttattcctggtgtttttcattgtgtttcaagtcaaaaattgaggaataatattaggaatatatctgctcaagtttttgttttaaatacacacacacacaaaatgcatatgtaatcctagcagcatttaaggcactatggtgccttatgggttcactatggtgaacccagtgcaccccttgactcccgtttatttcctgtgtcgtcttttgtatcttaaagcaggcagaagtcagggaagctaagcaatgcaaagcatgaactttggagtcaaagttgaggtcaaggggtcacccccctccctgagctcccttggtctccctgtccctgtctggaatggagacggtgccatctccccaaaggtggtgtcatgggaggggtgcccctggcagaaagtagtgggtctgcagtggcggccgcctctccttctgcccccagggtcccctcgtggaagtttctcctgtgaggtgcttgctcctagggatgtccagtctgcctgcggctgtctgtccttaaatgcttcctgggtttggtttcccaagtgctgtcatggggtggtctcacctgctcatggtgggtgcccagggtgactgaagtcagcaggggtgtccctacctctcccaagagatggctgagctggagggtaccacaccctggtgttccccccttctctttctattttatgttcacccacttgtcttccgagaacagccatctgcttaggaggtgagctctaaaaggcctcaccaaaagatcttttgtcaggaatttgctagttttaaataagttctttaaataatctgtcagaagagtgtagggaataaaaacaaccgtttttacacatttagacagggtcattcccttcttgattaatcacattttttcctccccgaaacacttacttgcagtcataaaaagcacaactttggtgataaagtgaggattgcaatctcttgcacctatgagattgtttatgattgtttatgtgtgttcctttttgcagtgaaattggtggtgtttttcttattaacgtgtataacttatgcagcatttgtgtggcagactactgcagccgtggctttggggtctgaagtgaatgagatgaaacacccacagcaccctttaaaaactgtttttcgtttattttcacagcaaacccaaggagcctgtattcagtgcaggtaagtctgatttaatttatgtatgggaacccctcactcactctctcagaactcaagggacagaaaagaagtagccagtttcaggggccagccttggacacacaggagctttggtttgtgcaggcccagatggagctttgtacctggaggttgaatggctcagatagtgacagcgagactgcctttaaacagtcataaagagcaaacccttcacctaccctctccaaaaccaacgtaagacatgccagtaaggaggagagtggaatgccaccacctatgccatgatggaatttctagattaaaaggtgtctgttgccttggttattccttccttactaactggattctgttatcaacatttgcatttctcttaggggaaagtttcttatgcatcaagttatataactgtctaaaagtagcttttctttttctgcctatgatctcctaaactgcaaactaatagttcatgtatatctttccatatatcttttttaacaccttttgtaataaggtagatgctgttgtctagcatcttaaccttatttagaaatgcatttaaaatgcaaaaaatggacaagtatgtaattgatgaaatacattcatttaattttaattgttctagttttttcttaagttcagaattaaaacataaaagtcaaagttgtgtatttatcagcatgtgctttagtgttcatttcattttcaggaagcatgaaattactcactgaaaatgtacttgctgtaagctcgcagggccacattgtgagcgcacttgtcaggatccctgaaccgtgtccagattttaagactggggggcaggtcaggtgttggcctgcgggctagtgagggctccgggctccggggcaggcaggccagccacacttgcagtactccaccgtctctttatctagcccttctgtctctgtctccgaaatcacaagggaaacgccgggtgacacactgcaaaggtaggcagcatttctgaaacctcatagctctctgagcaaagctgttacccaggctacagaaacctttttcatacaggcaaacagatgctctccttgtatgaaaatgtttttgtgttgcaaaccacttcgattcattttaagttaaacgcatccctgagcatttactcggatgggctttaataagtggctgtaatttggatcccaattggtattggctgactgcaggaatttttttttcatctatgtaaaccttaagagagctatagggccacccctggatgtcccactgtttgacttggtatcatgcactgctgctggcctcttcccactagcgcctttgggtttggtggcgtgtgtgctgttatcctaacctgcctggaacaaacactgctttccctggctgcattttgattttagatgtagcctgtctgaatcaccagtacaaaacagtgccaaggctgacttcagtgctttttttgcctagttcagtaagttaaaattctgcagtaagtaagctcagtcctaaggtttcttaatcatcacatacctgtgatagactcatgtggatatttcatagacattggttatatacatccacactctgcattttttatgtgttgtggaaatagcattatattgtctttattcctaacctacattctgcgagctttctggcaggactgattctcttacaaagagagttgctagaatcccttttcatttagctgtcaactccagtctcctgcccctcttttcaagaatgtcaatcgtttgggtgcttttagattctttggttgtggtagccacacagcccctgatgagcttatatttgggtgaggtttaaggaagggaagaagcttcagaagagaacagcatgagcggtggcacagacaggacagggtgtagaggggggcaaagagacacgcctggccccagaggagaatccctgtgggtggctgtggcagatgaggtcctgtgcggtgagagcctggcagggcatttagacctgctggatccagcaaggaagagagcaggtgaagaagtttacatggaggaagggctccgtaaaacctggtttgggccttggtgggtttggcagcagtgtgtaaactgacccaggagagccataagacagcctgtggtgatggggccccagtgcacctggggaagttggcaccagtgtgggagacattgtaaggggaggatccatgggacgcagtggctggcacacataggcagggatgatcgcgttcatgactctcactcaacgtcagccttaatacgcagtgtgaagagtgtgtcacgtgcatgcatttaagacctgaagcgcatacacacaataacatgaaactggggtgccctcttgatttttaagtaatactgcatgtggcattgtttgaaaatccttaagaataagacttataaaactaacttgtactataattatttcctaactgttcctcgccaatttcctccctgcggatgctttttctgttgagttgtgtacaggtatccctggttccaactgcccagtttaaataccattaaaaccaggtcctttgatctgcagtgaaatttcagaattcagcgagttctgaatctgaacagaattcaccaggagcggagctcacaagacattttctttgcccttatcatatcctgagaactccagtcagaacaccccaagatgttctttttgaggtctaggagttaccccgtgttgatacgttgttgatatttacttttgtccctatgatttattgaaatattaaaagttattttattatagaaatgttcgttctgaagagttttgcatcctgatttctctctctaatgggtcttttgttcttttgttttccatttctagattttctttgagcattttcctttctgcattgcatcctagcatgcacttctgctgattttgtgttctttacacttgaaagaattgttcaattaaaagatacataaagatatatttttacattgcaatataacaaatccatttaaatattgaaaaatatttgtgaatttggatattgagattgtgtatacattgaactcaaaaactttaagtggatttcttgtgttagttgaattttgggggtggtattttttcccctcctgatgataaaagaaagtaaacagtaaaatctcatggaaaatcattgttggaatcaagttccttcctgccttttacaatttcgtaggtatctcatgtacttaagtaaacagaatatcaaaagcaaacaagatgcaaacttttgtttcaaactgtttatttttatgttacttttttccctaggatatcaattagaatgacggaagggtaaaagtttctcttttatactgaaaggctagagaggataaagcatttgttttcaggtacgctgggcactgaggtatcttactgaaatctttgttctttttgtagaagaaggctatgtaaaaatgtttcttcgtggacgccctgttaccatgtacatgcccaaagatcaagtggattcttacagcttggaagcaaaagtagaacttccaaccaagagactcaagctggaatgggtgtatcctttattcattgattaggtctcacatgaagttatcagtcaatcaatgcttgatgttaactgtagaaattcataaaacttaagtcctcttaagcttttaaaaaacaaaatgttttactgttacttttgaaaacttaatgtaacaaaattgactatatgttagagacctacagagttctaacaaagtaggagcttcataagagcggtttattatcaggagaaccaacttatcattcctgaacgaaatagctgtggttctggctcaaatacatgttcattattttgctgaaaagaaaatatgaagatgttatatgattgtatgagtgatttttttctttgtcaggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccctatgttgccccagctgttcttgagctcctggactcaagcaatctgctcgtctcagcttcccaaagtgctgggattataggcatgagccaccatgcccagccaaaagccaattatttttaacaggagctatcatatacttagtcaactcttcagggacagatggaaaactaggcactctctatatttataaggaaacaacagtgacaatgcaagaaaatattgtccttatgattgaggaaatgggagtatccaaaattgaaactaaaccacattggcaaaaaagtttttaaacccaaagaaagaggggtactctgaaaggaggactagcattctccccttaaaccaagtatggacttggccagccttaggagccaaacttcaagtgtgaccttgactgaagggatgatagaaaaatatgaataccaaagtactgaatgaagggagtcaagtgaatgacgtaaatgaaattgacatatcacgtagatatcatcctactttaaaaaaaaaaaaaaactagctacagggatgcatccctgtagtcccagctgttcaagaggcttagatggaaggatccaggagttcaagtccagcctgggtaacttggcaagtccctgtctcaaaaatacatatattcatatcaatcaaaaaggctccccaaaaatctaggccacaaaaatctgaatcaaccatataactaatgttcttgaaacagaggtgctggtagcttcatggcatgaggtttggaaaagtgagtttccaggggaaaaaacaactgaaagataagaaaatagaaactgtgaaaaaggtgaattaaatgttgattatttttccattttcttattactttagaggaatcctgcagagaccacctttcagtctatgcagattttaagggaaaaaaaaaattttttttcaccttcaaatatttgagtacctgtttaataccaagcctggaacacaaattataagatgttggtttaaatttaagctattgtgacttcatttagaataattactatttgagattatggaatcatattccttagaaattttttaaaattaccacctgtacctaaatttctcccccaaaatacttttttttttccagattcaaatgtcataggcatttacctgcacctgttttggaatctatcttgatacatgaaattgaagtgcttcagctcgtctttaagtcagtagtggtttattaaacggttatatcacatctggaaaacattattcaaaacatttattcagcctacttcctgttcatattttagaagatgtaaagcaatgaaatttgctctaaataaatggcatttttttggccattatttggcatcttgccaggttactttttacatccaagttgaagtgatattttgttctcaaaataaaataattttcaaggtttggaaatataatgcaaaaattttaacagggattcttatcccaaaggatctgaggggcctgatttttttttttttaccttttatgtatgcttgtgtgcatgtgtgtgtgtcatttgtaccctttgtaagtacttttaccatgtttaaaaaaggaattttttagtaaaaatttagctcgtagattacagtaaaaaaattaataattgactcaatagctttctaaaaataaaaccaaatcattgtgaaaatacgtattcacattacatcaatgactgtttcaactttactgcatgccttttgggggtcacatgtatttgtcatggaatatttgcaatttaatgttgtttaaattagtgatgctgatggtaatagttatatggtattttattgcctgtgcctgttgaataaagctgatgttttgtcagctcttaaagggaaaaaaaattttatcttgacatccacaaagctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtggtaagtcctgaaacaggtcattcctgcgactcagaaggcgaaggtaggaggatcgcttgaggccaggagttccagaccatcctgggcaacagtgaaaccctgtctctaaaataaataaataaataaatgtgattcctgttgcacaggtggaaatagcattagcagaacacggtcagtattgggacataactaaagagaaggaagagggtctgaggaaatgaggtctttgggagagctcttctgtgtggtctccttgtggtccgctcactactgcgctccgtgagacccctctcatgtttaattttccagcctcaccaacgcatgagcttcacggaccacattgtctcaacaaacagcgccacctctttggaggccttcttaacacatcatgtattaaaggcttctaatttgggtctttattttttgataaacataaaaatgtgttgcctcatgtttgtggctgagtcggctcttcccataattcatttatagcttttggtaggcatattacatatcttggaaggatggatgcgtgaagagatggatttatatatttgtatttgtcctggttccttggtcaatgataaaaatcctgttcacgaaagatggtatctttcctatttatgtactcaacatgactttttaataaagattgtagactaatgtagtggttctgagattgaaatggtattttcccagcagaggatgctttttccttcagtttgaaaattcttaagaagaaataagggaattaagatgaaatgaattaggtactagttgtctaacgtcgtggtgctcagagaatttgtcatgagtctgtaagaagttaggcattatatatttcttatatttaaatttttgactagattatatttgagcaagggaaaagtaaaacttacctgcaacatgtagatgttttgtaaatatccttttcttagcctagcagttcatcctgatcggatcacgatagcaacaggacaagttgcgggcacatcgaaggatggaaaagtgagttacgttaccttttcattgtttcataatgaactggtaacacaaagtaatttttagaaaacattgtgctgctgagtaaggctgcttagatataattatggtatctgaaaacttctgaacccctcactagaattttttattgtaaattagaagacttattgtgtggcagggtgcggtggctcacgcctgtaatcccagcactttgggatgccaaggcaggctggatctcttgaggtcagaagtttgagaccagcctagccaacatagtgaaacccgtctctaccaaaaatacaaaaattagccaggcgtggtgtcacatgaccgtagtcccagctactctggaggctgaagcaggagaatcacttgaacccgggaggcggaggttgcagtgagccaagatcatgccactgcactccatcctgggtgacagagagagactaagtctcaaaaaaaaaaaaaaaaatactgactgtgaccttaaaaatccctggagctcatcttaatttcatcagatttttaaatagcattgttctgaacaaagaattcgctaattcttaaaatgtttatttatatgataagtattaaaaatatgaaggtaaacatttaataaagttaaaattataataataatttgaatgtacaacattttgccaaatttcagccaccctctgccctgtcctgtgaatgtcgtttaacagtcgtgactttaacccatgaagtttgtgtctgtgtgcagtcacaaaagctactaggaggtttttagcacagattttgcaagcacttcagcaagactttaatttgcattttaaggcgttagagagggagcttgtagcttttttgatatctacttttatatagcttgttattgcataatattttatctgaaactaatttctttaagtacatacattttatcaacatgttttcatccagaaaaaatgaatactaccatatttcagaaaatattttagtaacattggattttaaatattaatcttatgctattttccattaatttttttttttttcttgagacagggtctcactctgtcacccaggctggaatgcagtggcacaatcacgggtcattgccacctctgcccccacaggctcaagtgatcctcccacctcagcctcctgagtagctgggagtacaggcacacgccacctcgcccggttaatttttgtatttttggtagagacagcgtttcaccacatcgcccaggctggtctcaaacttctgggctcaagcgatctgcccacctcagcctcccaaagtactgggattactggcgtgaaccactgcgcctgacctgcattaatattttatacttgaaaagagttaacagaaataatggaaatcagaccactattatgtaaataaatttacttaaattgaatgggtctttcaatttttttttttttaatgttaaatggctttgaaaaattctttgaaattagtggtaagctatttgttcctccctctagtggcttaaaagtatatttcagtttctggcattgaaattgaatcggtactttagaactagagaaaaatattatagttatctttcagtttacccatagagaaatccagagaggcctagtgaatgcccgcggacacccagctgcttagagattagactgaactagaacttggttcacctaacgcctgcctagtgtttctactaggtccaaggccagcaccttttcttactgataaatctactgattgctctatgatgttttcttctattaaggaagagaaaaattagcgtaaataacctaggaacacagttgagaggattttaaaccaattataacaattctaaatcttatttgtacataattgatgcctgttttgcccaagaatattaagctcttttttttttttttttttttttttgagacagagttttgctcttgttgcccaggctggagtgcagtagtgcaatcttggctcactgcaacctccacctcccgggttcaagcgatttcctgcctcagcctcccaagtagctgggattacaggcatgcactaccacgcccggctaattttttgtattttgtagagacagggtttcaccatgttggtcaggctggtctcgaactcctgacctcaggcgatccacctgcctcagcctcccaaagtgctgggattacaggcgtgagccaccacacctggtctgttaagctcttaatattatttggtggtgaccatcttatgaatttaggcatggtgacaccttagcaacaaaacagactttaaaagaataacccatatgtgagattccattttacttgtcatttttcatttctaaaattcagacacatttagatgcacaaattaaagtgtcagttcccatggtactattgtcaaaaattggccattcaaattctaaaacttggtagacctctccttactgttaaattatcaacaaggccctccacctcctgaagtcatcgggaatgttttatttacataaaaaggcagactcctgaaatgcagaaaaagatcttttgttttgacaaagtccgagttactgcccaagtaatcttgtagcttcaaggtaaagacacatgtgtatcaccatcacaattgatggctctgtgtttcttttctgaacagcaattgcccccacatgtgcgcatctgggattctgtgacattgaatactctccacgtcattggaataggtttttttgaccgagcagtcacctgtattgcattctcaaaatctgtaagtatgtgccctgtggatattgctgtcttcttccacaggaagtagagaatcaactcagggttgaagagggggagttgacacactcgatacctgcctgggtgtatgtacagatttggactctgaaacattcctgcttcccagaacccctcagtcagaggtcatatgcatgtctcatcagggacacacacttccttccaatcagacatctccagccacatgggtttggtgatgaaaacaggcccccagagatatcgtcctcactttccttaaggcagtttatgtgctctggccttgaatttcacctgcttctttcaagggtggctccagcgtgtctgtctctgccatcctgctactggaaaggggtcccgatccagaccccaagggagagttcttggatctcttgtaagaattcaaggcaagtccatagagtaaagtgaaagcaagtttattaggaaagtaaaacactaaaagaatgtctactctatagagcagccctgaggtctgctggttgcccatttttatgactatttcttgatgatatgctaaacaaggggtggattattcatgcctcccctttttagaccatatagggtaacttcctgatgctgccatggcatttgtaaactgtcatggtgctggtgggagtgtagcagtgaggacaaccagaggtcactcttgtcgccatcttggttttggcgggatttagccggcttctttactgcaagcggttatatcagcaaggtttttatgacctgtaccttgtgccaacctccatctcattctgtgacctagaatgcctaaccacctgggaatgcagcccagtaggtctcagcctcattttccccagcccctattcaagttgctctggttcaaatgcctctgacatttctcccctcccttttataagagaatccttaatcctaagggttgtaaagggacaaagatccatcttctgtaacttcttcgggctgaatagggatgatgatattcctgcctaactattagggtctcttgtatttggggtagagaagagctcagtcagaagacgtcagtatggcaaggtgatatctggaagattattaagtgttcaacttaagaaaacattgagtaagcttatcctgcattcctacacaaagagtgcaacagcaatatattccacaacagtaaaacaaaataaacaaaattatcccaagtaaactaagtaagaaggctttttattaactgggcaactattggaaccaagctgatatggggtcgctagctgattccagtgtgtccagaattggaatactgatccagatatttacattacccattgcttttatttcttctgagccgcagtcagagatcactggttggttcacaggaataagcagggttagtttaaatagcagaaaaaacttaaaaacgactgatgaaactagaatctaatgacaaatgtaccatagttcttgaaacataatttctgtctccagtctcccatttttactaaagacaaaccataacaggactgattagtttggaaaaataagccttagtcttgtatacttggcttgattatttgtataaagtgcagcaagaataattatttttcacataggctttttaaattggctttgatggaactctgttccataaggaatctcagataagaccttttttaaagccaagcccagccataggtttatattctcaaatacctatgggttgggtaaattcctctcctcttggggggtcccaagataacttggggctcctgggcctgtgagaaagtgacattctttacttaccacagatcaggaaccctgtacagggactgtggagacaaggtacaaggccagtttcccccaaggggcttctattgactctacaattcaatttgattccttaaaggaaagcatgccattcctgtgaaaaaaataaccagtttctccagttgtgtcctgttacaaacaaaaacaaattctttacaattatgcaattaactatattgccataaattaagaatactcacaaatagtttctaaattctggagagatcaggttgagagaaacaaatatgcttcaaattttgttcatagcagtatactttacttaattgttaaaagctctaaatagctcaaaagaaaagttttcttgtctttgaaaaaagcaaaggatcagcaacattttaagcaaagtcaaaaaagatgatttcaatcttctattagtttggttcatgcagttaactcctgttctgcttgatattcaggaacatttcagctccccatgagagtcctgaaagttttttcctctattctcatgttacaactttgaaagtaatcagaaacttgcattcaagagcacctgttaaaggcctatatctgattataagccgccttttaaataggaccaaaacaagacaagaattgtctgtggatgacagaaagtcttaggacagccacaattaaagccacaattgacaaggaaatttggttactcctggagcatacaataatttaacataacaagtacaactattaataacatacactaagtcatatcagaattataggagtttcacctaattttggaacacatgccagtaacatatttatacaaatacagcccaaagaaagccaatttcctatttgacaatgcttcctgtatgacttttataccaaataagccaaatttcacctttacattagtgtactattgatgttaaatattcttaacaaaatctcatagataaatctattcattttttttttttttttgagacagagtctcactctgtcacccaggctagagggcagtggcatgatttcagctcactgcaacctccacctcccgggttcaagcaattctcccacctcacctccctagaagctaggattacaggtgcacaccaccatgcccagccatttttttgtatttttagtagagacgggtttcactgtgttggccatgctgatctcgaactcctgacctcaagtgatccacccgcctcggcctcccaaagtgctggggttacaggtgtgagccatcgtgcctggccaatgtattcaattttaatcactgtgaccataaggtaagatttttataaaccttttattaatcctttacaatttgtgttgaaaagcagatcattgctcagagaaaaacctgttgtgcttttattccaatgtttaatttacagaaaaactgattaatacccctttaactttagccaatatgttcacacagaatttctttacaagattaatttctctcaaactttcgacaacttgcttaaactttgagctttattctatctaatttaaaacaataatttaaccttttaatctaggcaaaaaaaaatccacatttccatgccttcttataatctattaccaaaagacatttcactttctttatacaccttacatataaaacagtttttatttcccaaaaattacttaattcatgtgaactgaaaggcattacactttttacttttcttacaaaatatttgatttaagcttattattattattacaccaattaatcaaagctctttcatatataaacatcacacacataatacatgtaaatacacagacagaaaataaaggactcattccctaagccaggaattgaaccctgatcccaggctgccactgtgatggcagagaccaagataaagtactgccacgtgttacaaggtcaagctcccaagcacacgaaacaagataagagagaaactttatccagttttttttcaggaacctgccacaaaatttataactgaccagtttgctgtgctactttgaacagtgggcttatagggtcctaggcccacattctatcctatggtacccctctttatgacagaatgatatagaagacaaatttataacacaaagcacaacagattttctacagcttaagattaccctcacaaatccttttttcccattaatcaaaactttacaggagataaatagtgatttttaccattcattcagccagtttgcagagagagagagagagaaaggccagaagtctgactggtaagaaattcttaccattttgctggcatgccaggcttctgggttccctttccctgaggcggccctagtgatccagctggctgcaccacagccctaggggccaagccacatcataaaggaaaattatctttttctgtcctggccagagcaaaatatgtgtgacaaaacatagatattagccattcagctcagcacccagcacccaaaatcaaactggcagggctcagacatgcccctggtcggccccatcgttgttaatccagcctccaaccaggagcttcaacttacggtctctgggcaagatggtggccctgagtaatagaaaacataagaaagggaaaaaggagagagagaaaagcattccctgtggcagggcggggaaggtgaagagctcagggaggccagagaaagacctgcccactgcagtgacactgaaaagttcaggtggctgcctgttgataacgaagggatctttcccagcagtcccgtcagctcttaaatttccccttttggggaggaaaaagttccccatgtcccatgatcttgtacatgcctaattctgtcacccttagccatcagcaaagagtgcaaggcagataaacccaaagatgataatagcagttaacgtcccatagtgccaagcctgttcttagctgaaaaggactttactgagagggacctctaaccccctaaatcttaggaaggactctaaccttcctaagttgggcctggaacccaaggtctgtctagcgtccttgccttttattaagaggggcctttaacccactctgtcttaggagagactcctaagttaggcctctaacccaatcccatcctttgcccaggtgtgtgccccccccttacccaaaatcagccattcggtgtgtacagatgatttttctttgcatcaggggtctccagtatcatccctttggggttcaccagaaagatgttaccagaccccaccacttactaaagttagcctttggattggaggtttcctcagtattgtcccttctgtggtctccagaaagatgtcactggaccccaccacttacccaaagtcagcgtttgggttgggggtttcctcagtgtcatcgcttcatggtcaccagaaagatgtgatcataaaggggtcccaatccagaccccaaaagagggttcttggatctcacgcaagaaagaattctaggcgattccataaagtgaaagcaagttttttaggaaagtaaaggaatagaagaatggctactccatagacagagcagccccgagggctgctggttgcctatttccatggttatttcttgatgatatactaagtgagggatggattattgatgcctcccctttttagagcatatagggtaacttcctgacgttgccatgacatgtataaactgtcatggtgctggtgggagtgtagcagtgaggacaaccagaggtcactcttgttgccatcttggttttggtgggatttagccagcttctttactgcaagctgttttatcagcaagatctttataacctgtgtcttgtgccaacctcctatctcattctgtgacctagaatgcctaaccatctgggaatgcagcccagtaggtctcagccttattttacccatcccccattcaagatggagttgctctgattcaaatgcctctgacaatcccaacgtggctggcgggcagcctggctgcaagcaggggtcggacagggccttgtcatcttccaggcttcctcaggacgtgctggttcagcagacccaccctacactctttcaaaccatttcaaccacttcagaaacccatattcacacacatgtgcacgtgttcacatgaaaagacccccttgcactcaggcccccagagccgaggcattgtgcagccccacagcagccaccttcacagctgctaacagcccctgtgccatgcctgctgcaggcactgtctgctctaggaggggctcttgttttcatggaacccagtggtgaagagacaccccactggcccttctcttccccaattcctgtttcttcattccccatcatttacctgctctttctgtctggtcaagaaagcatgtctcagccaggcccagtggctcagccaggcacagtggctcacaccttctaaccagcactttaggagtctgaagtaggaggattgcttgagcccaggagtttgtgaccagcctgggcaacatagggagatcccatctctacaaataataataataaagagtagctgggagtggtggtacacacccgcggtcccagctacatgggaggctggggtaggaggattgcttgagcctgggaggtcaagggtgcagagagcaatgattgcaccactgcactgtgacctggatgacagagcaaaaccctgtctccagaaaaagaaagaaagaaagaaagcaggtctcaaaagcaatggatgagtattctttaactacaatgtagcagactctttattaaaaatgaaatttgatgtttatttttaatcatgttcaacccactttattctcagatatagtcttcctgtgaataactttcttttcagaatggaggaaccaatctctgtgctgtggatgactccaacgaccatgtgctctctgtatgggactggcagaaagaagaaaaactagcagatgtgaaggtcatgctccaagccttttttgggctgcattaacattttcccattcagagccgccctggcatagtggtagccccctttcagcgggctcattcccaccccagcccttgtgtatgacgccttcaccttagaatcgtttggccccgatccctgtcccatcatgggactttgaccccaggtcctgttagggttttttctcttttcgccatgtctgtaagattgttttcttcctcatttcatagccactacccttttaattcatccagtcatgtatttgctggctgttcctttcatttgcttggcacaccccgagtgcctgccacgtgctcgcacggcacgtggaggcccggaaatgtgctcaggcgtgaggtgggcttgctgcctgagcccctgcagccgcaggaagggcaggtatgggcaggggccgccagcacgggggctcctccaaagtggcacagactcaggaaagaccagcgggagccccgagctaaaccccaaatccttcccaacaggattcctcctgcgaggggccccttgggacttctttgaccgcctctaatccgttttgcacaatatgtcaaattcccttgccttgactgacctttttctatttctattttctattggaagcctatttttatagactcgaattcagatttctcatctttgcatctattaaccttagataaccttagtcacctaactttctctgctgcatgtctgcgaggcagaccttgtattctaaccaggtctgttccctgacacctgtgttcattccctagccccaccttctgatattctgggcaggtgtttaagttcttcttgctacgttgctaggttagaaggcatcagaggcaggttattatccaggctcaagaatgtgtaactgcattattaaatagaagcagtgatcagagcccaatccagtaggccagggtgcgggtcttggaggttagggtgtgggctgaaggtggcggaggtggcacctgaagtgctagatctactccatgggaccccaggccggttcactgagccacaggcagagtcccaggagtcaatcgcaggaggaactccctggggaaacgggcagccagagtcagccacgaacaatggacctttgtaaaatccattccagggccctccctggagatgacatttaccagatagggggtgaggcctagagatctgcattttaccatttctggtgattccatttgttcggccagactgggaacccatgactagcagatgagagcaaatgcttgcagttctgaagtccctctggtcccaactccctcctcagcaaagcatgctgcatgcccaccccatgcctggccctgggagaggccctggcatagacagaggactcctgggtgctccctgtcctcaagggctcattgtccagtgggggagacagacaaggaggaggtattaaggcccacaccagcatatgcttgatgtttttagcaagatggattcaatgggggaaataataggcattgtgcttgccttgaatttcttatttatttgtggctcacattttacttgttttcctacatgtctcttacgcgtcttaagagatgtgaggcatccgagtccctgtttttcctatagtgctctaatgaagctgtgtttgctgcggatttccaccccacggacaccaacatcatagttacttgtggaaaatcacatctctacttttggacactagaaggaagctcccttaataagaagcaaggattattcgaggtaaagttaaattatgatttttgctttatttttctctcgtatatgtgattggctagatgcatctctctgggggctctggtgatcaacacaatcccttgggatccctcacatagttgggaagcgtgtcacacctggtagataacgctggtaatgaagtgaagaaaaggacagagcaagcctgggtggagggcagggaaaggacctggacccagggagcaccaagcctcccacagtggcactggctgcagagagtatcagaagatgaagtcatcgggaggcaggcaacctgcctttgcaaaagacattagagactccctgtgccttttgtctggacgttgtggggctgcgagagcaccaggggacagcaccttttcccgggggtccatctgccaccacctccctgaggcttgtttcgaggacccctttattctggtgctcggaccctgccctttaggctgacagcatagccccacccttctccccggtcagtaccctcctccgcttgctgtctgcagctttatgattccccagccacttggggttgctagaaatcgctttgtcttagagcagttaatctcacagcagaagttatgtaatagtagacagaaatgcaaggtgtgcagggtggtcacagaagctgacactatccagcttgggaccactgcgaatctagatgttattagtacaaatgaaaggttgtctggaatatatatatgttgtatggattaaatatatatataatttttttactacattctacagaaacaagaaaagccaaagtttgtcctctgtgtgactttctctgaaaacggtgacaccattactggagattcaagtggcaacatcttagtatggggaaaaggtaataagtgattgttcccaaaaccaatggtttttggtaatgttgtaagagatcaaacatgagtgctttaagaattgtctattaatacaacgtacaggagtaggatgaaatttcaagttacagagacacacacatacatgtgtgcatgtgtaacttgaaaccacaaaactagaacagaggaaaagcggagaatagtaagagttactgaccttacagcattctgaaaggctctttaagcccaagctattatgatggaattaaatagctttattaggaaatcccctgacagattatgatgaaattaatgactacttataggtctgtaaaatatttaagttactatcctgatttatctagcatgtggcagacatttattgaaagctaattatgtgctagacactgtgaacatacaactgagtcagacccaaatcccctgctgtctgtgagcaaacagtttgctaagggagatgatgcatcactcagaaagcatgcgtccagttaagtccagtgagcatttatgagcacttaccccgtgacaagaaaaaagggaaaatccaccatcccttttctcaaggatcttagagtttgaattggggctgaaggtggagacggacttgtaaatgcaatttcagaagcattggtgacatttccagtatccctgctgctcttggctctaggtgtcttattcactgctcacttaatccttagaacaatcctgcagggtaagcagcagccccattccaccaagggggaactgagggtagagtaactaagcaatttgtccagagaaacagctcactagagagctgggatctaaactcagagcccacgttctcagccgcgtggtgcttcaaccatgcggcttcaacaatgcatattttccttcattctaaggtaacccatttcatgcttgtctggtgctctgcgaacgtctagaaattggatccttcatagattcatattgcaatgatgtgctcacggacaatattgcgttttaaaacctaagtcagatgagattagaaaatgggcagaggcaaccttttgacaatgtgctaatgatggttttcttggtgtgtttaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggaggtaagtcatcaaggctactgctaaaatttgtttttaaccttaaactgttatcctttttttattagtttgaaatctgtatcttacagttttgaaaattgtttaggtgaaatcacattatatgggagcaatgtattttattaaaatcctgaggcaggttaaatataactaataaaatagaattaggtttataaaacttgaggttgtaacacacttcatatttagaatatttttattctcaattttccaagggactgttacccacattttgatttattataaaaatctgtcttctcttttaactttttctttttctttttttctttctttctttttttttttagagcagggtctggctctcacccaggctggagtgcagtggtgtgatcacagtttactgcaacctccccctcctgggctcaagtgatcctcccacctcagcctcccaagtagctgcgactttagacacacaccaccacacctggctaatttttgtaattttgtagagatgttgcccaggctggtttggaactcctgagctcaagcgatcctcccacctcagcctcccaaagtgctggattacaagcatgagccaccacgcccagcctcttttaatttttaatttctagcatgttattttggagacattattgcattgagtgaactagtatttgttgagtatctacttcgtacatggccctcagctaagtgccaatgtgctccctagggctgtgactccttttgatacccggtgtacctccccattatctacttggcagccctgcattccggtaggcaccagaggcaagatatttaatattccttctgcccactcagtgaattttctcccccaggttccaggaaatcgtgagcagacactgcaaaattggcctcattctgaagggtgatgcttttcatccctagcttagaatggacagactttaggactttgaacccagatacacacaaaacacttatattttacatcagagagcaacatggcaccaccctctggcagtgtgaaaatttggttctgttgattatttcccttaataaaggaagatcttcatctgagctttggaaatcacttccccttgcctggagattctgttgtgagaacatttttaataataagatttgaccagcatttggttgaacatattgtgaattgctagagtcatagacatgcccaagtcatattataactgtaaagaaagctccaaagccccatctaatttcataaaagctattcactgtttgttagtatctgattcttcctcattagcatgggtcatcatcaacttgactcaaatctgtgctaacatgccacactggagaatgtgtgaggggaggctgcttctttcctggaacgggagagcctaacagcaaccgccagggtcaagctgcagcatttgttctttttatagtacaagaactttgtttcttcatcatagcaaattgttcttaatgggtgtattttgcaattctttctcttaacatttagattattccatatgtttatgtcgatttttaaactgaacagaatgacattgccaaagaacttaccattttaagttgtattatggcagtgttattattattattattattaattattattattttcagacagggtctggctctgtcacccaggctggagtgcagtggcgtgatcttcagcctctgcctcccaggctcaagtaattctcccacctcagcctcttgagtagctttccagctactacacgcaccaccatacccagctaattttttttgtatttttggtagaaatggagtcttgctatattgcccaggctggtctagaactcctgggctcaagcaatccacctacctcggccccccaaagtgctgggattacagatgtgagctaccacacctggcctatattctttactttctgaattgtatctactgttgctatcagaaattgtaaaaagtaaagagaaaactaaccagtagcattccttatttttaaattttgttgaggaaaatgctttttcttaacctcattcttgctgatgcttctaagatatataaaatgtttgtagtttaaaaataaggcttagggttttgatcactcactcaacagttggctgtggtatctgtttttttgagatggagtttcactcttgtcacccaggctggagtgtagtggcgtgatctcggctcactgcagcctccacctcctgggttcaagtgattctcctgcctcagcctcccaagtagctgggattacagccacccaccaccatgcccagctaatttttgtatttttagtagagacggggtttcatcatgttgcccaggctggtctccaactcctgacctcaggtgatccacctgcttcagcctcccaacgtgctgggattacaggcatgagccaccaagcctggccagctgtggtatctatgtgaaactctccatatatatgtatatacaacatatatatttgaacgtacattatatacatatgtgtatataaaactgttatagggactatcattatgataagtgttttgaatgactgagctaacaactgaatgaaattgtacatcttttcttttcatatgacttttcaatgcagattccagaacagtttggtccaatacggacagtggccgaggggaaaggcgatgtgatcttgattggcacaactcgaaactttgtcctgcagggcactctgtcaggggacttcacacccattactcaggtacgatcccactcagcaggcccggcaaacactctcattttgcattatatcagaccctaatcaagcattacaatcaggtgctttatactacgataaccttcctccaccccagagtgtctgtggctgctgaaagatgggaggagagaaactgttgagagcagttatgaagtcagcatgaagcctcggttcgtcatcccttacggctcctgagtgcgaactgtagtatctcagagcgcttctgtttgtcttggttatttgtagggtcacactgatgagctctggggactggccatccatgcctcaaaatctcagttcttgacctgtgggcatgacaagcatgccactctctgggacgctgtgggtcaccgtcccgtctgggacaaaataatagaggtaaacatgcacattacatttccatttttcttacagaaattcatctggaacatgtttatttattttttgcatgaaatcaacagtgatacaaagttgtcccaaagcaaatgttatttatctatttagagttgccttaacattgcaattgcatttaacagtgttacttttaacattgcctcgtggcctcagccatgtaattttgaagtttactgttgaaattttctgacaagaagttgttctttctgagttcattgtcagattttctgagtacagtctctcaaccatcctaagagctgaaaaatacttgttatgagcctgcattctatttacagtgtaccctttgaatgggaatttacaagctgtactaaacacacgattgaatatatctctacattttgagtttgatggtaaagtgaactttcgtttgaaagtcagctgggcacggtggctcatgcctgtaatcccagcactttgggaggccaaggcaggcagatcacctgaggttgggagctcgagaccagcctgaccaacatggagaaaccccgtctctactaaaaacacaaaattagccgggcatggtggtgcatgcctatactcccagctccttggaaggctgaggcaggagaattgcttgaacccggaaggtggaggttgcagtgagccaagatcacgccattgcactccagcctgggcaacaagagcaaaattctgtctcaaaaaaaaaaaaaaaaaaaaaagtcaacatctctgtgaattttgcaaaagaaactctgatgacctgtcagagtgttgaaatgccctttccccacgtgtattacttgagcactgactgtttgcatgccaagcactgtgcgtgtattatccttaatccctgtagcagctctgcaggttgaagaggttttttttttaactctgattttattgaataggaaattgaggtgtagagaagttaaataacttgccaaggtcactaagttagtgagtgacctagctagtgttagaacccagctcagtctgactcctaaactctggttctttccactgcattgcactgcagcgaatcggaagctcattctctgttgccggtgccctaatgatctgtgcaatcccattgcacagaggaaatagcccttctgtaaaccaacacatcatcctttcatcccccatagagttactggcatgtcccaggtgctaggttcaagttttggctcccttcccttcattttcacggaaggggtgctggtcactggtggccagctgagccgtgaggtggaagggcccaaggggcaggcactgccactcagagagcaggtgtggcccgtgatggcaggaaagggctaaagggaacagtgttatatgttctacctatgccctggtggtccaggagggctgaaggcaatgacagctcctttaccaggctgttaatcatttagcctaacataagggttggagctctaagctggaagccagggaactgcaatgaagttctagctcctctgcctactggccttgtgaccttggacatctgtaactcagtgtccacttctcaaaattgttacgaggcttagatgaatgacacagacagaagtgctttgtaaatggtaaagcttcaagtgaacacgatttctgtttgtgtattagtggcagctctgagcttaattacagctcccactgtagaaagaaagcattgaaataatgtaatcatatatcaagtttctttctcttggttttttagattatccagtggatctcagggcctcctattttcattcccattgctacttttcttcctgatcttccttaatctcttctctcttcatcctaaacactcctgccaagtgccctttatctaaaacacatgttcaatcatgtcactctttttattgaaaggacaagaccattcaaagtgttcttatttcctagtgatcaaagtccttaccatggcagtgacatcactaatgtgatatactctgtgctgtaagcccattgacctatctgccactcctcaaatatgcccacagctgtgttgcttccatcacttttactatattactgcccccttcaccatggtccaaaaaacgactggagtggccacatctcaccttcaccagtgataattcttcctctcctgggaggcccaagtccagtcgtctgtaccgcgaagccttggcccagcttcccagtgtcacctcatccctccctcccctgtgtatctctttcatggatctctttcatggatcattccatcttgtatccgagttagtgatgactgtgtgtgtgttccactggatcaaaacctagaacatgccttgctcatctcatgatccttccaggcctccatagtgttttgcacccagtgggcactcacccagtctccgtgtcatggagttgggtgccgtggttgtctttctggagcaatcaagcacactattcagtgagcttaccactcagcacggggagtcaactgaaggggctgggttctataagctgtgactttgtagaagggcatttacctgtctttcatcagattactgtagaaatgagaggatgtaagacaaaaagggaaaaatcctaaaaggacagaaatttaagtcaggctcaatggcttacacctataatcccagcactttgggaggcagagacaggaggatcacttgagcccaggaattcgagaccagcctgggcagcatagggagactccatctctacaaaattaaaaattaaaaaattagccaggtgtggtgacacacacctgtagtcccagctgcttcagaggctgagccaggagtgtcacttgtgctgcaataagtcatgatcatgccattgtactccagcctgtgcaatagagtgagatcctgcctcaaaaaagggtgggggtaggtagaaatttagcattattgaaacgcagcattcattcaagcaggaaaacatttttctctagaaaagagacttttcaaatagagccatatagccctaaggaattagaagtgtgagcgtttgtgtgtgcacgcactcacgtgtgtgtgttttatgctatagtgttctatctgttcatcaatttacacttcctttaaaatattttaggatccagctcagtcttctggttttcatccttcagggtctgtggttgcagtcggaacactcactgggaggtaagtccatgccaacagcgcttgtgcttgcaaagcttatggaaaagaggcctgttgtttctatttccccaggaacaggcccccgttcagctcttggctacatgttcgaagcttctaatgacttaccaagaattaagttaaaagcgaaacttgaaacagtggcccattacattttgagccttggggaatctgaggaaagccatagaccctctctcctggaaaaggaccctctacctccactagacacacacacactttttttgtttgttttttgagacaggtctctccttgtcacccagactgaagtgcagtggcacaatcacagcttactgcagcctccagggcttaagtgatcctcccacctcagcctcccaagtagctgggactacaggcatgcactgccatgctcaactaatattttatcttttgtagagacgcaggtctcactgtgttgcccaggctggtcttgagctctagctcaagcagtcctcccacctcggtctcccaaagtgctgagatcacaggcatgaggcaccacacccagccacacacacattttgcctacaatctcgaggatttgtggagcttctcaagccctgatcttgaggctgtgggagaagccttgattttggaatgaagcaagaaaacatttcaaagtgctgagcatttaaaaatgctttttctactcctggtcacagtggctcacacttgtaatcccaaccctttgagaggcctaggcaggaagatcgtttgaggctaggagttcgagaccagcctgggcaacacagcaagaccctatctctataaaaaatttaaaattgagctggatatggtggtccacatctgtattagctactcaggaggctaaggcagggggatctcttaagatcaggagttcgaggctgcatcgcactatgattgcaccactgtaccctcgcctaagccacacagcgagaccccatctctaaaaaaaattaaaaatagaaaataaatgctttttctagctgccctttcaaaatttcaggaactgcccagaccctgagcctcatattccaattgagttaatacctattcacctggcacctcctacacaccggatggtgggtctgcgtttgcagctcagctttgccacttagcagcagtgtctttgagccggttacataagctctctgaatttgtttctttttctgtaaattgtgatattccctgcctggctgtgttgcactgaggatcgaaggagacagtgcacacagcacctgccagggctgcccatcaggcactgcaggggttattattatcattgctttccaggttttgattgaacatttatgctgctcattgtactgtatacatttactgtggtttcagtcaaatatttttcctcccacccttcctctctaaaaaagcgtagcacttaaattctgttgctatgactgcagagcctatatggataaagaaagtgtagccctttgcaggtcataggtagcaatatcttaagtattgggctccatgtagccaacagaattcttcatgaaaacgtttgtatagccacacacacacatacgcatgcacacagacacacacacacacacacacacacacacacacacacactccacctcccatttgactctctttgagacaggtaaaccttctaactcatcaggctcccaccttctgatgactggcctcccaataggctgacggatgccagcatgcctactgtgtgtgtaggacacggtgacagtgctcagaatcacagtgtcccatggtggaggagatggatcgggtcacctaatccagcccctcatctgtacctcttgccattcaggtcctaggttaggcttagctcccgatgctgttgatttaacaggtcacttcaaagccatgttctaatcagccccagcctttattaaggttaaatagcacattaaaggtaaatggttgttgaagatgcaagaaattggcactgaaaagcaaaatccacatttctggggggcaggacatctgacagtgcctggctaggggggctcctgtggaagacaagggacactcactctgcgtcagtggacatgctgatgggatgtcctcaggcaggttagaaactgcagcaacagtttatccatttatccttatccatttatccatttatcctgaaaacaccaggggctcaccaccaccccttgagaatataacaggcaggagagttcagtcattctgatgttaacactcatttagtgggtactgtgtgcttatcagaggatacaaagcacttccatgtccattatcattcgactttaatattgagcctgcagagtagacctgggctcttctccccatctcaccactgaggaaatggcccagcgaggtgaaattagaagaccagtcctccactccgatttctcccatttgctctgtgctttccctcgccctgttggttgcaggctagcatccccataaggcctgtactcttggcctgctctgtctgcagcaccattgggaacaccaccaccccggagttgtcccagccccatcctcctgcatggtcctgcttcgccctggaaacctgggtgagctcttgcaggtggtccttcactgcttcctctcaccatatgccctggcactaggtattggcatcttccctgcccagagctttctctccatgtgtaaatgacaaagcacaaacacagagaaaccatgtcatagtgttgataatggcatagttttgaatgctagccaatatgctgttcctttcattagaaaatgcttatatataggaaattttctttgaatgaaagctgggaacaagctttcttattaagcaaattctgagtatttattaagcttttatgattaacaatttttattcatcccactattatataatcttcattttcttattaaacaacttactgtgctttttctcatgttgataacaggtggtttgtgtttgacacagaaacaaaagacttggtcaccgttcacacagatggaaacgaacagctctctgtaatgcgatactcaccaggttagactccaaaccattcactactttattttttttaatcaacttttattttaagttctggagtccatgtgcaggatgtgtcggtttgttacataggtaaacgtgtgccatggtggtttaacgcacagatcaacccatcacccacgtattaagcccagcacccattagctgttgttcctgatgctctccctccccctcgcccccctccaacaggccccagtgtgtcttgttccccgcccagtgtgtccatgtgttctcatcattcagctcccacttataagtgagcccatgcggtatttggttttctgttcctacattggtatgctgaggataacagcttccagctccatccatatccccacaaaggacatggtcttgttcctttttatggctgcatattattccatggtgtatatataccacattttcttcatccagtctactattgatgggcatttgggttgattctgtgtctttgctattgtattcactactttaaaatcccaacagaattgagattctgtgtcagtgtctttaaagaaaaaatttcacaagcctcctcagagtaaaatttaaattagacatgcacataattatggcatttagggttcttttccctcctttgggtcactgtgcttgtgttatggaaaatttcaaacatagacaaaattaaacagaatggaataatgaaccccatgtactcatccgccagcttcaatgatgatcagctctcagccagtttcctgcgtctggagccccacccaccacccgcctcccatattctgaagcagttcccagacatctcatcatttcatctgttaataattgtatatatcccaaaaagatgaggactctttttaacagctttattgaggagtaatttacatacaataatgaaccattataaatgtacagctcatcgattctttataagcttgtggagctatgcaacaaccatcactacagtccagttttttaaccttttcatcatccaaaaagtttcctccatgcccattagcagttcacttccaccctcacccccagtccgaggaaactactgatctgttttctgtttccaaaaattgctttttctggacatatcgtgtaaatggattcctacaatatgtagttggttgcatctgacttcattcacgtagaatgatgtttttgagattaatccatgttactgtgcacagagcagtactatattccttctaattgctgggtagttttccattttatggatatataccacatcttgtttatccatgcatcagttaatgatggattttttttttttgagacagagcctcactgcaacctctgcctcccaggttcaagcgattcttctgcctcagcctcccgagtagctgggattacaggtgcatgccaccacacctggctaatttttgtatttttagtagtgatgggatttcgccatattggccaggctggtctcaaactcctgacctcaggtgatccacccacctcggcctcccaaagtgctgggtttacaggcgtgagccaccgcaccctggccttatggatttagattgtttctggttttttattattattaataatgctatgaacattcatgtatatgcctttttgtgtttgttttcatttctcgggtaaattcttaggagtgaaattgacggattgtatggtaaacttatgtttaacattttatgaaactgccagactgcctgtcctattttacattctcgtcagccatgtgctagggttctagtatcatcacatcctcccaatacttgttattgtccttttgattatagtcattctaaagagggtgtaatggcatctcattgtggttttaattggtgtttccctaatgactattgatattgagcattttttaatgtgcatattagtcattccaatatcttctttggtgaaatatctattcagatattttgccaatttttaattgggctgtttgtcttactgttgagtagtaagtcctctttatatattccgtatatacagtctttatcagatagatgatttgcaaatattttttctgaatgtatggcttatctttttttctgtttgtttgtttttgagacagcatctcactctgtcacccaggctggagtgcactggcatgatcatggctcattgcagccttgacctcaggtccaagcaatcctctcacctcagcctcccaagtagctgggaacacaggcacacaccaccacgtctggctaatttttgtatttttgttagagacagggtttcgccatgttgcccaggctggtcttgaactcctgggcccaagtgatctgcctgcctcggcctcccaaaactgctgggattataggtgtgagccaccatgcccagccttcattttcttaatggggttttttaaagcacaaaagctttcaattctgatgaagttcagtttatcagtttttccttttgtggatcatgcctttggggtcgtatccaagatcatgaatatttccttgtatgctttcttttagaagagttgttttagcccttgcattcgagtctatgatccatttgagttaattacacaagagttacaagagtacactagacttgtttcttgtggatggtgagaaggaagagcctgtttgctctgcatagaggtatctagttgtcccaagcactttttgttgaaaacacagtctttccctgttgaattatcaatgacacttttgtcaaaaatcaatcgatcaaaaatgtaaaggtttatttccagatactcagttctgccccttcacctgtgtttatccccgattactgtgaccctagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactttgtggcccaggccggtctcaaacgcctggtctccagagatcgtctcacttcggcctcccaaagtgttgggattacaggtgtgaggcaccacactaggccagctcgtcaatttctaactttgaaaagcctgttaggattgtaagagggattatgtttaatttacagatcaatatgggggaaattgccacctggacaatagtggctcttatcatgagcaaagactgtctctccatttatttaggtctttactttttctcagcaatgctttatagttgtaggtgtacaagtcttgcacttcctttgttaaatttattccaaaataagtgttttttttatgccattgtgaatggaattgttttctgaattttgttttcagttggttggctgctagtatgtaaaaataggattgaattttgcacgtagatcttatatcctatgacctttctaaacttctttgattagttttagtataatagtccctcccaatccacaggggctaccttccaagaccccacacaggtgcctgaaactatggataacaacaaatgctaagtgtactatgtttcttcctatatatacttgcctatggcaaagttaaatgtataaatcaggtacagtaagagattaatgacaataataataaagtagaacaatataacaatatattgtaataagagttatgtgaatatggtttctctttcagaatactgtattatacgtaatatttgcagaccacaattgaccacaggttactgaaaccacagaaagttgtttcagtcttattatattatattaatatcactacattttattaagtttcttctgtttttctgaggagaaaaagcattcagtctttcatcatgagggataaagatgccctttatcatagtgagaaagttcccttctatttctaatttgtttggaggttttagcatgaatggggttggagtttatcagatgctttttctgcatctgttgggattattatgtgggtttcatccttcatcttattttattaatatcactacattttattaattttcagatgttgaaccaacttcacattcctgtggtaaattccccttaatcatggtgtataatcccttttacatgtgtttgctaggattctattaaggatttttgcctccatgtttctaacagatattggtgtatagttttcttttcttgtggcatctttgtctgtctcagttatgagagtactaccggccttacagagcaaattaggaagtgttctctcctctgttttctgaaagagtttgtgaaaagttggtgttatattaaatatttgacagaatgtatgtgaatttggtgaaactacctgggcctttctttgtgggaaggtttttaattactaattcaatttctttacttcttacaagtctattcagatttcttttttcttttttttttttttttgctctgtcacctgggctggtgtacactagcacaaacacggcacactgcagccctgacctcctgggttcaagtgattctgccacctcagcctccaagtagctgggactgcaggcaggcaccaccacacccagctaattttttttagagacagggtattcctatgtctctaaactgaaactcctgggctcaagcagtcttcctgcctcagcctcccaaagtgggattacaggcaggagccaccaaatttctcttttcaactctatttttgcttcatgtagtttgaatgaatgattgggcagaggttatgcacaaataacttaagccagtaaggctccgtcctctgccagtggctctgtgggcaggttgaagggcatgttcaaagttcaggccgtttccatgtcggcctggcttttactttccactcacccttttacatctcctctatgcacatgtacagattcagattggccggaagggtgtctgaataggcaggatcctttcctgcctccactgtgcatgcaccagcctcccgtcagccaggaatgcgctcacccatccaataaccgtaacctcaagccagtagaaaccttggccctccccacccaactgccctagagatggtcacttccatcccagtgctactattgcccagggctccatatggagtgagcccttttaccacagccgcgtggtcctcagagcctgttcttccctgccaggaccgctgtgctggcccagctgctgcgaaggagtgagggcagcccagggaagaacatgatggattcaccctgtttttacctgaagttgagaagattttcaaataaacaacacttctcagattttcatgtcttgttcaatttacagagtctggaaatggttgtttttgtcagttttatagaatttcataattgctttatggggagaggattggccaaccttctcatttggccacagctagaagaactgccctcttattttttgtgttttttggggttttttttttctttttttgagatggagtcttgcactgttgttcaggctggagtgcagtggcatgatttcagctcactgtaacctctgcctcccagattcaagcaattctcctgcctcggcctcctgagtagctggaactacaggcttacgccaccacacctggctaatttttgtatttttagtagagacagggttttgccagattggccaggctggtctcaagctcctagcctcaagtgatctgcccgcctcggcctcccaaagtgctgcgattataggcataagccaccgcccctggcagctcttattttttttaatgactgctttttattgttagagatgaggtcttgctatgttgcaggctggagtgcagtgggtactcacaggtgtgatcacagtacactacagcctcagccccttgaataggtgggactacaggcgtgtgccactgcacccagctctgcctttttttttttttagacagagcctcactctgtcacccaggttggagtgcagtggcgtgatctcagctcactgcaacctctatccctcaagctcaagcaatcctcccacctcagcctcccgagtagctgggactacaggcatgcaccaccatacctggctaattttttgtatttttagtagagatgaggttttgccatgttgcccaggctggtcttgaactcctgagctcaagcaattcacccctgcccttggccttccaaagtgctgggattacaggcgtgagccacagcacagacctgccctcttatttttaatataaccacagtatcgttgtctcctccccaacccaaatcagcattgatgtcttaatatcatcagatggccagttacatgttccagttttcaatttacttttttttaacaatttgtttaaaccaggaagcaaaaaaaagcccacacaatggtaattggttgatatgacttactagtttctgttaatccataggtgttctctctctccctctattacagtaaatttgttgatgaaactggctcgtttgtcctgtagcattttccacactggattttgctgaatgcatctttgtggtgttgtcttcacgtgttcctctgtcccctgtatttcccataaagtgattgctggatatcgaggcttggtcatattcaagctgtatatgtgttgctgtatttttcctttaggaggcacataatgggtttttctcactttttgtgacattagtagctgttgttacccagtgcctagatccataaaggttgccaactattgatttccaatgttagcttttcttcttcatttattagatatagtacttctatgaagaaaaactttccttcatctacaattttggtacccagtggtagagttcatataggaaagtcagaattaatgcttgatttcattcactttattttccagtttctgagataatacatttgctttctgctcctctaacagtcaccgatcagtggtggtgatagtagtggtggtggtagtggtggtggtattggtggtggggggggtgggggggtggtggtggtggtggtattggtggtggtgatggtggtggtggtagtggtagtagtggtggcggtggtggtggtggtggtggtggtggtggtggtggtattggtggtggtggtgatggtggtgatggtggtggtggtggaggtggtggtggtggtgatggtggtggtggtggtgatggtggtggtggtggaggtggtggtggtggtggtggtggtggtggtggtggtgatggtgatggtggtggtggtggtggtggtggtggtggtgatggtgatggtggtggtggtggaggtggtggtggtggtggaggtggtggtggtggtggtggtggtggtggtggtgatggtggtggtggtggaggtggtggtggtggtggtggtggtggtggtggtgatggtgatggtggtggtggtggtggtggtggtggtggtgggtagtggtgtagttttggtgccattatggattgaagtttatttgctgtgttcctgtctgttatattaggtggaagttactctagttggctcctgggtccttttgacgtgacctcaggagcctttagtacttgttctctggcataacaagttgttccaggatccttgtatacatttcttacctatagccctttctctcaggaggccctccttcctttttcatctgaagggaggagatcacaatatgggtgttaggagtgcttgttgccacagggtaggggattgtcttgccttttcattatatgattatgttgtgggaaatactgtttctttcatgcacaggccatttggctatgctgacactcttggaaactggagttttggttctgggaaatacgtggctgactctgagctgctggtctctgtagggatcttctattttataaccttattgacagcgtcaactctgcctcacagtgggacgtgtcctcgagctttagaagatctgatagagcatctcttttggatgttttttcgttgtctctgaaccacgttcataacttctcaccctaaacagacaactgctcagcccccttggcagccttttgtccatgttgagaaggagcttgacttggaatgcctttcattcataacctcctcagtatcacatttctttctgttaatttagccagtgttctgcatcttatcttgtgtttctcaccattttctcagttattttgaacgtctgctgaaggcacgagggcctcatctgcagcctctttcctagaaagccatctgatacctgtcagcgcctgctaacttgagcaggtccattgggaaacatgtttctatttcttgtcagttacactaatgaccattccctggagagcagagagctcttcctactagaactctgcctctcagcttcagagtcattgcctgggagctgtgtggggcaaaagtgaaagccctaagccagggccgggccaaccgcatttgaatctagtgttctcccttagttagccaggtgaccttttcagagcagacagtgagttaccatgaggcccaactgaaagaagtgtgaatgagttctctgcagagcattgtgcagatgtcacaggggatgtgatatcatcatcagtaacagcagcagtgatggcccctggaacagcacccagatggtggactcagacccctggggagtgacccacagttccatgatgggagggaccctattttgttcagcactgtgtgcccagctagctcctagcatagggtttatgacgggttagttgcatgcgtgaatgtagctataactaactacagtgcaacagacacaaagcaaaatgtgatcagcagtatgagttttctggttacacaagatttttccagcatataggctatactgttgtggattactatctcatttttggatttaagtatttacagacctaagactaaagagagagagagagaaagcattcgatgcccaaacacagattgtcattgacatggaatttcagaaacctgctgccaagatcccggccgagatctgtagcccatctccaaggtagcagcaccctgcgctgccatgtgctaagaagggaaaccatgatgaaatgatgagggctttttctcattccgtcagtctcaggaaagctatgagggttctgctgatggccagaggaaaagctagtagcggttcttgagctttataggtggagctggccctcctgggccttcccaggatgtgggaaggaccaacgagcccccagccagaggccccctgcccaaagataaatgccaccttcacactcagtgaggcaggtggacactgaccctttgccacagactggggttgtggagaggagctttaggaggaactggggctattttgcgaatcaaggttcaaggttgatgttaactgtgcaggggtgcgggtctgaggggttacctcataaactggacagtcgaaactttagcagcagttgagaactaaatgtttctggcaatttctcgcttctcgcacaacaggcaggcccaggtttcagttgttggtctatacctcaccgtgggtggaagagggaggttcagaaagtcagcactggaactctgggcacacgcctggaacgcaaccacgaagccaagccctccaggagtgcatgtggatcacccagagcgggtgggggttctttggcatgctcagagccatgagcctagagaatttccatggaccattgaatacccatctcaggcatgttttagcaactgtcatttatggactattttatataacatggtcttttgctgataaactaatgttacgtgaaagtttatcacaaccagtcagctaagtgttggcaaaatgccagctccctcaggcttattaaatacagaagcttcatagtgataattctcatatttaacatgcatgtcgagaatcttatagagcactttatgattggacaggatggagttttgattgaattaagattgtacttttttaaagaacagaaataggaagaaaataacttcctatttattaagcccaactgcagatccttagcctgcctgttctagtttcagctcattgaacctagggtaaaaatctgaatgtgaagatgaaagagagaagcccagaaaggactaggtgcaactggtcatgcaattgtgtttctcttctttgatcttatccatgtcattgtttgaaaggtggggctttttctgcttttactagaatgaatcagaatctggcacttactccgtcacttgcagtattagatcccccatctgcctgggtctgagccctgtgctgatgcaacccctgccacccagccaaccctttcccctgtcatgtggcattccccctccctgggttgatccccatgcagatgcagcagtcttgtctccaagcccaaaattacaatcagtgtgccaggagagaggctacaccatagctgcacggctgttcctacacctgcagaccatcttcgctgccaccccctccctccccaccccagatctcacttgtcagcttacaggtactttgcaagcatgcaaggatttctgtctgtgccactcacctggctgtgttgctgtacacaaattactaagcctcagtttcctcatctgcagagcaagtctaattgaaccctctgctgaggcgctgttgggcttgactgaagcccccagcctccagcctggtgaagagtgagcaatcagtagaaaacagccgtaaggttgtccttctgccctgagcacctggactcttgctcccgtggctttatgagttctccagctgattttcattttgggccaaatcctagcttatttcagtggagtaagtttaggaatctcagtctccgagagagctggggaatgaggcttagagagtttttggaggagaggagaacaattagggaaagaaaaagggctctgtgggacccaagaaacaggctgtgctaggtttcttctggcctctggttagcatattgacaaacgctggttggttttgatttcttaggcaattgtttttatatatttatggatgaatgtaggtaaaagagctaggatttgaacccaggtttttctgcctcgaaggccacattctaatcctcacactctgccgtcttgccgggcagtcgtcgcggtcaacgggagagtcattttgaggtttttcgtggtggttatgtcgggggccaggggctgggaggcacctcctctgaggaagggaacgtttctcctggttctgcctttgtctctgagccactgcctgcatttccacatcacgcactggtgggtgcgtgctaaggacgtggaaacctgggtggggtggggtggtcagagttgtttacaaggaagattagggcctcctgggccatcttttcgtgcctgtgcagaggcctggggttgtggatggtacgatcagccggttcccctctgcagggaggacttccccaggcagaggtgagcttcaactcctgcatgaagaccgtggattagaataggaaaaaggaattacaatctgattaagcctgtcagagatagaagtggattgctgagagagattgtgaagtcctgtttcattcatctttaaaaacagatatgggggccgggcgcggtggctcacatctgtaatcccagcactttgggaggccgaggcaagtggattacctgaggtcaggagtttgagaccagcctagcctacatggtgaaacccatctctactaaaaatacgaaataattagccagacgcggtggcaggcgcctgtaatcccagctatctggaaggctgaggcaggagaatcgcttgaactcaggaggcagaggggcagatgttgcagtgagctgagattgcaccattgcactccagcctgggcaacagagcaagactccatcttaaaaaaaaaaaaaaaaagatatggcgatggtgattatgcaggtgtagttgtcaaaactcctcgaaccatgcacttgaaatgtgtgcattttactgcccgaaaattgtgggatgatgttgtaacatgacttttttccttaaatagccaattgcgttaaacctgtttgttaaataacaaatagttccattatggccgggcacagtggctcacacctgtaatcccagcactttgggaggccaaggatgttttgcttgagcacaggagttcgagaccagcttgggcaacatagtgagacccccgtctcaacaaaaaaataaaaaaattagctgggcatagtagcgcacatctgtagtcccagctactcgggagaccatggcaggagtcgaggaggtcaaggctgtagtaagctgggattgtactactgcacttcagcctgggtgacacagcgagaccccatcccaagaaacaaaacaaaactaatggttccattatgaaagacacctcattatgttttgagttcacaaatgatcaggtagttcttttttttgagatggcgtgtcgctctgtcgcccaggctagagtgcagtggcgcaatctcggctcactgcaacctctgcctcccgagttcaagtgattctccagccttaccctcccgagtagctggggctacaggtgtgtgccactgcctccagctaatttttgtatttttagtagagacagggtttcaccatgttggccaggctggtctcaaactcctgatctcaggtgatctgcccacctcagccttccaaagtgctgggattagaagcgtgagccactgcacctggcctgatggggtagttccttgagaccttttgcataagagtggacagccaatcccctgccgtgtcatgtgacagattttcagctgttctttaccctaaagctggtcggaggggcagtgcccctggagtcagattgcctgggtttcagccagtttcaggaaacctgtgtgaccttggatgagttagtttattgtacacgcctcactgtcctctcttgaaaaatggggataattatatctacttcacgaggttgttacgaagatacgaaaattaaataagttaacacaggaagagtttagaattggacctagcacatagtaggctctcaaacatattggccaggccgggcacggtggctcacgcctgtaatcccagcacttcggggaggccaaggcgggtggatcacctgaggtcaggagatcgagaccatcctggccaacatggtaaaaccccgtctctactaaaaatacaaaaattagccaggcgcagtggcatgtgcctgtaatcccagctacttgggaggctgaggcaggagaatcacttgaactcaggaggtggaggttgcagtgagccgagatcgtgccattacactccagcctgatcaacaagagtgaaactccgtctcaaaaaaaaacatattgtccatttaataattgtaattggtatcattaagtggccattgttagtagcattttgtgtttattgcggtcatcgtcactgttgctgtccaggcatggccagttgcaggcattgagtgcagagacggttggtttctggcgtggtcacctggccttctcaagcctcatcagcagccgatgacagcctgtctccggcttcagcagtccttttgtttttctcagcaaaaaatatgtatttgccccattccttcagaattcttgatttggacaggctgccttggtcttacatcgcccctattttgtcctggcctaggccaacacttcctaaaataccattccctgaggcgccaggccaccctgggtcctgcaggattcctgcctggcagaaggaaaatcacaggaaagaaggaggggagaaacaacccttacctgatgctttacgcgcctgtgagcgcaaggccctgtacaaatattgtccaagtggagcctcccgactgctatgaaaatgcgccgcttgctgtgttttgtggatggaggacctgcagccccctagctggagcagagagacccctgctaccctgcattctattctgggccctgcatggctccaggtttccagtccttctttttgcttgctggctcaggaaagtctgaccttttcccggactcacctcctggccgtgtttcctgtcctgggcatcgtgagtccccctccctgcatagcgtgcacagcatggttgcttccagccaccagggctgctgctgccttttgttgcaaagggctccttcccatgtgtttccacacaagcatcgcagcctgggtccttaggccctcccagaaccagaaacccaggggaagaacataccaagatacccctgggaagagaggcaggaagggctgtccaggcagagagcagtgagtgcagaggcctgagtgaacccgtgtgttcagtgaggagcaacgtggctagaaggctgtcctggtgggctttctgggcccttccaaggaattgagtcttcatccttcagtgattgggacagggaggggcttataagatttcataaaattgtatgaaaagaatttgtagggggcagtggctcactcctgtaatcccagcactttgggaggccaaggcaggcagatcacttgagctcaggagtttgagaccaacctggtcaacacagcgagaccccaactctacaaaaaaatgtttttaaattggccaagtgtcatggcacacgcctgtagtcccagatacttccctaggatcacttgagcccaggaggttgaggctgcagtaagctgtgatcataccactgcactccagcctgggtgacaaagcaaaaccctgtctcaaaagaaaaaaaaaaagagttcataaaaatttataaatcgctggacgcagtggctcacaccttaatcccagcactttgggaggccgaggcgggcggatcacgaggtcacgagatcgagaccatcctggctaacacgttgaaacctcgtctctaccgaaaatacaaaaaattagccaagcgtggtggcacgcacctgtggtcccagctactcgggaggctgaggcaggagaatggcgtgaacccgggaggcagagcttgccgtgagtcgagatcgcaccactgcactccggcctggcgacagagcgagactccgtctcaaaaaaaaaaaaaaaaaaaaaaaattataaacctttaccaggttttatcatctggccagatgtgtgtttttcaaaagatagctttggaagtggcaaaggattcattgaaaagcagatttttctcttggaaataattcattaatctggtgattttgtctaaatctgtggtggcagctaccgttatcctttgtaacgaacaaaatgtgtattgttaacatctgaaatgtaatttgtcatctttttatagatgggaatttcttagccataggctcacatgacaactgcatctatatatatggcgttagtgacaacgggaggaagtacacgcgagtgggcaagtgctcggtaagcgctgacagtggacctgtcgcttctcatgcactgcgtatagtttaactaccgtggaacagtgttggcagggacttctaaggccaatgaaatgaagacagtgttttaccctcccagggtcattccagcttcattactcacctggactggtctgtaaactcacagttcctcgtgtcaaattccggagactacgaaatcctctactgtgagtaccaccccggggttgtatgaagtctcgatctcagaaagcgttcactctgagatccagggggcctctgtgagaacccacctcctgtatgacttaggcacgtgccatcatctctaggtcatggtttccgcctctgtaacgtaggggagtggggctgcgtggcttcttgggtccttcccggtttcctgctgactgtgagcccctatggaggagaagatccagggcctgccccaaggggaagaaggccaagccctgcagaggggggcttggggcaggcggatgtggcagaagggggcgggtccgggtggatgtggccgaagtgggtgggtccggagctgtccaggcaggaggagggcctgtaaaggtgttatcctcacaggagggaccatgaagtccatccccgctgggtggacggcagccctgggacccctcctcctcccctcccaacctgaccctggccagtctctgggcccaggcagtgcttgggaacagcgaggatgatcgtggcgggcacttacaagcacatcctcatgccacgcactggttccttagacacccaccaggcacctgccacgtgccccactctgggccacgcagggcggcgcgtgggcacaaggaaggcctcgctgctcccctgctggaagttactggaaagcgcagtgctcctcctctgcgtcttctcagatgacctacagcactttctggcttggccgcatgatgcagggaagggctcagagcccaaaacacaggccccaagagcccacgggggtgggcgggtcacactcacttgagcgtccccacttgttgaggaccaggacaggcaggaccactggcggcagggaaagcagggcagtgtgtaccgagactgagctcgctccagtgcggagggcggccgcaccgtctcacctcctccctgtccagctcctgcctgacacaggcacaggaacggtatgattttcagggacaagccctgggtctagagccttctcagatgtggtctcgtactctgctggtgagagctcatttggggaacacacaagtcccctgggaggcccttggtttgactggtttcaataacctccattcctgacactgatctgaagggactgaggggtatagggaggcgagggggcctgaccgcagaggcagagctgtgttcaggggctcgggtgggggtgggcagcaggcggagacccaggaaccagaggctagagaagccagactgtgggaaacagacttggacggagatgggaaaaaaacaaagaagagggcacctccacccaggcccatgggctcgggctcagttccaggggaactcacatctgtgcacacgtggttcctgcccgactgggaagtggaaggtctccctctccaggaagggctctgtacccaacggggcacagctctgggggctcagccttgcttaggggaggggtggggccttggcttagatgttgccagactgtttgctttttgcaggggttccctctgcctgtaagcaagtcgtaagtgtggaaactacaagagacattgaatgggctacctatacctgcactttgggattccatgtttttggtaagtttgctgcagatttcactggttccaacaaaagagtgtctccttttaaaatatttcttcagttgctacggagtctcatggtcaccagtcttgtcagattgctcggctgctacgggaggcccatgagacacacctcctgccgcaccctggggtagggcctgggcttgcctggccgtggcccactgagaagaaccagagagatgggtttttaacccttctccactgtacagggcagcaggtcctaagataattccctggaaccctctcctatcaggttgtgccacatggacctaggtggaccagatggcactcagtcaacttaccatttgtgagggttattatttatatattttttgttcttaaactaaaaatttcactttcttcaacattcactttaggaatattttcataagtgaactaaattaaagggctgcaaattaatagaatttttaaagatagtgtttattgtctctttacgtaagactacaagtcttgtgagaatttgcagttttgtggtgttcagtgctgaggtccggaggttcactccagagctcccagtcgaaaacccaacgtgcatccagccctctcctagccacaggtattgttgaaagggtttccccgacaatggtcagaagagggcgtcccccacccacccattctccaggcccacctgggctcacccgacaatggtcagaagagggtgtcccccacccacccattctccaggcccacctgggctcagggatgcagagcctggagccagtaatgatgggcacagctgccaggctgccccaagcaagcaacagccacagtgagtgaccccaagaaacatgcgcacacccagggttaaaaggcctttggagagacccacccatgtagagttacagcaataacaaggaaactgcaggcttgaggacagggcagcttcccacaagatgcttcagagatcaaggagaggtgtcactttggaactggggttcctggtactgtctgccttggcctcaagatgaggcctcaaaagacctggcagcccggaaagcttgtctttgctccccttgcacagcagagcatcagagggtctccgagactggcctgagtgagaggagactgggcgcacagcgagaggccaggaactgaggctattgtgcttttttgacccttgtttctaaagctggacttcaggcagtttcatgttcaggaccgttcagtgggcgcttcctgcgccatgtggccctgtggcccctggtgtttccagcgccctgtttgtggtctttgttttaggagtgtggccagaaggctcggacggaaccgacatcaatgccgtctgtcgggcccatgagaagaaactcctgtcaacaggcgacgactttggcaaagtgcacctcttctcatacccctgctcgcagttcagggtaaaggacttgtttcttcactaatcttatcccccatggggcatgcacgtacacccgacctgtttggagactaagtggaaatgggctgtgagcgactgctgccagccacaaaggcagatgtgactctgttctttgcgccctgagcacttccagccgcccttagggaaaccccaagccccacaggacccacaaagccgttcagagctgctcatccacctctgcagccccacaggctcacgaccccgccctcccccacggctcccttgctccggccctgctcagccgcgccagccctgagccctgggacgcccttcttcatcctccgtgatcctgaccctggagacccctcaccctcagccccgggcatctggttaggcccacctttggggcgacctcatacctggcacctctgatactgagcatatctctcggctgagggcggtcatttgctcgtgtctgtcccctaccaggccacgaggactgtgggctttgtttctgtgtcccttctgtgtcacacacagagcaggtacccaagtgagagctgccgagcggagggcgagtaaaggaattaaggcatgcagtgagaattcaagcactttcccatcccagatggttcgccttgtagtaaaggaagctttcccccgtatcattccctccaggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacgcccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaatggcttcatttcattttaattgaaattctttaaccagtgcagtattaaccttgcaggtgttcactgttcactcactcacgcgttaacacagcgagcaatgaccctgtgccactgctcagcacctctcaggcaagcaaggccttgaacctccaagattctcccggaacgagaggctcaggaaccgcgcagctcttagcccagcttccctgcagcacgtaagatgaggaaagatgaaaggaaaggaaagattacgatttatttgtagttacaataattaagtttgttagcatgagagaattttccagtgaacaaaaagccctcaggggatttttttttatttaccatttgaaactttgtgaagatgaaattgttgcttttgcagagtaaagtctccgtggcagtcctgtttagataaggtcaagtatcaagggaacgctggatttcctcaagaacagggtaggtgctggcgttcacatgcttcaaagcttgcaaaagagcacagttgacccttgaacaacacaggggttaggggtgctgaccccacatgcagtcaaagatctatgtataactttttactttccaaaaacctaactactgatagcctactgttgactggatgcctcactgagaacaatttccacatattttgtcaatatgtattatatagtacacgcttgcaataaagtaagctagagaagataaaatgttaagaaaattataaaagaggccaggcacagtggcccagcctgtaatcccagcactttgggaggctgaggtgggaggatcacttgagcccaggagttcacgaccagcctgggcaacacagcaggaccccatctctaccaaaaattttaaaaagtagccgagtatagtggtatgtgcctgtaatcccagctactcctggaggctgaggtgggaggattgcttgagcctgggaggtcgaggttgcagtgagcctggagcagaccactgcactccagcctgggtgacaaaatgagaccctgtctcactctggggactctgaaggctgacagcctgctgccgcctgcctccagggcctgggaagttgatttgaagagtgacactaccagggcagggaggccatctgtcattctgcgggtgtttgtttgggggattttgtaggcttgtgacagcctgcagggaaagcagggctatttgatagatacactgaggcttggagaaggaaataacttccccaagacaggcacttgttccaaacttgtcttaatgacatgtgctgggcgctgggaatataaggacgggcaaaaccacaccagtgcctgccctggggcgcctacatggcatcagaagagccagaggttagcagaacgcatgcccagccgcgtgctagatgaccaccatatgagccaggaaggaattgagagcatctaactggaagacccgagtgagtatggggactccggaaagtttccctggcagaaa

SEQ ID NO: 13846 - DNA, 37715 bp, Human
gcaccatttggtagctaagactgcattctaacatgaagcattcagctcttcagtaaccaaacacataatagtgagggtcaaaatagactctcatcttccagttgatctctagcaaacagtcatagcatccgggaatttcagggctgcattataggcccttaccagatgtctgaattcccttctgttacagctcaataaacagttatccagcatctgtttgaatacttttcatgacttgtaacacacaactgtataaagctgctctctgtatatttttagacagctgagttactaaacaggtcttacttgcggagaactggaatctattactctacaatttccacctgaagatttctgattttgctttcttgagcaacacagagtgctttacccatgccttaaggcagctgtcacatgactcttcccctaatacggttgtgaggtgctcacgtgttttggagatagcaaaagtctcaaataatatggcacagacggccagccatggtggctcacacctgtaatcccagcactctgagaggccgaggtgggccgatcacctgaggtcaggagttcaagaccagcctgaccaacatggtgaaaccccatctctactaaaaatacaaaaattagccaggcgtggtggcgtgcgcctgtaatcccagctattcaggaggctgaggtagcaggatcgcttgaacccaggaggtggaggttgcagtgagctgagattgtgtcactgcactctagcctgggcaataagagcgaaactccatctccaaaaaaaaaaaaaaggacaaagggtgagcagagctcagattggttattggagaagacaatacagaggaaggctccttggtggttaagagtagtcttttaaaatcagacagatctgagtccaaatcctagctcaatcatttctcagttgtgaaaattcagtagctctgtgaccttgggcaaattgtttagccaaatgagaaaggtaggaccacctgacagtggtattgtgaggatcctgtcagctaaggctggtaggtgcttgccttggccgtgtagtagctgctcaggaaatgagatctatagagtgtattggtgaaagacaaatttaattttgcacataaagttatgaaaatgtctccttatggcagtggttatcatctaaaagtcataccatcccactgaagaagacctattttagggtttataacagactactctctggacaaccttaatccacttaaaaaactaatatatgcatacagcatttggaatccaaagaactgaattcaagatatggcttggccccttattctgtgatcttgaataactgagccttggttctcttgcttataaaatgtacctatgtaagtgaacaggtggtaatacccaccatgaaatactatggagcagttagaagcaacagagcaattagaatacggatctggaaaacatagttccaagtgaaataaaaaggtgattggcaaaatgagaaatgtaacaatgccatttatgtaaagtcaaaacaaccacaagcagaatataacacccatgcaaataacagacatccagtacagtgtaatgattgtctacaaaaggaggagaatgcaagtgagttgggaggtttaaaggggatcaataaataaagaccacagaagggcctcagtacatttagaaataaataacatgcaaacaatgatgcttccctaccttcctcacgaggttactctgaggagctaatgagattgtgcgtatgaaaacaaaagttaattgactgtcttcattatgatctccatattggacaaatgaactgaacagagataaaaattccccatcacactttggcaggaagctgttgccagggcagcacctgtgaagccctggcctggcttcagagtctgctggtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcaggtaggacagcatcgatcttgctttgtaaataagcagaggctttgtgaacagcttcttgggaacccaaggaacctgtgttttcttccacatgtggaagaggtgatcttcccactgggagaacagcagatttgaaatcaaagaacaactagttaaggaaaacgagataagtggggactgaatacaattatattgaaactagttgacaccaaaagatgagataaattttttgttttttgcttttcactcctatgagatgtgttatttagggatgataagcagaacactaattggaaaatttaatgctgaaccactcaattctattcttgaccaatttgaacaaagtatcactgggttcaacaaaaaagttttggctactttgatgcagaaagatgatttggttgcttggttcttacctatacatctgggcgtgctaaggcagctagcatctgtggtgggcgaggatgactagccagcttaccacaggcacccagatgtggccttgaccacatttttccaaagagtggtcctagtggggttcttagaaagagagatgctaggtaaagatgtattcactgttaagacagctctgtccagggatgacagacatcacactgagtgagatgtaatcagagcccaggcaaggaggcgatagaagcatttggaccacctagattggttcactcactaatccactcaccttgaacagcaattattcttgttgtttttctaacttctgtgtaagctcttcactgatctcaaatagatgaagagaaaacaagcaaaatccagaaacaaatggtattagaaccttgacataagtgatggttctggattaaactgttaaggggcttgcaatgaaggagtaatgatttatgcagttgaccgctttgactgtgcaagaaataaattgaccacaaattttcaggcaaaactataaaaattttatgtgaaaggacattttgattgtataaatagtctttgatatttgaaaataaaactgacaagcatgtcatgcagaagaaatgtcagcttccaagtgttgaggagacatatttcaaaagtcagttttcagatatgttaatgttcgcaacaccctgattcatatgacattgacttttcattcattttttgctaaaatgccccattcagaaattcctgaatttcctatggcccttcttccacctgatttctctttgcaaggtctccttttctctcttgctgcctctttgtaacctcctacagccactctgaatctcattttctaacatcctttccaagaaaatcctagatttcatctaactgttaagcctgcctgatattacagacttacatagaaggctagagttggagaagacaggaagattatataggtaaagaagccaaaaaaatagatttttttttttttttttttgagacagagtcttgctctgttgcccgggttggagtgcagtggcacaatctcggctcactgcaacctccgcctcccaggtgcaagtgattctcctgcctcagcctcccaagtagctgggactacggacacgcgccaccacaatcagctaatttttgtgtttttagtagagacggggtttcactatgttgaccaggatggtctctatctcctgactttgtaatccgcctgccttggcctcccaaagtgctgggattacaggcatgagccaccacgtctggccaaaaatagattttttggaaaagaaattaaaagccttagcaaatatggaactgcttttcatggtaaagaaatttgacaagggttaggcaggaaggaaagaaccagaagcaccacttactggaaagctctccattgaaacgtccaagcttccagcaaggacccgctgatttattatagacacagcaatgaatacatacaaggcggctgaggcaggcactcagggagatgatgggaggtaagtttcttctgttggcaggacagctgaagaggcagctacatgccccagatgcctgctgccagggaccaagcccagctgctcaggcggcggaggaagctcactggtgcatggtgagcaaactgccgctgtgcatgtgatgatggcaaagttcccaggctggtagctcagaagacacattaaatacaaatgtgctctatggcgcaaaaataaaccacaggaagtagaagtcctaggtctcaaacggaatttctgtgcatagatatatagactttaattggatagagaaataaaaattattgtaggggacaaatctctagatacgaaatttagaaacctcaaatcctggctctgagcctccccagccatggggtatgggacaaggtcccctctctcccgactgattttaatatcctgataaatggcctatctgatgtgatcaccaaatgagataatgcatgtcaatgtgctttgataaattaaaacagttagacaaatgtaaagtgtaattattttcttgtgaattgctggatccattgacctttacagcaaaaccctaaggaatgggctctccctccacaatatgaacaaggtcaaatgatatcaacaaatagaacaaagacaggaaagaaacccgtcaacatgttataactggttttttgggagtgggggttggtagggagagattatggctgtttttattttctgggttttccagtttttttttttttttttttttttttttttttgagacggagtctcgctctgtcccaggctggagtgcagtggcacgatctcggctcactgcaacctccacctcccaggttcaagcgatactcctgcctaagcctcctgaacagctgggactacaggcacgcgtcagcacgcccagataatcttttttatttttaatagagttggggtttcacgatgttggccaggatggtctcgatctcttgacctcgtgatccgcccgccttggcctcccaaaatgctgggattacaagcgtgagcaccgtgcctggcctccaatatattttttacaataagcatatatatatgtatgtgtgtgtgtgtgtgtatatatatatatatatatatatatataagcatatatatgtgtgtgtgtgtgcatatatatatatatatatattttttttttttgaggcagggtcttgttctgtcacgcaggctggagtgcagtggtgccatctcggctcactgcaacctccgtctcccagactcaacggatcctctcacctcagcctcccaagtagctgggactacagatgcgggccatgcccggctaatttttgtagagatggggttccgccatgttgcccaggctggttttggactcctagctcctgccttcacctcccaaaggattacaggtgtgagccaccgtgcccaggctacaataagcatgtactttaaaaataaaaataacaaagaaagctgttttttcagctgataggcaacagttttcattgttcctaacacattctttggctgtcagaaggattaaattagagaagaaacctgattcctgctttacttgggcctgaacacacaaattagaaatggtgtacctcaaagtgttgcactgtctggagctatttcattctgcaacatgcatgcaacataattgggtggagctttgctaacatttatgctatattgcaaaatacgtgccattcaatgtgccataggaagctggtcttaaaacgtagataagggaaagtattaaaacccttgaggcatttttgcatatttatgaaaagaatactgaattttattccatggctaacttcctaaattttagagcaatttgccacccgggtcaagctggagaaggatcagaacctactgcttgtcactttcttatttcatcctgagttccaatacgtggagctattttaaaatttcattctgttatcaaccctcctccataaacacattagtgtcactcgagtccatgtgaagagaccaccaaacaggcattgtgtgagcaacaaggctgtttatttcacctgggtgcaagcgagctgagtctgaaaagagagtcagcaaagggtggtgggattatcattagttcttacaggttttgggataggcggtggagttaggagcaatgttttgtgggcagggggcggatctcaacaaagtacattcttaaaggtggggagaattacaaagaaccttcttaagggtgggggagattacaaaatacattcgttagggtgaggcagaaacaaatcacaatggtggaatgtcatcagttaaggctattttcacttcttttgtgtatcttcagttgcttcaggccatctggatgtatacgtgcaggtcacaggggatatgatggcctggcctgggctcagaggcctgacaattagttaagcttactctctgtgtcttgacccaaatcattgatgctgaggaagaaaatgcacgaccaggaaggttggctctccacctttgcatctacctagccgtttaacacttgccaagttccattgttcaagcagcttgacacccaccagaggatactgtcatccttcctagacttccatagtttatctacaaggatgccactggaaggcattgtcttcagtgaaagcaagatgcagcatcatgtcatcaccaataaagggctttgttagtacctactctgtgcagtatttgtcaggttgtggagacacaaaatagtggaagacatgagtcctgcaaacaaggagtttacagtcagacaggaaagtcaggaattgtacctttgtcatcacctggaattaaaaaagtagcatagcatatattccaagtttgaacaagttttctttaaaaaaaaaaaaaagttagcatttgcctgctcattttttacttttagtcttctagtattattttggtctagttttatctaaactggctgcttgccctttccattcagtcattatataatgtttgacatgtggattctgtctcactcattatcccaaaaccatcgcctccaaaagtccctggcaatctcatggtagtaaaatgcattatttttttccacctgaatgttggtaaagactctctccttgactaaactgtagcatggcttctagcagttaaggccatgtccctaggatggccccctttaaaatgcctgcctgagaaagttcatcactgccaggagaatgtcctgtttattctagccaaaggcaggcaacagggagctggcccgtgaaccctctcttaaagcagttactttagaaagttgcaatgataaatcctttctctgtccctttgagatgtaaatcttctaaccatccagaactgtcttccaaggatctgaaaaaagcaacccttcaaagaggtaactccgactttcagattctgtgggagggagggcctaacttcagaggaccttcctctaatttacaccacaaaagtttgcttctcctccaggaaagctccaattaacaaacccagatggcctagtcacagggaccaacccccctactacccctcaggggcacacccttcccctagcagcacatcccagttttttaaaagtctcatgccttttgttcccataaacactggggcctctttcctattgccatcattatgactgaatataaccatccttcccactttaactagtgtccagctttgttaatctttggcaatgttctattctacacttcaaatttatggtgtctgaaatcaaaatattcaaagtcattgtttgcaaaataaacagaacatcagtcgaaggaggtcagtttcctgctctagaaaataaaagttgaactggccactctccaggccaggcccagaatccaaacacagattccctggttttctttacagtttttcttgctctttccctaccaccttgagtgccttctccctttacctctctgcttcccagaccttagactcctgaaagcccccagagagaagctttcctccctagaatgctggtgggagtcactgcctagggtgggctcccagcttttccttttgatgagcaaaggctcttaatctcatccaattacccctctctgactccacaagccacgtgtagacctcagctacagacttagacaattttctttcacataggaggcctcaagaaatatttgctcagagaatgatttatctggtgaatataaaaccagcccaaggaacttgtgtttaccaagagtaatttttgtaatgaattttttttctgcaatgcatgagtattaattttgtaatcagcaacataataaatattttatttttataaattcaagagcatgagcatgagatataagcttttttcttgctctgatccaaattactttgtatttcaaaatttgcggctttaaattaacaaaaaatttcttaatcccatttaaggtgggccaaaaaaaatcgaggcaagatcgtctcagtcataagtacagcagggctggagacagaaacctgtccttagtggtgctaggtgctagtaagagtttgcaataaaaccaaacaaaactgcatgatctttctgttccaaggatactgaaacagatcagttgctaagtgaaattggtagaagggtttttaaactgtaaacaggtcagtttaactgtaaatgactatttaagtcactgtttacaaaataagtcctatatcagatgggaagaatcaggaatgacctctccctgggaagaagacagcaggtgaccatccatgaggatccagaaagtcagacagagggtgggaaggagtctatacccaggcaaataaaaatagctgccactttcctcctggagggtttttctaattatacttcatgagaggcaggatcaactaggaaaagaaagacaggaagaacagggaaattattgcctgagggaaaaaatgcagaactgaagtctgtgagttaattccataacccagggcttttcagacatctgagtgccacagtcacgattcttgtaatatcttttaccacatcttttattataatatatacgtaatctgtttattttgtttgtttatttgtttggggggagacagggccttgctctatcacccaggctggagtgcagtggcacgatctcagctcactacaatctccacctcctgggttcaagcgattctcgtgcctcagcctcccgagtggctgggattacaggcacgtgccaccacacccagctaatttttgtatttttagtagagacggggtttcaccatgttagccaggctgatcttgaactcttgacctcaagtgattcgcccacctgggcctcccagagtgctgggattataggcataagccaccacacctggccagtgtgtttcttttaattgtccctaaactgactcatttaaaataaaattagccttgttctaaggaataatatccataaaacctatgatctgagatgcataatttaaaatacagatataaataaacacataagccttttaaatgttcaattgtgtacctcctaaaattatgtcacgtacctgcagagaaacgagtaccatgttggaaaacacagctgtcattgaggccaaaggctcgagtgggagtcaaatctaggctggggcagttcaatagaaaagatctttctctacagtggtgtttctcaaagtggagttcttgggctgtggggtggttttaaaacataggtcctcctgtggagagggaggggcaatttccccgtcctttgcatctgagagtgctggtgactgattcaaccagtaaggtacagtggaaatgagactgtgtgactttccctgggacacaatctctgggaccccagagcctcatgtaagacattggcgcctcctcttagaccacataaagttgcttgggtccccagtccctagttgcactgagcccagctttccagccatcctcaccaaggtggcagaatgtagaaccacggggaacatcagcacctcagcagaagaatacagggcagagagatcacccagccaagcctgcctgaagtgctgacccacgaaattgtgagatataataaaatagttgcctttttaagtcattacattttgggatcactggttatgcaacagtagataacgaaaacagactgactatatcagaatcaccaatggagcttgtcaaaatgcatattcctgggcctcaggtgcaattctccaggaattctgaagtctcataatgggacccagtaatctgaattttaacctagcttcctggatgtctctggtagacactagagtttgagagacattcctttagagctattcattcattcattcatctatccagtctaccgtcatctttttaccattactataaatctggccatgtgctgggctccaggcataacccagagaccatgccactgtccctgctctcagggacaccaaggaccaagctgggcacctgacagtcaagcactagttgaaggaggagaccctgaatcttcttccctgtaggagactgaggtaccaatgccagttctctcagaattgctataatttgttcaagacctcccaaacttagtccaaagcactaacaatcggtcatggccaagaaattaggagaagattgaattcactgatattttggaaatagccatctcagcagaaccttgggatctctgaggttgaggttggctgccggagggtttctgtcaccttttattataagaaggaagccaaggtctctgtgggcaaggcagaaacaacttcagcctcaatcacagattcatttgcccttgaaaatgacattcatgtatattttcccccaagtagaaaagtgaccatagatagttcattacagaaaatgagaaaataaagaaaaacatttcaaacacacaaacaaagctcccctcaggcatctaaccacagtctagcagaacgttaagaggttgcttgagtcaggcacacctgggtttgaacctcggcttcatgtaagctcccccaggcttggttttctcctctgtgattacattgcctactgtgctaggctgttgtgaggattaagtaagaatatgtgcacatgtgtgtatgtcattatcattatctttgctaatagtcacaagtatttctttctagtctgattccctttatatgccagtatttattgttggttacttaatagtgccttgagccccatcccatctgtactccccagcattctaatgtccccatcagaggcagggctgtgtccagaggaatcctaggtggagagatggtggcgatggagcagcagggtaggagtggatggtgacaggccagaatttggacgatgagtccagggctcccccttgacacgtccatctccctcagaggtttagggaaaacccagagcccagagagcctgacagcctccctgtggctgctccgtcttgatgtgtggctatggcaactgttctttcaagttttctggggcagttctacatgtcctgtagtctagtttagtccatataatattgtacataaaatagcaaaacacaaattctatgtggcagcagcaaggcaatacgtttactgctgttatataggaggtgctattccatctgtatttctgcccttgggaggaaatcgattttcttattattatgatacccatccagatgttactccctctgcaacaagaggaagtgagcagctccctccttttccaaagaacacaaagtcatggatggccaagcacatagactttgatgagaacagccataggatcaaatccctgctccacctactaattattcgctgggtgaaatttttaacatttccaaggctatctcttccctttttttttttttttttttttttttttgagatggagtttcgctctgtcgcccaggctggagtgtagtggcacaatctcaactcactgcaacctccgcctcccaggttcaagtgattcttctgcctcagcctcccgagtagctgggactacaggcgcgttccaccacgcccagctaattttttgtatttttagtagagacagggtttcaccgtgttagccaggatggtcttgatctcctgacctcatgatctgcccccctcagcctcccaaagtgctgggattacaggcatgagccaccgcgcccagcctctcttcccatttttagatggggatgatcatatctatctcatggcattattgataattaaatgaagtgatgtataaagtgtgcctaccagagtgtctagcatatagtaatattctaatattgttaacatttccagtattggagtgttcagagcagagagaaaaccactgtaccagcaaatagacaaacagctgccacaagatagtgataagaaagtatcagcagagcacactagaggccatgggtctccttagtaatactgctcggtaagggctcggagctgaaagtgaacaacacacagagactgtgaattgcctgtgaggggctgatggcaaccccgacacgaggaagcacatcacagcccagatctagctggccacatgcagaggatcagccgaactcaggcaacacaagacgatgggaaatacagtctgggccacaacagagattctctcaacaaaatttcttaaattatttgtggcaaaggaccagttttcaaaaaatgtgttgaagaccaatgcttcttttttttttttttaagccacaataaaactattttggtgatgtcaaattacaattaaagtttctaaatgctgacttacaatttctgaacttaccttgttgggaactagtggcaaccaatactgagctctgagtagcattggcttaagaggttttgtttgactttttggtttttgtgtgtgcttaagattattattgctcttttgttttgtttgctagttgcttattgaacaggaagtgggagtttaaatcagagccttccttcatatgacgtacagcctgtcatccacaaatttgtttgtattaattaagaaatgcatatggttctcacccaacaatgtgagcgcagacattctcacactgtctcagagaatcccaggagaagaggcagtagggggagtggtaagagtgtaggtggttaggggtcccagggttcctctttaacatacccttctccctctcagggttaggtaaaactctatttattgtaataatattataataaataataatgtatcataagtataataatataataataatttttccctccaaaaggcagaaatatagatggaaaatatagatggaataacacttcctattaatccttgatccaaagaatccttcaggaattttattataaataaattttgaaataatatggatctacaatagggaagtggttatccatcttcctttaattcttgtagaatgttgctttgccatgacttatttctgtttaggcacatcctgccatccagatggtctcagctctgaccccagcccacacctctctctgagcaccaacctcagatcccaactgtcaaccagatattttaatttggatctcctgctgtccttcaaatgcggcatgcctgaaataaacttcagttccaccgctccaccccttcccccaaagagacgcaacttcctaaatctgatttctaccaaaagtgccattactttactgtgattaatatgctggagtaatatttgactccctccctgaattcatctttcataggtgagctgatgcagatgtctaccatatttctcctctgcttttctgtgccagactgggttaaaatcatctcacacttacacaatcatttcatcttcctaagtagttccgcaaccctccctaccccattacgctcccctccaaatcactgtatgtaccagactcgtcttttaaaataacactgtagtgctatcaatgttctgctcacaaaagccttcactggctccacaaccccagaaaataagatcaaacctcctcaacaggcttctaagaccttctagaatgtagttgtccctacgaattcagccacatctacaattacttcccaatataaactctccactccaacccaggccattctcctccctgtccttctggcccctgacccttttcttccaggagaaccctaagttctgccttttaggtgtgtcattcaggactagacacagtcccagctctgccaccaaccagctgcctctcccagcttacaccatgtttttttccttctctgaacatggcagatcttcatgcctcatgtcttgtcataattcacatcataagccatctgtttcatgtaacatactagtgtctagtaacttcctttttcttctttggtacccaacctcctcctactaccatcaccgccaccactatcacaaggaatctagggttgtgcatataatagcaaatttaaaaatacctcatgaatcagattctatcaaaaaaagaagatggagaaagaggaaatcaaggaaacaaaataggaggagaaagagaaaatattgctatgttttctcttcgatgcttgggtatgctgtgtgctcatgctattgctcagatttatagactatttgaactgaaaggatcttaaaaatcactgggtccaataatataatgctgaatgtgaagacttattaaaaactagaaataacatatctggcccagaaaaaacaataaaagaaagatgagtatcatttaccagctgtgtgacttttagaatgtcacttgacctctctgttcctcagtttcctcatttttgaagtgtgaatgatgtaacacttattgaggagctaaatgagatgatgtaggtaaagcacatggccaatgccttaaacatggtaagtgcttagtacctgttaagaaaaagatccctgtccatgcttcgaaaacatgtaaatcaaaatttcttgaaggctggttataaataattaatttattgttaataataaactgtgagatcatttaatggggtgtttctatggtctgaatatttgtgtcaccccaaaattcataaattgaaacctaatccccaaagcgatgatattagaaggtggggcctttgggaggtgagtaggttatgagggctccacctagtgaatgagaaattaatgtccttaaaaaagaggcccgagagagctgccttccccttctgctatgtgaggacacacagtgggtgccatctatgaagaatgggccttcactggacaccatatctgccgaccccttgatcatgggctttccagcctccagaactgtgagcaataagtttctgttgtttataaattactcagtctaaggtattttgttatagcagcctaaatggattaagacagttgcttaatccatgtaagcatagctacatctgtacctatttctatgtctactttggatcataatataaaacgtatttctaactgtgggtcactgtcaaacaagtttgaaggccattggattattaaagtcctccactagtaaaaatggagcagcatgccaaaacctcatgtggaatgctaggtgctactttaagagcagttttaccttccatcttttctggaccttggttttccatcaacgcctcagtcctgctaatgttgtctttattgttcgtgcatctgacatgtaacccggaccactgttgccatactaattaatgtagagagaattcccttgcatggaggcctaaattctccacacctatggttaggtctagcatgtgtctttctccatcagatggaatgctcagaaaccttgaggaaagaggagagcttctgattttgaaagatgtttcagctggtaactctgtcttgcattttgcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtaagtgtcatgggtgtgattttcactgttctttgcttgatggttaagaacataggcttaggatcaacggagctggggtaaaccctaaattctctgcttactacctgtgtgaccttgggcaagtcacttagctttactgagcttcagtctcttcctttataatatgacataacgataatgccagcctcacaaaatggtcatgaagattagaacaacacacatgtaaagcgctgaacacaatgtgttgactatagcaggcatctaacgagtggtcgctattttcccgaacacatttatacacaaatctttcaaaatatttaagccttgatattctagcagccagaaaagcaggagattcctttttttctctcactgtgatcattcagaaaacaaaacaaaacaaaacaaacaaaacaaaaagttaagctctcaattccaaatatttgagcaattgtgctaaaatctttgggaagagggcttggaccataactacagaagttcatagaaaacgaagatgatatttaattgataggtcttttcatttttttttctgatttcaaaaataatacgtgttgataatagcaagttcaaatattagagatgtatataacataaattttgagtctcctataattttatcctccaactacagacaactacttccaaattttttccgtacatatctgttattactattaatttttattgaaaatggatgcttatgcatttgtttaggtgagaagagactattcagatagcaccaacccaggccccccgaagactccaccaattgctgtacaaaagatctcccagtatgcgtgtcagagaagaaccactttaaacaactgtaaccagatattcacggtaacgggactttacatcaacacccagggcaaacgaagggcttgcagcttctttctgtggaccgcaaattaaattataaatttttctgaaaacctgggaaagttttcctcccacctacctgcagccctagcctgatctctgatccttctatccttcttctttctatcgagactgggtctccttccttcctggaaatagacaaatacatttaggttatattctttagagacagcggattactatttacagatagttgtcattaatgggcgcaacacttgtcaaaagcaaatattctgaaaaaacaaatactggaattagtccaaaacatagtaagagcaaattacatagaaatggtaacaatacatcaacagcttttgctgggaaaccaaaaaattgagcaaacctagattccagcctttctgatattcactagtttgggcaagtcaatttctctctctgagcctgtctcctcatctattcaaaaagaaattggatggatcatatctaaagctccactcagccctcagattggtaattgtgttttgaatggccctaaaacccacaactgcttgtctgctagcctagagtcagtggttagctggatgaaacatgtagtagtagatcaatacagagcttctcatttctagacttccagctccatgtctgtgttggaaagactaggaaattgtagctactggatatgctgagcatgagatcacacagctacagctgcttcctcccctgctagaaatacaaacgtgccctaccttaaataatcctggctctgggtctgtgtgacctacgactacactcattcattcaacaagcctgtgttaagtgctgtgtttcatggggctgctcagtgatcaaggcagaattctagccacaggctagtgggaagatagtacagaaggagggattatgctgagtcatgactagcaagatgctgtgagcaccaaagcattttttagttaaatcatctgtgaatgtttaatagcagtgtactccaagtttccgcataatgcactctggtacctgtcttttcaattcaactctactccatgacaccagagaggcatacaagggtatgggagaccccatcctgacctagaaggaaacacgcaagtggtattccaatatttaaaggagagcaagaggcgtttgtgagtgaccactggctcaggggcttggaagcaaatctcctgcttatctggttttatcctgcaggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggtaagggtgaaatgggatttgtcccacttcccaataggtaggtgggaacgggggagagagggatgtagctaacagattttcctgtcaactatgtagatgtggtgtacatcacaaattttcctttatacatattcctctctctctcctctgtctctctctctctctctctctgtttatttttatacacatacacacacacatacacatatatatatgttaggggttgtgaatatcctagtcacatggcaccaaaatacgttagtggtggcaggtgtcagagttaccgatagtgaatccgttcgggtctgcagcaaccccaattattgcttccgcagaagaaagaattcgactggggggcataaggcagaaaaagagactgaggcaagtttcagagcaggagtggaagtttattaaaaagctttagagcaggaaagaaaggaaagtacacttggaagagacccaagtgggcaacttggaggacaagtgcagcgtttgaccttttgacttggggtatatgttggcatacttctggggtcctgcgtcacttttcccatgattcttcccttagggtgagccacccgcatgcacagtgccctccttgtgcttgggaggggagcatgtgcagtgtgtctactggagttgtatgcatgctcacctgaggcattcttcccttttccggtggaatgctccggaaagtcatactctgccattttgtctcttaatgtgcatgctcatgcccactcgcccaattcctgagattttaatggaagctgctgattaccaatttcaagtgtttttatctattgggaaattgcctctccctggcgccagttgtgactaatcattttatagggtgacaactgccagaccatcacggaattgcctctctctagcactggctgcaaccaattatcattttagagagacagtgtgataactcctggaccatcacctgatggtcgcctgacattcctggtttggaggggggagccctctcctgccctgctcatgcctgactagctacctactctaacatataaatagatacagacgtgttatttataatccataccctaatattatcacagctggagctacatggaaccagctagtagaagcagaactctcccatactgttattaatcacagtgaaagactcaagtggcctaaatcttgacagcagggaaatggtctgatttccctcagttccacctgggggcgccaccttagagcagtggtgcgtttgacatgaagtggaggtggttctacacctctccagggagagcgccagaggttgtgcttatttactgaacggtgtttagggattccccagcaaagcaagttggtcatctggtagtaagtttctgtatagtcaagtgcaaggtatattattcaaggacaattatcccaactctactcagaggaagggggctctgagctagacatcacaagggcttgaatgtagattggctttttggtgggtccaaaattaaccttgtcaatggaaaagtcttcttatttcagtaaggtcatattcattgaagagaaaattatcaccaatatttggacatacatttttcagtgaatattttggtttgggattctgtagatctggatcctaaccatttgtatctttgttcctaaggatcgtaaaggggtccttggatatatgatgagctagcattttcaagattgtagggaaatgtcttgttttctccagatcaattagggaaatacccctgcatgtgatgcatgcacatttcatgagaaaccaaactactaggtccatgaatttgagagtcttagacagtaattgtccaacatcactaatttaaaatatttttcaactgtccattaggagattattgaagatggagaaagttctgaagttaaagctgtgttaaatgatgaacgatatcaatccttcaaagtaagtgattttacatatatttattgaaaatggtttttcagttaatcttattacttattctggctggttgtattagtcagcttgggctgcaataacaaaatacagagatggcgtggcttaaacaacagaaatttattttctcaccattctggatcaagatgtcagcagggtcagtttctggtgagggttctctttctggcttcttcctgtgtcctcacatgctcccctgctcacatggtgagagagagacagagagaacaagcaatctttctggtgtcacaaagacactaatcctgggccgggcaccatagctcatgcctgtaatccaagcactttgggaggccaaggcgggtgcacttgaagccaggaattcgaccagcttggccaacatggtgaaaccccatcattttacaaaaatacaaaaattaggtgtggtgaggcatgcctgtaattccagctacttgggagattgagacatgagaatcacttgagtctgggaggcagaggttgcagtgagctgagatcacgccactgtactccagcctgggtgatagagtgagactgtctcaaaaacaagacaaacaaaaagacactaatcccatcatgagagccccactctcatgacctcaaaggccctgtcttaaatacggtcatactggggattaggacttcaacatacaaatgggttgggagggggaattccgtccatagctttggtctaggaagaaaatgcctaaataaattcaggtgcccagattattgccatgctgtcgtgatgtacaaattgccttaccctccaagagtctgtcactcatgggtacaaacatcatgggacatgaggaccatgggggggttggtggggacaggacggaactgctcttaaagagcagatttgtgtctgaaaatctccttactgcatcttcatttacttggaagcagggtttattacctcccaattttccctaccttagagttgcaagtggaagggacttccaccagttccttcaaagcaaaagtgatgtacaggcctaaaatatggccatgagcaggagcacaggcttggagtgtaaacagaccagggtttaagtttgggctgtgccacttcccacctgtatgatggtggagaaactatataacctacatgagcatctcttttcaaaatgtgagggtacctatgcagagcatgagtgtcggtgagagacccagcaaaagggagagccctatagagctagcgtatcactcatggacagcacaggcaggccgtcaattagactataccttagccctgcacaggtgccagaacctgcttgttacttctgtttcattttgtaatgccacatgtcaagaaaggactcacctgaaataaaaaatgcccttaaaaataaccatcacccacctgctcgttatattcaggagaaactaggtcaaagatttgcttatactttttcttcattgcctgagacctagaaagggtcatgactcggatgttataatgattatcttagagactgatggcatgcctttccctccattttagctctttacttctgtatttggagtggggctgaagacttctgagaagtggttcaggatgggtttcagaactctgagtaaagtaaggtcggacaaaagcctgaaatttacacgaatgcagaaagcaggtaaattgtctctcctaaaagtcattgttgctatgggctggtcgggtcgtggtggagctctaagtcagttacactgcaactccaatctgggagagctgggacacttctttgatgtccattgatgcttggatctaaatcctagctccagcagtttccagctgtgtgatcttgagcaagttggttaaaacctttgaaccttagttacctaatctatgaaagagagataacattgatacttagctgagaagtcaatcagttaatgcaggcaatgcctcagcactgtgtctgacacagagcaaaggcgccctccactgtggctgtttgtggtccttcacccaaatgtcaagccaggttgtgctgctgatctggtccttactgactcttccggacattgggtcctggctgtctccctgggtaagagttgtgggtgaagagtcaaagacagaagggttggctgctaagaatacttgaacagagttgttgcctggcacaaatgtgaagatgccctagaaactgtaaaacaccaggaaaatagaagggaactggtggaaatctaggcacagggttggtatacccaaccaggactctttagcctaagacaagaccgtggtgggacatgagtgctgtcatcacccacctgaaagcctggcagggcctctcagaggttgaaggtagcctggtcacttccatttatgaggctcccagtaagttttttaaaaatgaaggaatggcaatacagtgtgaaaaaaactgtgtgtttaaaaaaatgtttacttttaacaagcaataaaaatacaatacagttgtgattcaaaaaggagtcacagccatagtccctactcattttttgtaaagttgctaatctttgaaagattgctaataatacaatgccacataggaaataaaagagtctaagaaaaaaagatccagtatttatattccaggaccctgaaagcacacgtttaataaggatgatttacaccagttctcaagatgccattcaaaagaaatttaaataagtattaaacataagtagcaagtaaatggtttggaatgatgagtaaagactctcaatgcttagagagaaattgggaggcaatatagtgtttcatttggatgaaacccttatcaaatgacgtccagtgctctcaggatctaagggcttccaattccctagctttgtaaactggatttttgttcttcctgttgagcttttccaaccctttgaatgaaacagctttattcatttagtcaatcagtgatttccatctaactgtttaatgctaccagttctatgcagaaatcaaggaatgccctcccattatacttatacccccacaagtagttataggcaccccttggagcagcactacaatgaatggaattgccaatgggaatagcttagaatactgtgaagggtaagctaattgaacatattgaaaggacagttcatggtcagatggataacctgatccagttttactcatatttgcacttgattgcagttccctgaggcttgagcgtgcacatgccacgtttgccttgaaaagtcagtttatgaactatagcagcacatatttaaccttatactgtgtgataagtttcctgtaataagttagtcgccttgccataccaaaaaggaaagccaattaaattactttcatggatgtcaacaaatcatcatagtcttacatgttcattcctgatagctgcacatcttcttaaagaaatagttgtgaatcctgacttttggatcgtgtatatcactgcataagcacaggtgtttgtggttacccagtgagttgtactttgaatattagtcatgatgacagtttctgtattacagcctaatagagcattgcttcttagatcaaactcctcatgctcacaaaaatggccatgttgcaataatttttagaaatgtggctttttaataaaaataaaaaataagtatcatattgaaataaagaaagtagtgttccacaagtggcgtggtttggtattggacacagtttataggtgtattcatatgaataccattttctcttggtcttgccagcatgtttccgtgactgtccccattagagataacatgggaaatttggcagggtgtgcaagccaaatggccaccctgctgcctcccttccacaatcccagggtgagaaacaaggaccaatagatttactcttgtcatttcagagggccagtggcaggtgaaatcgcaaagaagtagacttaggcttttcaaaagaaagaactggcacaacagagtttacaattaggaaacaggctcctctggaggtatcagagttccccattattagagtcaagcaaagtttgaatggccccctcttggagaccctagataggagagcagcgatgctgaagcatgatttgatgtccctcaggctctatggatctaatcaccaggctcatctcctcaccaatacttcaccccaatccttggagataagcctcccttctcctttcctctttctttccaaatctccctccacactgctctgtgggaaccaccaagttagcttttcatcataacaactctgaactttcattaattcatgctggtcaggcaaagaagcaacaagctaaaccacctaagatatttcctgccttgcttcagacacacatctactctgctcctattcttgactttaattttttaatggatccatcaccttccaactctaaatctcctcatcccaaatctttatgcgttaccttttaaaaaacagtaggacacagcctattgatcaagaaggctggttcttcagtaggaagtcagatctgaacagtttggattccagagggatgtgaaatattgtctccttctcaggaaattgtaagcctctaggttagaaagcaaagaaccactgttaccctgaaaaattcacaaccaggagaaccacatggactattctgtctctgtgggaatggagtttggtgttgatgcctgtagtcatgttagctctatcgtggggacagaatccccttctactgagggctggttgtttcacacacgtgtcactctctccattgacctgtcaaatggcctctcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggtaaataacttgggtggctttgcctcctctgcccgaatacttcagtggctccctgacttggacaggcatctgaaacggcacaaaaggctgtgatctggtgccagcttctttctacagctttatctcctgcctctcacatttcatttcagcaaccccaaatggcttgtcatcccctgcacattcagagctgtttcttgcctgttgctttgcttactcagacttttctgctttgactgccattcctcaaattgtcgcttggctgacttcccctcattctttaacactcaatttagatggcaccttctccagaaagccttccttgactccctctttctccatgctggattagtgcccctcttccatgctccctgagtacctgcaaagcccttgatccacatagttacagtgatttgttcctgtgtgtggtttctccactaagtttgtagagcttagttctcagcaagactagttcatgatgcctagcacaaagtaggtgctcaagaaatcttggttgagtcaataaatgactgactgaatgaattcatgaatgagtgaacgcttcacaaggatgtatgttgttgttggatattgaggcctgcatttcagaaagggatttctttcctcccacagcctcctctacctctttctccagccctctcacctggtggcttttggccatcctaacaaaataggtttggggcaaggaagaaagtaagagaagatcaaatctaagataatgcctttactccatgtcataattccaagagcgctaccttgtattatgtgaatacaattcttagtttgcttgttgtcatgcttgtctccatgtgtgtatgtgtgggtgcatgtaggtttgtgtgagtgtgtagaataaataatttttttgttattttttgccttgatatacataatcagatacatgctatgtatgactttttctgtgtcataaatttattttgtaaggaacagcgatgtgtaaccaaggatattttgtttcttaaaaaaaagtcaagaaccttctatgttgcaaatcttaagcatagggcatagaaacaaaggtgattttttaaaaatgaagactaatatctaattgatttccattttatactgcttttgaaaattaggggtaagaagatggggcatgatgtagattttttaattaccagcccaggatcaacagaggatgaagagcaacttttacagaaagtgatgaacttatgggaaaagaaggtgagaagaaagatgaaaaatacatgcacacgcaaacattatgttaacacttgaattttgcacattacttgccttataattgtgtaatgaccatctaatcaattctcaattatttgtggcagcttatacaaagccatatgacctacaataagactttcctgttttgggtcctagagtacatgttatgaatatgtcctgtatcttgtttattatacttaccctattgccaacagggccaagggtggctatgcatttgtgtttgacatgcagaggcattaaagcacccaatcaaagtgaaaagtatgcactatgaagacctgggaaatgtaagctggaaagctgcaagcttgggtgagggggcaggactgcaaagactgggataaaatcagtctaagaggtgttgatagtgcctcgatagattcgaggcacttcgtgctgagatggaatgaaggaaactaatgagggcaagctgagccctgcagaggtcatggctcagaagcccccatacattgcagagatcagacttgtgacaggcctattgcctggtggaggaaaccaaagtaagctaagctaaccctgcagccagagccacatgcaagccctgactcctgtccaactctagtgagagcctcacttcctagagagaccagagggtcctacccttgggacctgtagataggtctggctgggctggtgtttctcctcacagcttcctccttcctgagtagtttgcatctgtttggtgtggaccaagcttactgatatcccagaaaaggaaaacctcagataaagtgaaaataaaagctagaaacacaaccctagggccaggggcactggaagtgaagactcaactttagaaccagatccaaactgacacgagtttgaatactgggcgtcgagtcttcccagaaggagttggagggaattagaagcgaagggcagggaagggatcctggctagagagcctcacactcagccttgcaaccctcctcagaaggcacctgagactaaatttggacggagccttcctgtgggaggtcaagctgagtgcatctccctcctgccccacagctctcttcctgagaactggccgctctgtaccctggggaggatgggaaggatggagaggtggggaaatgcctcctcctagtcaggagtttctcagtgtccagtaggaaaaataaaagaacatgctgatgtcaatattcagtcaaccagtgggtattgatggggaagccagagcccagagggctgccctgtagatagccggggctggagatctagaggtggcatcaggggttgtgtgcatgtttgacaactgtggcctgctgcagacaaccttctgaatatgcagacaggagcattacgttcaaggatgcattctcaaacaccttgcaaaattcaagacaaaacccaataaagaatggcccatttctctcttacccaccaagtgactgtttactgttaggaatccagctttgtgggctttttttttttttttaagggaaggtgtgttattacaaatttggctttcatgtgagacttgttcatatgttttatatctcctttttcaaatttacataattgaaatttacacaaaaggctgctattctgtactagtttcagcaagtttccttaaaaagtggaattgtattttccggagctggtgattcgaggttaactacggcaacatctaccacctcctccagaggttcttcctaacattagtgcttcccccttcaaatggtgttttttcttcaaggcgttgaagggtgaagagttccctctattgaggtcaacaaaataaaaagtatctttttgaattgagataatgtcttgtgcaggtttgtagaagaaagacaaagcatgattcctaacaataatcaatttaccaatgatgctcaaagtgtggtccctggtccgggaacaccagcattgcctgggaacctgtcagaaatgccctccctgcccctcctgcatcactctggggacagagccctgcaaactgagctttagcaaaccttccaattgcttctgatgatagcgcttttaaacatctaacctaaagagtacatggtaacaaatcacacatcccagtagcttgatgacattatttgagggttacttgctgtttttgttgccagatttagtggttgctagcacgtttctctctcctgtccccacatctgccctgtgccatcaggaactcccaccaagaatggcaactcgattgggcacatcttagaatcacttgtccactttctggataggcaactttaagtgaaacatgtgtcattaactttatcccactttctccaaggcaggtggactaacactctcatgagaaagagtctcccaagtgctacctagaaatagcaagtcatcttgccccaaagttagactcagcctccagccacaacgcttttggctggttaaacctggtcatcagtataatatgaagggacactgtctttgtccatttaccttgctataaaggaacacctgaggctcggtaatttataaagaaaagacgtttacttggcccatggttctgcaggatgtataagaagcacgacaccaagcatctgcttctggtgcggcctcagggggcttacactcatggcagaaggcaaggaagagctggcaggtgccgaggtcacagggtgagagagaaagcaagacagagtggggaggggccaggctctttgtaacccccagctttcacgggagctaacaaagtgagaactcactcattaccatgaggatgaggacggcacaagtcattcatgagagatcttcccctatgacccaaagacctcccattaggccccacctccaacattggggatcaaatttctacgtgagatttagggggacaaacatccaaactatagcagacactaactcaaagctgctccccagaaacaatatgattttttaagttttattatttatttatttctgagacagggtcttgctctgtctcccaggctagtgtgcactggtgtgattacagcttactgaagcctcaacctcccaggctccagggatccttccacctcagcctcctgagtagctgggactatagacacgtgccatcatacctggctaattttaaaattttatgtagaaatgaggtcttattatgtcacccaggctggtctcaaattcctgcagcgtggctttttgtttatggttggtttgtttttaaaggactgaggagagcccagagcactagctgaggttcagaagtggagagggagattttcttgcagttttgccattaagtggctttgcttcagcctctctcatcgctaaattccttttccgtaaagggaagataatgcaaccactttcttagtgttttctcctagtgtttgcaggtgggcctttaatgcaaggccaaacacatgtccatgttctgctcgaatctgaaaagatttcattaagaatccagtgttaaatcatagatcttcttcatcagggccttttcctgatgccattctgtttcttttcagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccgggtaagtgctacatggacccatgggatgatgttagctttctgaaagacgtaggccgagtctacctgggcccaggggagagatgacggcaacaggggctgggtgacaggggaggggccagtacccagaaacctctaactcaaggcatcctgtccacacatggccaagtatgacagattaatttagaacagttattcccagtgtgtggtccccaacaccagcagcagcaaccttacccaggaacaggttagacatggaaattcttcaccccactccaaacctatggaatcaaatcagcatctctggggatttcagcccagaaatttgtttggaaaaggcttctaggtgtttctgatgcagctcaagtaggagaaccactgaagtacagaaaccagcaaggggattgaaataggaaacaattaataaagtggagaggcaactcacagattgggaaaaaatatctgcacatcatacatcacataagggccattatccagcatatacaaggaaaccaaaagactcaataacaagaaaacaaataatcctatttaaaaatgggcaaaggacttgaatagatatttctcaaaagaagacatataaatggcaagcagatattgccatcttgcttaacatctctaatcatcagagaaatgcaaattaaaaccacaataagatgttatctcacatccgtcagattggctattatcaaaaacatgaaagacagcaggtgttagtgaggctgtggagaaaagggaaccctcttgtattgttggtggtgttgtaaattacacattttggaaaatagtatggaagttcctcaaaaaactaaaaacagggctaccatatgatccagcaatcttacttctgggtatatagccaaaggaaatgaactcagtatgtcaaagagaggtctgcactcccgtgttcattgcagcatgatacaccatagccaagatattatataaaaacaacctaagcatccacagcagatgaatggatttttaaaatgtagtatatgcacagtggagtatgacacagcctttcgaaaacaggacattctgtcatttgagacaacatggttgaacctagaggacattatgttaagtggaataagtcaggcacagagagacaaatactgtatgatctcgtttctgtatatgtagaatctaaaacagtcaaactcgtagaagtacagaatagaatgtagaatggtggttagcagaggctgggggatgaggacagaaaatggacagggaaaagggtcaacaagtacaaagttccagtcagacaggtggaataaactctgttctattgcacagtatggtgactatagttaataaaagtgtatatttcaaagtagctaaaagagaggatttttaatgttcttaccacaaagaaatggtagatgtttgaggtgatggacatgctaattagtctgattttatcattctgcaatgtatatagatgtatcaaaataccatattataacccacaaatgcatacaattattatatgttaattaaaaataaaatcaagctataaaatttttctgaaagagcacaagttgagttcatcccagacctggttgcaagctcctgctctgcttcttgctgttgggtgatcttggacaagttccctatatcctgtaaaactcaattttcccgtcaggaaaatgaggacgatgaccttagctacttccctgagttgcagagacattaggtgacatgatgttctcaaagcctcagcaccaagccagcacgtggccagtactggataagtagtagcttccatatcctgtcactcacaggagaggacacctgtgatttgagtcccattcgcatgtgttccaccctcccaactaaacacctcaccctgtttctcctgttttcccaggtagctggttgttgctttgagtgaaatgggttcgtagagggttttttatacagatgaatgacacaacacaaattaattgttctcagccgtgggttaaatgtcaggtgtctttgctttggactggaattaattcagcacagcatcttagcactgggatttcttactctaatcacaaatgttgactgacaactaaatgcttttttcattcctaaaaaaaggggaagaaaagaaaaaatataccataaatgcaacttgtctgatagacataaatctttgggaacacatagttgattgagaaaggggaacgttccagaaagaagtccttggttatgcaatgtcatgccagttaagcatcactggctgaagtggttgacatttgcccattttatttttaagatggacatgttttcaacacattctagtctgtttcctcagagtactcagaaattgttgctgttggttctgcaaggcactggcagagcactaagctcttttgctttttagctgggtgactttaaacaaataaaggacttctgattgcaaagtccatctcctcaaccatcccgggtgagctttcctaaaatagcaaattgttccttaccactagagggcaccagtatcccaggcttgctccctactcccacatgaagaggacaaaatttctagattgtgtttctctcaggaaaactagtctccatgacaattcgttgccctcctttcccaaggtgttcctgtcctctgtcttaggcttcatgtattgctcccttcagtctcagagcccattcctgactgtgggagatgtcatccaggagcagttgacttagacgatcagtttcatggcatctcagtgtgaaaggatgttaaagccagagggagtcttaatcatgtccttcctccatcctttcattcactcaaccaagactcagggagtctggatgacttgacaggagatgcacagccaggtagggacaaagtccaggctggaacgggttccctgactcctccatcctcttttacaataacaatattccaaatcatgtaacacccaccaaactagtatttatccagcatttactctggaccaggcattatcctggtagaacgctcacgctattcatttattcattcaataaaacatttgctatacatcttctacatgcgaggcactatttgagggaatacagttgtggacagaacaaaccaggttcctgctctcacagagcttacattctagtgtgttcatgggagcacggacttctgtcaccagagaatttggccctgggggaggaaaatcactttgagaatgtttagtggagttacatatttcactagagggatgtagccacctaatactgaagacattctagacgtgttaataatttattttaactatctcctatccagcagtttgagagagacctccggcgctatgccacacatgagcggaagatgattctggataaccatgctttatatgacaagaccaaggtacagttctcttcctaaaaggggctactttgatcctcatccccaaggctggcccccgagctcttttcatggactgattttagtatccaggtatggtttcctttgtcatgcgtgttctatttccagttcatcatagttgagggcagcaagaaagatttccacagactcgcagtttccacccggcccagaatgcaattcgagagattttggctgaaacatgatgagctaattgggcttccagaacaagtccagcagtgaacattaactgggtttggtatatcctcggtgttggcaatgagtaactccaaagtaaaccagggatccccagaaatcacaaatactacttgtgtacccctcaaatgcagggggcagtggcattttgagtggccatgtaggccattaacaacagtctcctgcaagaaagagagcaacagagctgccctgagacataaatgagcatccagctagtctcattgactacccatgtcactcatttggtgtgctagtcttactgtggtcatgatccaattcatccctcagcaaaacgatagatgcctgtagaagttagaagagttaaatatccaactgttaaatccacagttctaagggctactcttcttacagatatcaaggacaccaaaataggctccatggggaagaaaactcaaaataactagaagtaatggtagtggccaggcgcagtggctcacgtctgtaatcccagcactttgggaggccgaggcgggtggatcacttgaggtcaggagttcaagatcagccaacatggtgaaaccccatctctactaaaaatacaaaaaataaccaggtgtggcggctcgcacacacccagctacttgggaggctgaggcaggagaatcacttgaacccgggaggcagaggctgcagtgagccgagatcacaccactgcactccagcctgggcaacagagtgagactctgtgtcaggaaaaaaaaaaaaaaaaaaagtaatgatcatttccctctaggagcttgtagtctaaatgagatgtattcagttagagttgtctcagttacaaatgttagaaatcaaatctaaagtggcataaacaaaaaagggaacttgggttatatactgcaatgtcgaagcgttcaggggcagccgaatatgggtgctcaggcaggcttccctcagtattgcctttattctcaggcaggtttccccataagtcccactcttccagctacttcaacagagaagagcctgtttcctaatagttcccccaagaatcctacctgatgctcattggccaggcctgggtcatgtgcctatccctgaacccattactgtggctctgattggccagacttgggtcatgtgctgcttcttggaattgggagcagctgcacctaaccctcctggactgagagtcaagaggagtggtttcccatagaaaaatccaggtgctgctcacagaagagggggctgtggatgctggcaggaaagcctcggatgctaagcatgtgggtgaaggcagattcacatagtacaatgaaggaacacttacaaattaatacattctaaatagttcaatgtaagcaagtaccttctatgtgcctagcaccgtgctatgtacaagaagggatggaggagaagagctgcttggtcttaaagagatcacagagtgggatcctgctggggttagaggcaagcatggaaagctaaggaaaacccaacacatacaagtatcctataattaccagcagtacaaaattataactgcatgttagaattacccagtgcgttcagatagattgattataagatctctcctgagcttctgatttcactggactggggtatggctcaagcttcaatgtttattttttaaactccatcaggttgttctaataaacagctgtggttcagaactacagcccgtaggaaaaatatccaaatggcttttgctgaatatgttaaagctgttatgattttactttaattcatttagtaccatgttttggaaagtcagttaaaatgactttttatactcagaagcagggaattatgtttgggctgtaattcattctgacaaggcaattttataagtaacactttcactgtgtccacaccatggtgcttatgaaaaatatctgaatgcacatatttcttgttatgttttcagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaacaagatgatggaatctgtttttcttcactcaaatattataaactattttaaaacacaagtgtaaccaagtggaagaataaagagcttacagtttgtcttaaggggacaaacaggtttaattagaagatgcagagattccagaggggatttgggtccgttctggagcttgtggaggaggggtgctgcctctggactggctcagctcggctcagtgcctgctccttcccggccatcatacagctggttccctaagcatcccagcacaggaccacataaaggatgtattctccctgccatcgtgctgaaggaaagacaatgtcctaaaccatcaaagaaatatctccctcttttttccatcttggagcttctgtctacaccttatggctcagtctctctcaggaagtcagtctctcttggcttcttatctgagggcacccaagggaagggagggagccctggctgagggaaattttggaactcccaggctccagacccattctttcctcctgcctcctccaggaggcatagaccctttgccttgaagggagttaacaggtcatctgttccagctgcttccgtgtcttcagcctgctaaagagctgggaggcccatgacgaccgttttcccttccttccagtccctctgggaagaggatattgggagatacaataccttttggctattgtgactaatgctgctgtgaacattggcctacaagtatctgtttgagtccctgctttcaatccttttggtagggacctagtaataaaattgctagattcaatggctattctatactatgtttaactctttgtggaaccactgtactgttttccataacaactgcaccgtattacattcttaaccaacagtgcgcaagcgttccaatttctccacatcctcaacacttgttatcttctgcattatctgttttataatagctgtcttaatgggtgtgaagtggcgggtgaaaacttttgcccatcctggaacccaaagacagtccaggctgaaactaacacactgaaagggcctcagatggtgtgtgtgcctgtcacatcttgagttgatggctaaaaaaagctggggacaacaagagggtggacagcagccacccccactggcctcaaatcccaaaatccacaaagtattctagtcttttctgctgcccagtgtttcccagttatgacattcaagattattctaggtagtaagtagatgaatattttcatactgatataatcaataaatatttattgggtgcttaccatgtcagtcatttttctaggcacagggcatagaaaagataacaaaactgtcaaaaatctctgcctgtatgattataagcataaagcttatgttctagaaaggtgtttatttgtgttcgaaaggtgttaagaaaatggttccttattgatggtagtgatataaagcttcctttttggaataggtttatttatataagaaaagcgactcaaggtcagggaaatcatttaggaaatattaccagtgaaatgggggagtggcaagaatgaggagagagggacgcaggtggctgacatttgggaaatgtgcaggtggccttgtcgccttcactgagcaactccccagccctgttctctggaggtccccaccacacaatagccccaggaggtccatgccag

SEQ ID NO: 13847 - DNA, 83851 bp, Human
taaaaagaaaaagcagaagtgtaacctttgcctctggtctttttctctggggaaatatgaagttgtcagccaggtgttgagcaaagttgttggtggagagaaaagtcaagtgacttatggggtgcattttacaataattcagaaagaacgagctgactattatcatttcattcagtgaagcctgaatttcctgatctttgatgacattgtatgtgcctttaccatcctagtctacttgtttctttcagttaggaactatgggagaggaggaggcagggtctagagctccttcaggatgcactgcaagaaaattgagcagccagattggggaaaatgaatgatggcaggagacaagcacttgcatttttctcatgcaacattgtctgctctcttgctggcctggccaagtcagtgtcctggccaagcagaagggccccacccttcaacagctctgaagattctgctcctaaacatctggtcaaaccagaaattcataggcagtgatgaatgtgaataatcaaggttacctggaaaaagacagaacatccatttgtgcaaagaagaggcacaggagggaagaaatccatccacggtttccacctctaccactgccgctgttccttctccccctcctcctctgtctcctcctcctccgcttcttcttcctcctcctcctccgcttcttcctcctcctcctcctcctcttcctccacctccttctcctcttctgtcttctcctctttccccactgtcttcagccagatcttgggtctgcaacaggagaggtaactgagagctctttactttgtcctgctgtgtattctgacccaggagaagactggttcccttgataaatgttggaaacgtgtactttattccacaagggtgagcagggcattctcgatggctgcagaaaagtgtgtccaggtacaaaaggtcacttccctcccattttcttcctccttgaccctggactgcgggctgctctttaaacaacaggtaaatcagcatttttcagattaggcagaaggaaatataaagtcttccaggagggaagtagagttctctgaataggttcagcccctacaggtatggctccctcctcccagcctcaccccacctgtctgaccttgagatggcctcgtgtctggcgtgtcactgggtgtgatgagcaagtggtggacaggacagaaagaggcaaatgcaaggaggggaatggcattctgcttttaggacttcagaatggcctgatgtaggaattgcattgttgtgaaactgttagatttgttctcatctgacttttgggtacatcctggtttgtttgaaagcatctggctatcggcgaggtaactcctgactctatcaggcaataaggaggctgcacatctgacgatagagttcatctcccctttcctgagtcatccatccctacccccagatgaacagagaattgcccatcccattttaaatagagctccagaaaaagagatactctaattctctgagtaaactgttaccaccatgccactgacaacctgatatttatttttaaacgtattgcccgcatcggggggtaggaaaaagcacaaaaatgccatttttatataatggttctataagtagaaaaagcttatccataactttatgcaaataagcagaaagtctccaagagaggttcagatggacttgattactctgcttttccttgagcccaggaagttcccagttatagcatgcacctgctggaaacagactatatgtgtttgggacaaacaggaagtagtgaccagccagaaacttgtcctaacctggttacaaatctgattgtaaaagaaagcagctggaaagaaatttgcctgcccaataggtttcattattaaagtttacacaaagtggagtaatcaccaagctggctggctatccagatcacatgattatgtagaaacatgaaacttgactatgtgctcgggcaagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggtaagattttccccacccaatacccttcttcatctcctttttttccccccagtgctcttatggcatctcagaaatactgaaatcctggaatgctttgctagtttccagtgggtggcacttactatagggaagtggactgagcttttagggaaagcattgggtggcacttgctatagggaagtgaactgagttcttaaagaaatgtgtaggaacaagagagacttgctttagctgcctcttacaataaagtgtaaagctctggaaagataataaaacaaatgccaagggcttagattctactgaaggtcaacttttagaatctgaatgcaaccaacttttctaaggaagggtttctctaaactgagtcctcacccattttattgcaggttactatttaattttaaggatagctgtaatcatttgttattcattgttttattgtctcatttattttgtgggtgtatatgacaagtgtgtttggggggattagatctgtctttccaatgccctcatgtcaatgtaacaatatccataacaagcctctcaaaaagaataaaccagaagcggccccatgggcgtgagtcaaggagctatggaaaagacaacttccccaaattttgcttttgaaggtcttctttttgtctcattgtaatggcatcatggctttcagagactggaacttttaaagttctgggagtgcagtttttttttcacattttttaacagttttttttttttattatacttttaagttctggggtacatgtgcagaaggtgcaggtttgttacataggtatacacatcccatggtggtttgctgcacccatcgacctgtcatctacattaggtatttctcctaattctctccctcccctagtcccccaccttgacaggccccggtgtgtgatgttcccctctgttcagggagtgttttctattctgactacatattagaacttagccaaatgttcagggggtgatgtgacacatgtagcagacaagtaatcacagataacaatgagccagagaattgaagcttttgagacaatatttaagagaaagtctggattggcagagggacaacccttcacagtagaatacaggtcttatgcctaggaggtgcttggtaaaaggtaatgtgaaatgcatcaatgatctgggatcagtaggcaacatcagctgtgttcaaccatttcaagaacatgctgttgagtgctgctgtgtgatcagcactgacgggacaagaaggcacctcattcttgcccttggtctcaaatagctacaccctcatgaggggcgggggtgatacaatggaagctgtaagcgacagaaggaatgtaagaagagacttagagtagcaggaggaggtttcatagagaagatacttttaagaggtaggctttgagaggtgggtaaaattataaaatactggagaattggaggaaacatgttatgtgctgggagggaggaaatacagaggctgtcactcaaagcttaacacaagtacggtccatttgtgggatagtgaggagagttttctgtccagcggaaactaaagagtagggaatgtgggacctgaaggtcctggtatgattggacaaataaggtgggtccaggttgcaaaggatggtgagtgccctgaccatagggagttggagaacaggttatgctgttagctgttagcaatgtcatgacagtaggcttaaaggagcctggtaggatgcgttggagtgggagggacactggaggcagggatctggtgggagggaggagcgcttaagtaacccaagcatccagggttgtaggcctggacttgggacatggcagtgagaaggaagagggaaagagagggcagaaagacatggcaaagaaactaactaggcaccttcctctgaatgaacaggaggattccaaatgtttttttttttttgttttcagacatattccataatgtagaactatacagaaatgcattctctttcagggaatccaggtgggaatttaagtaaaggtgctagaacttaaatcattttatgattcctccctttgggacaaagtccagcttgatcacagagtagttgatgggcaatatacaaccatagattatgggatagaaaaccaaaattataccatggataatcatacactacactcatctgcttacataaaagtaactttttttccacttgattactcagttgtctttatagaatcatcctgttgtggtaaaatgtactgttgacgtggaacttttcaaagaaatgaaattgtaaactcaatgggctcgaagcaccatcttaactcttttccataattagatagataggatggtgaggagtcaatagatgaaatacttgcctcctgtgatttgtgtcctctgtcctgactggttgacatcaattctgaaggttgattaaccatgtaattatttggcaccagatgaccataaaagtggacagttatgtttatactcttaggcttaggtgagaatttgctcaaattcttagccacaaaaatagaaggacagtgagtgtccatccaaaggactgaaaggaatgaccttgatccagggagtatattcccaggactgaaaagagagtggagcagaaggaattactaggaggagaggggaagcagagtcatccaaggaaaggagggcatgcaggattggaaggagacaaggaattctcaaaatgaagaagaaagggaatgttctggatgaacccagtggggatgggtcatcaccttgagagtttctgctgtataagaatagagataggtgagatggctaagttgcttgtgaccacagagaggtgtgagcacagattctcatgtctttgctcccaccgaggcctgctaaagtaggcttctctgtcagtaggagtccatagacacttagggtcttttagttgattcctagccatgattttcccttaattgtataaggtaaagttatgatcagaaacctggctagagctgggtttcaatcgttccacagtaaacattcctatgatcataaaaatttcacctttctaggggaacatttcaaaatttacaatcctgaatcactttgcaaatatcccttttcaaattagtaaaactaacttgaaaatgaaatgtttagtttttaataacctcccaattgattcatcatctgtgcttgtgtatttttctttgtagcataaacaaacacatacctgctcatttttacaactagaaaaggtctttgacacaagtgtggtcaaatcgggtctccccagttatcttattgattaaagagtatggcatttttccattagaaaaatcaagatttgtgtgattttaggcaagattgcctaatctccttggtttcctcacctgtaagataaagataataataacagtaccaatgttgtagggctattgtaaggtttaaataaatttttctgtgaagcaactggcacatagtgattataggactttcaaaatagtagctattaatatcattactgttgttattctaattctatagttgtgtaattgattttctgaaaataaacagggactttccattgatccctgataagtttcatgttggttccttttcttctttctgactattttgactattttgtctattgattctgacatctgtgacacttggctttgcatggactgcagatgtgacaaacattccttctctgcgttcatctaagtgactaataatgttaagcatgacagaaccctgctgtgggtgtctgggtcttcctggtaggggtctcactgagaccttatctaatggattctgagacatgccttctcttctcagggtttggagttttcaactggagtttttacttccttgatttttctggttcagttcttcagaaacaaattcaccttcttttcacctttccacaactagctgtctctcagatcctccctgttttggtcgatggtatcctcgtcagccctcacactgactcacctttccctcttcacctcagctgacacccactcacctaccacaccctgcaggttttctttatggctcttctcttccatatatggcttttctttccttttcttccacaacatcccggataggttattagctcccccatgtcccctatgtttgtttggttcaaactacaaaatgagaacatttcccaaagtccctctcagctctgatgctgtgatcctttaagcacagagaccacatttgacatatgttacattctcaaaggctaccattttatctcaggactctcaggaaatatttcttgatatatttagaaggaccatgccattggggcccaacagggctgattctaatggccagttactagctgaagccattcagtttctctacacctcagttttcccagctgccaaacgaagctagagatgccttcctcacaggcttgtgtgaagaccaagtgagacaacatggactgaagttcccagaagagtatttgccacttagtcagtataccaagtcaataaaaagcaaacacaaccaccagtacctcaaaccacccaagctgagtggcatttgctgtctctcttgctcttcatatttgtggttccaactccttttaactggggtggcaaacttcaggggagctgcaggcaggaggcacagcatctagtggtggagattagatccacttcctggaccgtctggtttcccatcccctcacactgcctacctgcatcccattggatgagaagccacttaactggaccatcttgcggcacaccaatggatggactacccagagcagctgagaagggttctttctccctgtgggcaagccacatgggagccacgttatcagaaactggcttagtgcgagtggacttcagagtcatcagccaagaaaactcaaggcaacttcctcacccactctgggcatggctgtgctaggaaaaccctaaaccagagtccacatgtccgaggaacctctcttctggacccagtgattgtgtaccatggctgaacaacaccttcctcttcacacaacatgtttccaaatggactatgatacaattgattaggtttccaaggaccaaatcacagttattttccagccctgcctcctagattactggattgaaaagaactgggctggtgccaaactcttcaggcatgtatttacagacgatctcttgttttctccctacaggtgatttaaccccatctgttcttgggagaatttatcagcttggttcattttcaaagaaggtcttacatgagcaagaaaaaaagggagagaaaaattaaaggatagcttgttctagggaaattaaaacacttcgctttctttggcttcttaatagattccacagaaacatccttccccagcctcccgcaagacatagctggatcatttcaatcaatggttctccatcaggggcaattttgtccccaagggaacatttggttgtcacaactggggagtgttacagacactagtagttagtccccaaggatgctgctaaacatcctacattgtacagggcagtctccacaacaaagaatcatctggcccaaaatgtccctattgccactgttgagaaaccctgattcagactaagtgacatgttctcttcagaacaataagcaaatattcatttctatttgcttatagtgacaacgtgtatttaaagttcagaataggcaatacatatctttgccattgttgtggtctttgctcagatcacactgggtttccggtctgggatggtttggatgagggattgcctagaggaggggcaataaatccttaggcctgcatttcaatttgatgttcctttttaaaagttgtgtcaaacaaaactagatcccatgaactatatgcaccattgagctataagttgctctctcctgggtagaaaagtgagagcaggaaaagatttccagacataaggtcatcttgtaataaatagtctgtttctacttcttcaagtagactgagcaaatcttgagtggaaattcttaatgttgaggtaaaaagcatattatgtcataacacagccattaagaagttcaagggcttgtgagtctgatccaatggccaaattctggctgggtgtagagagtcattcctgcaatcccagcactttgggaggctgaggcaggaggattgtttggagccagaagttcaagaccagccgggtcaacataatgagacacccatctctacaaaaataaataaataaataaataaataaataaataaataaataaataagtctggtgtggtggcatgcgtctgcagtcccagctacttaggaggctgaaatgggaggatcgcccaggaggttgaggctgcaacgagccaagatcatgccactgcactccagcctggtgaaagaatgagaccatgtctcaaaaataataataataataaggccaaattctggacagaggtgcacacactgtgcttatcctagagcagaatatgttgcctaaggacattggataaaagacaaagcagctggtggaggagagatgaaatgcgtttgcttgtccatcctttaatcttcttggttatatatgaaaattctgtggcagtgtccaagaggcatgtatttggaataatccttccatgagctgggagagtttctggagcaggattcaccctgtcttgtctggtctccctgtggccagtgtgtatatatttttttgaaaccgatgggtaggctttaagggttcaatctttttcattaaagacttttttccagctctattaagcatttctatgtctccccgcccccctccaaaataactctttaaattggtttcgattgaatctggatctcaggaaatgctttgtgtgattgttctgcatattaggaatgatgagaggaggtctatgtgaaggacccagggtcctgtgctcagaagagcgctgtctcttgtaatgtcagatgctcaaggctcttgggtaatcctgcccccaggcttgcagggctgtggtgctcttgtccactgtagacagagcctcactaaggaggccttttaagtccacctaaccaagactccgtctctgcagattggaggtcagagaggtaccgctactgcctcccattggacaccctgtgtctctggattggtgattacattccatcaggtcccccttaaatctcacagacttggggccattctgcttcttgagggtgaccttgcttctctgtgtttgctctgtcagatgttgaggtttaagcgctcaaaggcagccttagttttttcattccacgtttatgctgggtttcctaggcccctaggaaccatgcacattattaggaatttagagtatgtttcacctgttgctccagaaatgggcctcacctgctgatggggtggaattccagcccctacccaagtccctgctccagatcaagggagcagagaaccctgaagtgtgatgctggctgccgtcctctaggtcccacatgacctcggggttccccagcacagctgtagggaagcagcttttgtgttgggctgacactggacactggggttggctgctgcggtggaaaccctctctcaggaggttgctcctcttcactgtgtgttaagcctcctcattactggcgtatttgtctccatccagcaatgagcaagaaagtctgacttcacctccttcctccctgtgctttgttccaaaaagaaaagagccctccccacaagcccctcctcctccttatttcaccaccttttcctacctgtcctgccttcacctcccttctgaaagggagtccaccagaagctacacctgaagccttattttttaacctaatgttttcacaacccttttgcagcactgtggtctaggcctccaaacagaccatttccctcagcccagcatggctatttcaatgcttatttcaaaagcaagacaaagaagccagcttgagggacatgtggtgactgtttgctgagccacacttctctgttggccagtttcctaaggaaggctctcattaccccaggagcatccctgcctcccatgctggctgggggccccagacctactccagattcccttccttcacacattgtagggaacacgcagcacaggtccctagcttcctgggcgtgtggccatacagtcgcacagggtcctgtgctcggagcttgtgcctggtttaatgctctgctgttgcagtcctgaaattcttaacaatttcgaccaaggggccctgcattttcattttacattgggccccagaaattatgcagccagtgctggtcgggggttccatgaggactcgggccttgcttgcttctacaatgtgcagagacacaggcttccatggagaagcacagagattcgccttgcgaggactgaaaggacacctctccagcccctttattccacaggtgagaaaggtgaggcccagagaggccaggtcacctgttcaagctctagacgacccctccatgtctgcctgtgtaatttactggccaatgtaacattcaggctttgttcttcacttttcatagacgtttgttttaaaattaaaaaagcagtcacttactagtcagaaagccttctgaggattcctgctgtcagtatttcagacaattgtgtgttccaggcccaaacttgaattccacactgactcaggtgtgtctggtatcctactgctatatattttgcaaagaatgctcccacaatcgttcatgtaatctgagagtgagttataattatgaagagcagagctggtcttatatacagaccaagcacacagcaccaacgtggtattttaagaggtgcccttggaaggtgtttttgtcttactgaaaagaaagaatcaggcagatgtggatttgaacatttgctctgcacttaccagcttgtggtctttgagaagatcacttaatcccttttagcctcaggtttttcatctgaaaaatgggaataataatatctcaataatatataacataaagcaggggtattagaacagtacctctgtataccggagagtaagagctcaatgaatgcccccttcctcctggtctgtgcttccctggtgccctggattgtgttgttagagaggcatctacttgggatatggcagtgtctcaatgttctggttcaaaattaaacatcattaagtgtaataggttcaggcactgagtcatctgtcactagcacccacgcaggactcatttatctgataaccaactcagaccaagggggcagagagctctcctacccactcacagaggtggttcaatcaacagcctagctggataaatggatcattgttcaggaacatggtgataaggagggaaaggccagaggtgggagaccacacctaagtaaacgggagttccccagagggaggctatgaccaagggtgcttggagtagaagacaagaaagtctgagctcgtacctagagtgaaatgacccccagccccattccattttttaccccttcattttacaatcttacttggttcaaagtataaaaacttcattatgaaaaataattttttaagcataaaaagtgtattaatgtccctactcaatattgaacatactaggaagagtatttcattgcactgcaaataactataagaatcacatacaaacatgagaactataatttcaaaaaagaaaatggcaaatgtaatataaaatcattgaaaaaaatgaactctgtacatatatatgattgttttggcttttagatgatctttacagcctgttcaaggtcagagttctcttttttaccatggcaggacttcagatttcacatcatcttcatactcgaagatcatcacagttgccaaaccgatcttagatgattgggcttaatatacccgatgctacctattagggtaaattctattaacaacctcttagcatgatgaaaacaaaagctattcatgaaaatgcctcaaaagtaaattattttgaaaatctgctttaaaattgccaatgactgcttcatgggtctggggttttatttaggggtgatgaaaatattctggaactaggcagtggtggtgattgcacaatattgtgaatttactaaatgccactgagttgtacaatttgaaatgggtgaaatggtgaattttacattatgtatgttttaccacaatttaaaaattgataattaaacaatttcctatatttaccataaatgagtgtattttggggacccacgattatatatttttttgacccactagatattgttggccaggcacagtagctcatacctgtaatcccagtactttgggaggccgacgtggacaaagcccttgagctcaggagtttgagaccagtctgggcaacatggcgaaaccctgtctctacaaaaaatacaaaaaattagctgggcatgatggcacatgcctgtagttccagctactcaggaggctgaggtgggaggatcacttgagccagggaggttgaggctttagtgagccgagataacgccactataccccagcctgggtgacagagtgagaccctgtctcaaaaaaaaaaaaagatattgcttcaaaatttttatttaaatgtattattgacaaacatttgtagatgtttttaatgaattacaatgcttcctttcacccctacccctacatacaagacattcccaatatctttgttttctcagagctaagaagaatttaactgggtcaaactttttcaatatatgagttcttgaatgccatccctcaaaatcactctttacttcctgaaaatatctttgcttttacctgcagaaatggatgccaggacaagtagatgacaatactatatatatatcatgccatgtagatatagccaaagttcctttttcccccattaagttaatttttaaaagaacatattcaaattcttaagacacttttattttctggaattatgtagaattgcattttcagaaacatgactagaactacttctcagtcgcttggttttacaaacctattggcagctggttcgatttaagagacgtcagttttgcatttttatgctggtagaggacagacagtgaacacatgcacggtgcagctgtcagcacctcatcagaacaatgagcacatcagagtcagacacagtgaagggactaaatgacatgacctcttagtgttcttccaaacccaagagtctgtgtcatctatgaacacaggagtctcccttaacttttttggtttttgcaatctgcttttatgtagttttatgaggaagttttcctttattcaagacctctgccaggtgggtggtgagagcagagtccagcaagcattccaatgtgctaaaggaaagagaagtgttgtattcctggaggccccaaggaccactggcccctaaagtcagagaggggaagggccatgccaatttcagctgtcaaatcaagtgacaaaacttctaagaacttcttaaggcaggtatagcatcatttccttgccatctcatcagtctcagggtggtgtgcctgatgcataactgcctctgatagggtaagtcctaccagggtttttgaaggacacagggtattagtggaatcatccctactcctgcttgtgccaagtcagcccaatttctgactgcttataaccaagctcagccgttcagacatgccaaagactaccacaaaatatttgcagatctcagtaggaaaaaaaagaaacaagcaaaaaaaaaaaaaaaaaaaaaaaaaaggtagggtgtgaactgtttggagaaacttataaattactttatacggttaataagtggagagtaagaaacagccctggcagcaagatgcttgtgtgtaagggaacacagcccctccactccaggaccctcagggggcctttctgcctcgggtgttgagaaaggatgcatggattatggtggcgtccttccagctgctctgttcagccaccctacttctgagcatattccagaccccagagggccgctaccgcattccctcctgcctcccacgtgccttaccccctctccttcccatttcccctgccatctgtcccttcctctttttactctccctcttcctcccaaagtctgaaacaggcccttaagagctgacgctcccctctagcaaaatgtctaaccttggggaccaatagcaaggcaggggtgggggcacatgtgtcacagtaaagattactgggttggtagagggaatgggtgctgtctccagggacagagaggaaggtatccaaagaggcaacgtaggtgctgaagccagtcgcctgccctggtgaggggccaagttgaaacaagttagcctgtatcatccagagtgggttgagagcataggctccggaatcagacctgattttgaattccagctctatcacttatttgctgtaggatctgggcaaattatttaacctctctgagtcaaattttctcatctataaaaacagggataactacaactatgtgaatatattaatgctattgaactggatacttaaaaatggttaagatggtaaattttttgttatgtgttttttatcataatataaacatggggataataggacctccctcacagggtagttgtgagggttaatgagataatgcacacaaagtacctagcacgtagtacatgctcaataaatgctggcttttaccgttattgattttccaagtctgatcactggcatgcatgatgcttctctcagcaatggcttactgggcttgtactataatcacagctctgaactatggcataagaaggtgggggttacctctggccatggaggtaccccccaccttctctagcagggggctcaagccttatgtggaaggggaaggaacaggtatgactaaaagagttggaggagtcctcaactaaattaatctcagggcaatcacaaaatttccctggaatttaatttcctcccttggcataagaggaggttgacccaggatattcccaaagtctctctcacttccaaatttctgtgactaccttaattgtaggcaaaattcggagtcagctgtatagtctgagacactcatgatctctgatctctttgggcttcagtatctgcatctgtgaaatggaggagaaggccactaactcgaccttgaggggcttgttcacattatcacaccatggaagggactgccaaagctgtcaaaactctgccagctccaccatgagctcactccccagaaggaagcagcctgcagtgctgaattcgcaaatctaaatataattcctgttatttcatagcaaggccaggctggaggaagtgagcattaggaagccggtgccagaaatgacaaggctttagaaagagtggagggggagaagttgtcataggagtcctgcagcatgcaagtaacaggatagtcactaaaaagtatcatgctgcttcaaaacgatgggttggtggctgaaaacttcagctttaagacaggagtgacctgagaggaggatgttttgtgtgaatcagagaattctccggtctgcctatatctgtcccctggcttcacataggccagaaggtttctgtcatgtgataaggtggtgaaaggagcccctttcctgcattacaagagggtcgggtttgtgttcaggttagctctgtggcctgcatgtgccatgcccagtgtgcacacactgaatatttgtggaataaaacaaaacgagtcatgtataaaacagcaaagcatgacattaaattttaaggggtaaccctcattaataaattgatacaaatagtatttaatataatattttaaaaatcaaaatgaatgcccagaaatccatgatgaagaaactactggaattttagatgaagacagaatcagtcctgctgatttactttgtctcaggccccagtatggccaacatggcactttgtctcagtaatgtcctctttgagagttgttggtcctttcgcacagctgaggcccacagggcactcctagtgttattccattgcctttggtaccacgctgtcacgagctcgaggcttgggcctggcacagttgcctccatactggtgtcccagccaccactgtcccaggccgagatcctcctccattcttccaccctcatcatgacacaccccgaggaaaggtctccaagggcttccagcaggaagcctgtaaccccccatctccttggcctaacaggtcccttgactatctgtctctgctcccagcggtctcatccttgtcttgtaaacatcctctcaacacctactttcctgccactctcagctgctcactggacccgaaacatctcagacagtttcacctctgagcctttgcacttgctgttcctgatacctggctgctgttcctgatacctggctgctgttcctcacccttttgatgtgactagagatgtgagatgaagagtcaaagagagagagaaagggttaaagaacattcagaagtttcaagcctgaagatccaaggatgccagcttataaattccatttgcttcttcttctgctgcttttttttttttttttttttgagatggagtctcactctgtcgcccaggctggagtgcagtggtgcaatcttgtctcactgcaacctctgcctcccgggttcaagtgattctcaggcctcagcctcccaagtagctgggattacaggcacaggccaccactgccagccgatttttctatttttagtagagcaaaggtttcaccatgttggccaggctggtcttgaactcctgacctcaagtgatccaccctccttggcttcccaaagtgctgggattacaggcatgagccaccatacccggccctttttctttttcttattgtcagttttcaattttctatcatatagctgttttaaaatttagtaacaaaaataaaatatactatattagtagcatcttaaaaagaaacccagagtcaattacattaaacacctaaaaaaggaggaagtcaactagagaatcagcagacctaatgatgaacattaatttttttatttttaaattaaatgcatttaaatgtatttaaattttaagtttaaaaaagtgtttttaaaaatccattcatagtaaaaagtattcatggatgcatttttgtttctatatatgccaaggaaaacattacagagatttctactccaaattgattttagaaacatataaattggagataccaggtcaattgcaccagcacagatgttctaaggatacccaagtatacgtggataaagcaaagggctgagccagcagcccccaggggttcttgcagtacttgaactcctgacctcaagtgatccaccctcctcagcctcccaaagtgctgggattacaggcatgaaccaccacgcctggcccttttcctttttcttattggcagtgttcaattttctatcatcgagctgttttaaaatttagtaacaaaaataaaatttctatatgggcatggagctcagggtgagactgagtgactgagccatgacaaaaagctcaggcttgattcagtagataccggggagctgctgcactcttgaggaaggagtgatcgttgaaatccaggttttagaaacatttgctgaaagaggccctaacaagccctcacagcatggatgggagggccctgctgccagctgctgcattttcctgttgtaaaggggaaagtgtaggcttagatcttggctcagagaggaggaccagcctatgaacactgaaaggatgaaactcaagaactggacctgaggttaagatgcgggggatgaagaaggaaggatttatttattctgtttgtttacaaagagtcactttcacctgagacactctttaatccattcctacatgcagattaaacagggattttctctgattagcaatactttgcattccaccctttctgaaagacaaatgaaaaaaaaaaaatcctgaaacctgcctatcattgtcctctgtgacagcactaaagagctacaaggaaaacaagatgttttatgatcttatttctactaaactttttaaaaaagtacttcttacagataatatcatctgttaaatcatctcctgtatttaataaaaattattggaaaagtgtttttgtcaaatatgtaatttcttggacacctctggtgatctggccgaaatatctgcatgcagctgccctccccgtgccctcttggccctggaagagctcgctgtccttaaactccatccttcctgaacttgtttatccttctatgtgcctggggctgttctcagtctgcagatacccttctgtggattctcactatggattcctctccttgtgctctcttggccagacgaacttccctggggtatgtacaaagttctcctatcctgagaacactgtcagtggttcttaaccttggctgcacattggatcccctgagagtcaatgactctggtttaaatggtcgggggcaaggcctgggtgtcaagattattaaaagtcccctaagtgattctaatgtgcagccaaagtcaagacgatttctttaacctaccttttcatccaagaaggagatgtagaaagactgccaattgatgtaaggtctaaacttcaattcataaaagactcattgaagggccaggtgtggtggctcatgcctgtaatcccagcaatttgggaggccgaggtgggcggattacctgaggtcagaagttcgagaccagcctggccaacatggtgaaaccccgtctctactaaaaatacaaaagttagccaggcgtggtggcaggcgcctgtaatcccagctactcgggaggctgaggtaggagaatcacttgaacctgggaggcggaggttgcagtgagctgagatcgtgctattgcactccagcctgggggacaagagcgagacttcatctcaaaaaaacaaaacaaaacaaaaaaaaaactcattgaagaaggctgagctgtacacagtcagctcctcgggttagagtccctgctctgacaccaggctgcctgggaagagaaggcaggcaggctggaagcatcactgtgcccgacttgtattaatctgagtccaggtaaaggtgaatgcctggccattggcaaccacagccgattccttctgctgtcttccccttgttgaaagcagacatcataccattgactaaaattccattgccagtgtctttcctttcctggggagaatgcctgggtaagcctttggccactcattatggagaaaatagtaagatttgctgttaaagctattccaggctatggtggatgggggaagatactctggaggttgggaagtcgtctcttttgctctttccatttaaacttagcctagaaggggataaacctggcctaatccttttttttttccttttttttatttttttaattttttttattttttttgagacagagtcttgctctgtcgcccaggctggagtgcagtggcacgatctcggctcactgcaagctccacctcctgggtccatgccattctcctgtctcagcctcccgagtagctgggactacaggcgcccgccaccatgcccggctaattttttttttttgtatttttagtagagatggggtttcaccgtgttagccaagatggtctcgatctcctgacctcatgatcggcccgccttggcctcccaaagtgctgggattacaggcgtgagccatcgcacccagcctggcctaatcctttaaaaatggctgtcaaccttctgtgtgcataagagtcaccaggcctagaaaatttgttaaaaagcagattgctgggctctatctggaatttttattctattgatatggtttagggtccagtgatctgaatttctaataaataaatacaggcaatctttagaccttactctagaaaacactgtttcagagggtgatctggaagagaggctgggtttgaagaaacaagagggaacctgagattgtcccctccctctctgcccctgaggtccaagcctcttgatcccaggctcccagaagcaaggcattcggcacttattctcacacagcctttgcttctcctggtctcagattgccatgtggtctggtcatctctctgctccctcaagctgaggggtcctgattcactgcttcttgtcacgcctacttggatcagagtttcagctatttaaaagcccctcagatagcagaggaaagaaagatgcagataaagcctaaggatggtgctcacttatgaaaatattcacaatatagtaagtggaacacacagatttcaaaatgtcaagagtgatcttagttgtgtaaaatctgtacatcttatgcatgggtagtaaaaattggaaggctattcaatgggaatccttctagaagattcctctattcaacctgcagcacagggaccaacaaccaggaggccccgggaagacaggaaacatcacagtaccaagcctgaggcctgcctgccacatcctcattttcttacatcctttttctaggttggagtctttgcaggatgagtgacagcaaagacagcctatcccccaccaacagggatgaggtcgagtcttagtgccaccgccactgcattctgttagtcacttagagcaccatattataatagcaatggcaaaatggtcccgaccatggcactctgctccaagaagggccagtcccttttccattgtcacgcaaggagaggggcatgttctgcctgcagtcacttcatctccattctacagttttgcaaactgtggctcaagaagaaagtacatgactataaaataaattaaaatatataagcagaggttagtctgaattcatacagagaaaagtcaacagtcctgcaaagaagctacagactgaaaagcgcacacccaaattatgcttccaattgaccacccaatttatttgtctgaaactttgcacttgagttaatgagaacttagtttttcccccaaacaggtatttgctttacttgggcacaactaaaaggcccacaatagaaaaaggcatgatctatcatagacatgcacaaaggatggtctcccaactggtagcatcagcaccacctgggaatttgttagaaatgcaggagctgggcatggtggctcatgcctgtaatcccagcactttgggagcccggggcaggcagatcacgaggtcaggagttcaagaccagcctggccaacataatgaaaccctgtctctactaaaaatacaaaaaattagcccggcatggtggcaggtgcctgtattctcagctactcgggaggctgaggcaggagaatcgcttgaatctgggaggcagaggttgcagtgagccgagatcacgccattgcaccccagcctgggcaacaagagtgagactccgtctcaaaataataataataataaaaataaaaacataaatgcagattttctgacgcaccacagacaacccaatgagaatctccaggggtgaggcccagccagttgtggtccaatagccctcttgagatctatcggattctaaagtaaggcactttaaagggaagaaactgctgtaactttcaaatggtgacttttctactctcagtgcttcctggaatttaaatctctcgagattcagacttacccagggtcacactactacagtgtgactaagttacgtgtcttaattcaaaagcttgaaaattaaaaacaaaagagagaatataaaatttgatttggtttacacaagtattataattatttatatgacctgctcaccatttttaaataccaaaatgccatactgcttaaaattacaatacttatatattttaaaacatgtattagataagctttgttcttcattttattttgttacatgagcatggctctctctctatgactttagaagattaggacattgtgaccttattatccatctccccaccatggaaggatatctctgaatgagataatcaaagtgaagctgttttatgccttacctatctttacctacacacaactcatctcagtaaaaggattgctgtttgaatccagaacaacccctcctggaacagaccagttgtgcattcttttgctatggcatgtgctataagttgtaataaggagcaaaaagcactccaaaatgaaatggccaatactagagagcagcagagctgtgcatcaccagatgcgtggacagttgacataatgagctaacagcatcacagcaaatcttggttttgggtcactatgtcttcccagatcacagaagtttggcagttgtaacaaagcagtctatagacatcagaatttgtgtgaacgagatacagagagagaagaaaactttaaaatataaaaagtgtaatttatctagggtgactatagttaactataatttattgtatatttcaaaatagctagacgaaaagatttggaatgtgttcagcacaaagaaatgataaatgtttgaggtgaggtgatgggtttcccaattacccttatttgatcattacacattgtttgcatgtatcaaaatatcacatgcatccataaatatctactgctattatgcatcaactttaaaaagtatagtttatgcaacacttcagtaacttactgtaattatatagttacatagtataattgttattgttataataatacacaataaaaagtaattaggaaatgccaagaagcaccaaatgccaaattgagcaaatgacaaaattgcatccaattcttttgcaacattttgcatctgtttatttacatccacagcaaaatcacttatgcaaattggcccctggttccctattactctgcctgtgtcccatttttgacacatttctgataggattcttcactgctgcctcattttgctcctcaacctggttaagcattaacttagcctaaagatactccattcagttacagtcagcttacaacgagctgccctctgccctccatatgaaattattgaatttccttgcaatcaatccacttcaacctctctctctctctctctttctctcttcctctctctctctctctctctccccctctctctctgtctgtctctcaatctctctccccactgccagaccccttattttcattttcttctttcctctatctcgaagattctctatagttcctcaggaaaaggagaaaagggtttggcatagagtatatgtgaacaaattctagaaaactgtagagttctgaggcaactcaagggcccatctgagggaccctctgtgtgtctctcaaccatccttttctctttgctactgagcccataatatgtgcctggctctttcctgagctcttacacttgtatcatcagtgtgcccggcctccctagctagggagtataaaatatggtctcatttcctttgttacccaaattacaatgacttggcaccagacccctgacacatacatttgaacgtgggtccctcagtgggtacctcacttacgtagataattctccaaaatgcagccatacggctgtcccaaaagaagtttctcctatccttctacttcacactccagcctgtcctccctccacccttccatgccagtggaacactctcttccccaaggcccagctgaggccgggctgcagctactacaagatcttactgaagattcagggacagcagagagggattatgtggttgaaaatagctagcgatggctctggctatggcttttctcagagcagaggcccagacccagcctcagattcagggctaccacgccctgccatcgcccaaacccccaccactgaaaatccctcaggtttgtctgcgctcttcagcactctagcgcctaacagccattagccctagaaggagagagatctccccaaaatctgcagcctaagttcccaatttacgtttgagcaatctcccttttcccaattccctatcctgtaaatttcactccactccctaagggctagagggcctgccctcaatagagcagacccagcagagcaccagcatggctgcattgtttagctttaaattaacacttggtagaggacacccacaggcctgcccaggcagagttcttctgagaagctgtcctcttaccctctaaactgctccactgctgcaccaaaaagtaacccttccaccgcacgggcattctaaattcacaaagggccaaggagtatttctcccagatgtcctcaaccaacagtttcctagacctatgctaaactatttctattacctaacccaaggcctagctcccagagtcagagaaatctgctttcaggattgtggggaaatcaccatttcctacaagaacaatagctgtgtacagttcattatctaaagggtccagtcaaatagttttctcagaacaaaggaagcatttacctgaaaggtgaattaaaacgtcctactctttcagggaagaaccacgtgaaattttattatacattttttaagtcagaaaattattatgaggaaaacataacatggccctatcctcccattataatatttttctccatatttgtgtataacacagataatacaaatgatatctacacatgctataaaaattcaaatattttaaaacatcataaagtaataatcccctttttagaaagtagaagtttcaggcaacaatatagatgtatattcctcttttttttaggggtctgtggcattccattgcatggatctatcataatttatttaactagttcccttttaatgattaatgagcattgggttgttttcagagttatggttgtggggagggcagaagaagcagggagaagattagagagttcttacacatcacgctgcaataaacatgcttatatgtatatactgatatcattttgtgaccattttcataagacaaattcttagcagtccaattgctgggtcaaaagtcatggacgttttaaatcttgacagatttgattgtaacaatttactttctcaacactggatattatcacacttgttatgttttgccagtctgataggcgaaaagacatctcactgttgtttagatttagatttgtttaaatataagtgatgttcaatatcttttcattggtctattgaccacttgtatttgttttctgttagctgtgtgttcatatcttttgctcatttttctattgaactatttctctttttcttactgagttgtaagatttctttgtaaatcgagaaaggctggtgcaaaaataatcgtagtttttgccattacttccagtggcaaaaaccgtgattacttttgcagcaaactattatgtagtttttattattattactatatgttgcaaatatttctttcagcatgtcatttatcttttgattttgtacatattcttaccagtggagggtcttgatacatattgttaccagtggagggtcttgactatgagtcttccaggttcttggccttttgaacacagaattggacaaaatgcacaaagtaacagaagaatgaaacaatgaaagcatagatttactgaaatgaaagtacactccacagagtaggaatgggcttgaccaagtggctcaagagcactggttacagaattttccttctaggggtttcccattggttacttggttacatcctatgtaaatgaaggagtggcccacgaccagtctgattggttgcagaaggtgatcaatcagacgctgaagttaaggtacaaagttacacaggaagacttggcctgggaccagtctgattggttacaggaggggatcaatcagaggcactttccatttctcatctataacgcagtgcaaaggtagtagcctctgatccttttgttacttgtgcatggagaggtggggttttccatttgattcagttctaggaagtcagtgcaaattggccttaggttccctgactccagaccctattctcctgcctcaatattactttttgttctacagaagtttcaaatatcagccagatttaatagtcattttctttatgactcctaggtaggagtaacttttaaatggaagttttaatagatgctacctactaccatttaataaaaaagaaccttgggcctgattgaagcctctgctatgtccacagagtagcatctatcttcgtaacgtagatgctctaagacaatgagcaaggaatcagaatatctttcttcacagcctgagactggtccagacatcccaacggaaggggacacagcccagtgaccatattccttatagaatcagtcatgcttctccttcgctaaagtagcagatggtcaatttaattaaatacaatataattcatcctatttggaggttgttttggtagagttttttccccttttttgtattcgagaagagtaggagacttttttaaaaaagtcagactggttattaatatcttatgtttaattttgttttttacaggcagcttcaaaagatggtccatgatattaaaaacaatgaaggtggaataatgaataaaatcaaaaagtaagttcgcctctatttaaatacttaattatataaaataagtcaacatgtgctacatggaagaaaacaaatttctctgttacctggatgagaagtttctacctctttagcacgtaacccttctttactattggctggaatccatggtggccaggtctacattctggaacaggacaagtgagtgcagttgtactcagtggactttgattttccttctcactgcagggaaggtgagctatgcccattcaaggtgcctaacaaatgtcaaagcaggaaaatcatttctataaccatttagctaagggctatgaaaacatgtatggagaaatccaaatgaaaagttacaaaacacagccctagcttcttcaagatgccatgtgagttttcctttttttggggttttgtttttgattttgtttttttgtttttttgaggtggagtttcgctcttgttgcccaggctggagtgcaatggcacaatatcagctcaccgcaacctctgcctcctgggttcaagcgattctcctgcctcggcccagcgaatagctgggattacaggcacgtgccagcatacctggctaattttgtatttttagtagagacagggtttcttcatgttggtcaggctggtcttgaactcctgacctcaggtgatccgcccgcctcagcctcccaaagtgctgggattacagacaagagccactgcgctcagccagttttccatattttgatttctgcttttcgaattattacctgaaaatgaacttttcaattggcacttggagagggaaagctagcatctcaaaactccttgtacatcaaaaactcttaagcttttttttttaaagagaataaaaattgtacatatctgcatttgccactcaaaatctaaggtagacgtaccttagtaggtcttatataccttagtaggtaagtctctttcaagagaaaatgggaaatggtattctgttaagtctttaaattttttaaataaaactaatacagattcaccagggaaaaaaaatcaaagaggccagaattgtatgatgtcaaaatctcccatttccttatatctccatcttaacccactccccagaaagggacattgtcatggtaagttcaatgtgtgtatatatatgtatgtatgtgtgtataagtatgtatatatgtatgtatgtgtgtgcttaaacacatacatacatacactgacattgtacatactatacacatacattttcgtcataaatggtatcatagtgcatgcgccattctaccaacttgctttgttggttttacttaagctatttcatggacatctttatttgttagtaagtaaaaattaaccatattcttttctgaacagatgatttaatagtctaccttaaatatattataattcaattaactagctatatattggtggccatctttaaggggggatttgaatttaaaccggtacaacatttttggatagcaatttgataatagcaatcaaaattctctggttgtttcttccaatttaaatgtcatgaataatactttaataaatgttcattgcagaccttgaatataccagtaggctaaattcctaaaatgaaatttccaaatggaagaagttgtgcccttaaagttttaattgctattaccaaatttttctccccaaattttggaccaaaaaatagtttatagaagttcatttctctatgcattcaaaagagcatccttattcgttttaatctatgctaaaattaaaaataagaaatcacttttggtggtatttccagactatgaaatgtaaatgagtctctatgcataagtgatcatcatcaaacataaatggccttctgcttgtgaggtggtggtcatcttacagaggaggagaatttggcttcatgttctgtctgatgagtgggagaggtgtgtgatgatttttgcttattatttctgctacagatagaatctcattctttatgagacagtccttgttacaatcactagcaattctaattgccagttttacagttcaccagttctcaataacatgaagcctctgcataaaatgtttctctattccatggcccccagttgccagttttacaatacaccagttctcaataacatgaagcctctgcataaaatgtctctctattccatagccagtcatatttacagcagctgtggagctcaagttttttataacagcctctgtttcatacattctgcccattggatgaccaaagcacttttacatgacaaaccatgtttcttctcagcctggaaattatggccaccatagtcattaccccgggtgacgtcaggggccctttagctcaaagtgacttgcagttacacttttacttgaagccaggccacaggtgctaccctgaacggaggaagcacgcttgaacacgctggttccctaacacaagactgtgacagagttttcactggtctatggccgcatgagaaaataaggaccatgaagtgttgggggttgtgcacagcagccagctacagagcaaagttcaactacgccttttattcctagtgttgagtggccaacagtcctttagtgagtttttcctttattctgagattatttgggggtagtaaaatacccttccttttcttttatgaaatgatagtaataatggataacaggtggtttgtgcttttggaaattttactattccttgaaccaacctgggcaccagacccagttttgtttttgtttttcttccttgcaacaccttggatgatctctgtctctatacctcatcatgggactaatgatagtatcttcccagcccaccctgctggcttgtgaggagaattgaatgaaataatagatattgagagcctatgagaaaaagaaaaccagaatttctatgtaaatatacatattgttatttttgcaaattacaattttggtttgtaaattgtttttgtgtgcattttttaatcaaacacaaatttctatgctttttttttcaaaacatgaaagtttgtatataatagcagttatactgcttctatagaaggatatgatattttagtaaataaaggctactggatataagttttatttatgtatattttaaatttcattaagcaaataattcttagttaaaatgggtaataattattaaaaataattgactataaaccttactcatttcaagtagtggaaagggaggtatcagaacttacaaaacttggaatagttttctaaaatgtaatttcaattttcttcttttattgaatgaagaaggattgtgactagcacatttcatatgtgcataaaggtactaaagcacctttactttagtaaagttttgagagtgcttaaaacaagttgaatactaaatatgctaagtctcataatctccaatcctgagacactcactgttcacttgttcggctttttttcctttttaaagacagtgtctcgctctgtcgcccaagctggagtacaggggcgtgatcatggctcactgcagctttgacctctggggcccaagtgatcctcccaccttagcccctcaagtagctgggaccacaggtgcatgccaccatggctggctcattttgtttatttttttgtagagatggagtctcactatgttacccaggctggttttgaactcctaggcacaagtgatcctcctgccttggcctcccaaagtgctgggattacagaaatgagccagtgtgtctggcttatttgcgtttttaaaatggtgcaaacataattttagcccaacctacaaccaaaacgcttattgtagctgattttttcctgttaaacatttgtaagtcattaaaatatagtccatcttatcttaccttcttatcaacacttaccttaccaaccaatcaacatttatcttccttgaacctctgaactcagtgcttattactatcatattctgacctctctgagcccttctccacctgacttcacctttgccaagtcatagccacattgtgcatgcactggggagatggggagaggtggaaaacccctgactaatggcttcactacatttacaatacatcaaatctgtccattgattggtccaagagaagccattatgctattagttgtctatctattctgtctatatcagcttctagcatcggctttgaccatcattgttctgctcactgaccttttgtctcatggttgttatttccaggctaaaagtcaaagcacctccaagtgttcctcgaagggactacgcttcaggtaaggtatttctcagatactttaactgactcttgactaatttaatgttcatatttacatttaggcttatggaaagggaaatacgctatcctcatttgaaaacaaaaggtatcttttctaatttcaagaatgactaaatctattaggcattttgactacagtggagatgtagtttttttatccatccatccacccacctatttattggtcacttattaaacatcttccatgtgccaggcacacacagatctgaggcaggaatacagtgctaaaagttaaagatagactatacatttgaggaatttatagtccagaagggaagatagattattgtattagtctgttttcacactgctgataaagatatacctgagactgggtaatttataaagaaaaagaggtttaatggactcacagttccacatggctggggggacctcacaatcatagtggaaggcaaaaggcatgtcttacatggcggcaggcaaggtagaatgcgagccaagagaaaggggaaaccctggataaaatcatcagattttgtgagacttattcactgccaccagaacggtacgggggaaactgcactcatgattcaattatctcctacaaggtccctcccacagcatgtgggaattatgggagctacaatgcaagatgagatttgggggggtacacagaaaaaccatatcaattatgttaaaagtaattataggcccaggtgcagtggctcacacctgcaatcctagcattttgggaggctgaggaaggcagattgcttgagcccaggagtttgagatcagcctgggcaacatggcaaaaccctgtctctacaaaaaatgcaaattatccaggtgtggtggcatgcacctgtagtcccagctactcaggaggctgaggtgggaggatcactgaggtcaaggctgcagtgagatgtgatcatgctactgcaatccagccagggcaacagagtgagaccctgtctcaaaaaaaaaaaaagaaagaaaagaaaagtaattacaattcagtgataggggaagcacaaagttctgtggaattccacagcagcactaatgaatctaatctgtggctgggagtgtggggtaagtggggaagagactacttcctccatcaaaagctgtttaaattgatatttgaggattgttgaaggggtgggggtaataaattattgctggcacattgctgactctcagtcctctccaagtttagcctgcaacctcattccaactaggatcaactttggcaggaaagaagggttagttttgagatttgtagtgtttctggcagtggtgagccaagtgaaatattcaatacacatttctttattagaacaaatacgttggaagatagttttaaaatctctttctatagcattaattataaagatttcctgaatatccctcagtgaaaaccacagagctacagacatcattgatgattctcaacagggcaacagcctaaaaccaaaccataaccttaaatgatgcttactattttattttattttttcggccactgatcaagatagcaataagtcagatagtgcagttcctcctaagggaatcttatcacactgagaaatgctgaccaacctgcccaagtctggttacaggcctgttggaccactcactaattcacagagtagttattggcatcaccctgccaatcagtcagcaagtttagacagttggtcaggggatgccagtacagtctggcactaaaagagggaccctgttctgggctttaatatctacctaatcaataagtcaaggaagcttcctagttatatgagaacaaacacattcttccttccaagttctaaataaagaaaagaaaccaaagcagactcaacctgttaaagaactaaataagtttgatggacaaattataaaatcatggagtcttgggtttaaaaggaaccccagaggtcgtgtagaccaatatctgatccagggcttaacccctatcccaccaccattcacctccacacacaaggcccagcttctgcttggacactttctgtgatggtttcccatggtctagcaagggacaggcagccctggctggatatagatacaatcaatttccttgtgacttcctatgtctatcctgatggccacacagttcaagcctttaaatatgaagaaaagtagagccaggcacaggggctcacacctgttatcccagcactttgggaggccaagatgggaggattgcttgaggccaggagtttaagaccagcttggtcaatatagcgagatcccatctcttaaaatataagaaaaaaatattaagaaaaataaaaatagagttgtcctgtgcaacttcaaaggagagaattaagaagttaggccatctgagtggtttcttctctgggataaacatctccaggtgcttcagctgtttcgcacattttctgattcattcaacacgtgtttcatgagtgtgtcctgtgtgactgtcactgtgctagatctggagtggggaacaacatacaacccctgaccttacagtgctgaatgactagtggggagtcagataagaaacaagaaagcaaacaggtaaatataaattagcaaacatggtacctgctgtgagggaagatggaagagtgcaatggtggggaatcagtgtggggtaggagaagagcttaggtggtgtgggaagatctgtctgagaaggtgacatttaatttgaggattcggggacaaatgtgcaggaatatttgccacttttagatgaaccaacagcatcagagatgctggacacagattccaggagttcagagtcaattgttggaaacctaagtggactgacatatctgatttcagggtggacctccctcctgattgtcccctcacactcacctgtctgcctgctgatccacccacccaggccctctcctttccctttatttctgcgtggggaaaagggaggtagcatccatctattattcatccttttgcctaacccacacacttgggatcaaccttgatgcctccttttccctcaccttctacaaaaattaatctccaaatctcattgatttgctcttaaatgcctcttaaatattttttccctctctattcccattgctacagctaaggccttcatcatctcttgcttgtcctagggtagaaggctctaagtaatctgcttaattcctgattgcatgtggtcctctcaacttccaccagaaaattgttctgaaataaaattctctttaaatcttttcatggctctacattgctaacaagaggaactgcaaaccactgagcccacatacaaggtctttcagcttagccactaactggctgtgtaatcttgggcatctcatgctcctttcctcatctatattatgcaggcctgaactagaagatctgtcaggtcccctctaatactaattattctgcactcctgcagaaacacagatctctggggctcagggcccagtgataaagtgagcctctcctaacattccctggctttaggcattcacatcttccaatatccctgatgctctgaagtgttctcttttttgtcctcagacacctgctccctttcctggaacccttccaaatagtcttgatgtcagaacatttaatctctcctggaatgcagaagtgtggcccaacaggatcttctaagcctttgcaacacaaagtttgattcccagcaagatagcatcaacctcatctggagcttgttagaaatgcagaatcttggccccaccctagaactactggatcagaatttacattttagcaagatctccaggggatctgaatgtaaatcatatttaagaaaccctgctataaaccaccatctctgtccctattgcctttcctgaactgaaagacaagtagattttattccctcaatccctgacccctgcaaatccattgatgttccagggtctcggaaatgcatcttattgctttgccagatgactggggccttgcccagtttcccctgctcttacactcaatccccggaaatggtccaaaaccaccatcaccacctgcagttagcatcctcccttgccgttctctcccccaccccagttcacatcccaggagcatttccagctgcttcccctgagccttgaggtttctgcacagctgcacgtccagggcctcagaaatcagccctgagagctcctcctgaacctggggagtctttaggatcttggaaactgtagtgtgtggaggccagagcccaccagacctcctgagcctgggaggccaatcacgtgccctatggagcacttgatccaccaaaggctcctgaaatgctccagccattttccccccacacattggatttatgtcctctttccagttctggaaacaaatggcttcccaaaaccctctaagccaagagtgtgttgaccttggtgatgctgaccttcagagagcagaggatagaaaggaccagcaactgccccacaggaggtcagtaaaagagtcaccataccctcttccctagttagagtacagaaggacaaagcttgaattacacaaagaatggagagctgggtctcctccagggatgcaggtcaggccagtgtggagcctgctgccttcagttcagacccagcaatcccagttcagtctttccctgaggaggaaacatcgcccctaaggaactgctggcccactgggcagaatgcattgccccaagcagctggcattgctgtgggaagggaagatatccaaaatctgttgagtattgactctgttctgggcattaagctaagctcttcacagacatatctcatttaatcttctcattagcaccgttatatagaaattacgatctcggttttgcagatgaggaaaatgtgtctcaaggacattaagtatcctgtccaaggtgactgcagccactaagaggaaaacccatcccagactcccattttgcagctccttgctttgacccaagctcaagtgttcatgcttttgggggaacttttttcttattctgaaggcactagagctcctgacattaatgcaagaactcgcttcccagttcctgagctttcacagttgaacagccttcggtatctttgaagtctgaggtctggctggggatggaggtcagggagagaccagtcatggtgcccgagagtctgctgggatcactgcagatgccccattggttaccccacaagtccttgaggagtcagaactgaacagagcccctctcttgcactcttgggctctgatgtccagggctctgatggggtggcatccctgggaggtccacgtgtgactcctctggctctgctatcatgcagggaggagatcagagcaaatatagggtggaggggtggcaaactcacttacatggaaaaaaataaaaatccagagcaaagaaggcacttggacagggattcttgggtaaatgcccacacagaagtatggggtatgcataacaatcctttgtccactaaagaagtgagatttaacattgcttttgtcatgggcctggtgctcctagtggagccagcatttacctggttttctgtctccctgtccatattcccctggaggtactggtcttacgctgacatgggagagctatatccaacatcagtcctgccatagggaactaagaatagaggaatgacacttgggctcaaaggtattttaaagcttagaaattcctgaaggattgcccaacccaagcttctcattttaggaataactggagaccagagaggcaaagtgactcctgaggtcatgcagtgaggtgatggctgagccaggactatgtcccccattgctgtacccccacccctctgttaatgatcctgtgaagggatgaatagacatacagacaaagggagtttctacgatgataagtatttcttttttctttttttgagacggggtctcgccctgtcacccaggctggggtccaggggtacaatcatggctcactgcagcctcaacctcctgggctcaagtgatcctcctgcttcagcctcctgagtagctgggaccacaggcatgtgccaccatgcctggctaattttctaaaatcttttttgtagagacaatgtctcactatgttgtccagggtgttctcaaattcccggcctccagtgatcctcctgccctggcctcccaaagtgctgggattacaggtgtgagcccaccatgcctggcctaagatgttaagtatttagactcagaacacctctctcagccagcctgaatctgggtcttgtcctcagttccccacattaaatcatgtccctttctcctcttagggcggcactggtgggactggccacccaccgcctcccctgcagcctctgtagttctgctttctgttccttttcggtgtctgtccccaccaccacaactggcccaccctccctctttccttccttctgtgtcctgctgcggtcttcccactggctccctgcatgccaccacctgctctgttgggggagagatgggcagggtctggcggccgggtagcctccagagcaggatcagggctgcagctgaggcagaatgtcagacatgctgtgatgccaccagcatctgccccaggggctctggtgctcctattgactcagaactgagaggctggattcatactccctttgccccagccaccaccacagagtcctgtactgtccttccagccatcccttcccattcccagaccccctggtctggatcagctttcgtctttccatgcctgagttcctaaacaccaacctcatcagctccccatctcagcttgtcactggagcctgcggtatccactatggctggagcccccactggccggaagcacatcagatttgtgtgagcgctcagcagaatctcctgtccctctccagcccagcgcattcattctgcacacatctgcctctaagccctgcttctggggctgacacataagcccctctctcagatgatggaggaagacacactccttcatccttattctctcacccaaatcctgctcatccttcaaggccccattcggccccacctcgggcacatggcctcatgcaagtttttggctgtcactgggcacacctttctctgaactttccccgctcctggcaatgattccaggtgtggggacatttctcagaaaactacatggccctgagttgtcctcagtctcatgtggtcattcttctggcccttagtctttatttgtattatgaagtgtggcttggtgagaagaccttggactctgaggtcctttaggcctgggatggaatcctggctttgctccctaagcactgtgtgaacttggaacagttttgtaatttgagtgagcctccaatttctgacctggggataagaatacctatcctttagattgttctgagaattgcagagactgtaaattcattgtaatagctaacattcattgagccctttactctatgtcagatactcttctaagcacgattaataatgtccattttagcaaaggggaagctgaggcccagaggtgaagcaattcagctaagatctcactcctagaaaatggcagaataaggattctaagttaggcagtctgaccccagagcttaagcccaaatgtgggccgctgtggccattctcacatctccttgtgtctggtgctgtgcccacaggctggggagggctacatgaatcttaaaacctgggtcaggcaaagggaggagtccctctattgtgtggcatgggattatgacatggtaaatggagcataagccccaaaccaggtaaaccacaccataggaaaggctttaactgacaagagggcccgcccaggatctcagcttcctggcagagaccatggaatcacacaaacaaaatcaaaccacctggcccacatgaagcttgaacttctcccccaaattttactcactacaatagaggctttcttggatccatgcctttgtggtagccatagtgtgtgattgacgtgggagtacattagaatcagtggtgttttgagtgttaattgaggcattctttgcaatgctcaagatgacggtaacattactaaagcattactgtgtgccaggctttgctaagagcttcagatgtattttattatctgattctcacaaaaatatgatacaggcactgttcttatccttgctttacgggtgaggaaatgaagctttaaacaatattaaattattggtccaagaccaagcagcttgtaaaggtcagagccaggatttgaacctagaaagcctggctctaaactaccacctgtgcactttgggaagctccctgagatactggaaaactgactactgttttggacctaataccttggactcccatgctttttagtcttggcaattgcctgcaagactgtaactttatgaatatgatgctgtgagttgcacttgggacctgaagtagatagtctagctaggaatcgatggggcaccaacaaacaacctctatcccatactgtatgatgcttttctctcttttctgtctccatgtgccaagatgtctggattgggtcattctcgtttcaccaaggttttatctaagtgctcagcagagggctaagtggctcagatgagatttcagctgcaggagccaacacagcctggcttccaacccagctcccaaactcactagccaagtagcctcaggcaggttttacaacctctttcaaaaccaagtttctccactgtaaaatagagataaaaataacacctaccacatagtgctgttataagaatacacttttataacacttagcctggcacccagcacataggaagtgttcagtaaatggaatctattgttgctatcctaatgttcctttgtttgagtcatttattagttcacacatttattaatacattaattacaaatgcaaaattctgtccagatgcaaagataaattagataggccttattttcagtacagagagacatgaacaacttaatcacagcacaggacagaacgaagtacatgtgacatcacggtgccaccagcttccaagagggcccagaaaaagaagtgattgattatgacaagagactgtggtagactttgtggaggaggagtgatagggatttccatggaagaaagaagatgggctgcaggaacggcacgagcagagcagagaatcagcaaagtgcacaacgggaggaggaagctgtctggtgttactgttagtgagcgtgggagcctgccgcaagaaatcggtggtgggacagaaggcggaggcattggaatgtgttgccacagaacctctacttgattccatagggagtcactgatgactcttaaggaaaggaacagcataatccaaactttattttaataaaataactacaaacggtaggatggatggattggagaagaaagataatggagacagggacactagttagatggctaatgcactactttcaccagtgactgatcataaaataggcccccactcactgagaaagggtggagcaaatgcagttatccaggcagggaagtgggtttcataaatgcattttataagggtttctatttaaatggttgttacaaaaactcttgccatcttaagtgttgatcttcagtgatccccagacttaaggtattagaaacacattgaccagatgcagtggcttatgcctgtaatcccagcacttttgaaggcagaggcaggtgagttatttgaacccaggagttcaagaccagcctgggcaacatggcaaaaccccatctctacaaaaaatacaaaagttagctgggcatggtggcacgtgccagttactcaggaggctgaggtagcaggatcgcttgcaccaaggaggttgaggctgcagtaagccatgattgtgccactgcactcccacctgggcaacagagtgagactctgtctcaaaaaaaaaaaaaagactagaaaagaaaaagaaacatactcccccattgtgccaggtaatcatattgggaagaggatttattcacccaatcttctagagtttcttggccaaccccagtgattgcagtacactctaattcagcattagtcaacccaaagaataatgtaagaattcttttctgttcacgtcaaagtgtgacccatgtttggcttgtagagtgaggctctttcttagcacctatcatgtttttcccaaaagagggtgctgctgccgccattgcttaaaatgtggccactccgatcccacagtatccttcctgaccccatttcacctctgcaattccttgctggtgcctctggagaccccaaatgtttgactctctggagtccggtggtctgctgtggcaggggtagaaatagcaaaaacataaaaataaaactagaaaatgttctgttgaggttctgggaaatttaggaacatccactgggtcctctgtggcagtggctactcagcggggaatagcaaaaacataaaaataaaactagaaaaggttctgttgaggttctgggaaatttaggaacatccactggatcctctgtggcagtggctgctcagcggggcaggagggagctgggaccctctgtggtgctgtcatggagccactctgccacatgggcctgtgtctgcttgattcctacacagcagagtgaatcccatttaacctctaaggtcagtttatgtgataggctagatgctaagtttctcatactctaaatgtgttttggagggaaaggggtcaaatattcgcctgggctgtcataattcagacttattttattctacaagctcataaactacttaagggccacaacctgtcatatccatttttctatgcccatgcagagcccaggacggcacctcctgcccctggagcgaggcagcaccatgtgggggctcagcgcatgcccgtggaaggcaacctgtagggttcaactcctggctctgccatttattacactatctgaccttgggcatgtgacttatctgctctaggcctcagtttcctcacaaggtttaggtgatttttttttttttttttttttttgagacagggtcttactctgtcatcccagctagagtgcaatggcacaatcacagctcactgcagcctcgaccccctgggctcaagcaatcctcccatctcagcctgctaagtagctggaactacagatatggaccaccacacccagctaattattttattttttgtagagatggggccttgccatgttgtccagactggtcttgaactcctgggctcaagcaaccctcctgccttggcctctcaaagtgctgggactacagtgctgggattacaggcataagccccaacgcccagcccctcacagcatctttgagagggctaaaagacggcaaagctctgataatattgcctggcacatactaagacattggataatttttttttaacaagaaaagtcaaagttagagccagagatgatcacagaaatgatcccctcattgtatagatctggaaaccgaggctcagagatgttagaggtcttgcccacactccaacgcattcggaacagagcctggataagaacttaggtctgtctgattccctgtcctgtgctgttcctactacgccatcctctgaagtccttagaagccacatagtatgaattgtaggtctctactgggggacccagaaatgtcccttaacaaagcccacacatggatcagacgcacattgctctgcccagtgggacttctctctatgctttgagaattaatattttttaaaaagtcaaaagcaagtgaacatatgattgtagtaactaacccaaggtcaagtatatggcaccagaaagcccaaagggaagggaaggcaggtgcgaaatgtgtgtggatgggctggggctggccagctgaggctcacacttgtgccttctgcttctcccctgctgttgcagagagccctgctgacgaagaggagcagtggtccgatgactttgtaagtatttgctcctgggaccaggagggcatcagggtcccatgggaggccttttgaagatcttatttctgaattacatgctggtggtcagccgcacgtcccaagagggaagacttggaaaggtcacctacaggcaaggcatactgcataccagctgacttgactggcactcagtgtgcgcctggctaagagctttccacacataacctcatttaaacctttgaggtaggtgttcttatgcccaacttcagtgctggtgttcagagtactcaccagcacatccaaaacaggtgtaaaaatgtttaaatgtttccatatcagttagcaaatgcctctgccctaaactccccagtgcccatcactgcctgacccctgcccaggagccctaaacgaaccaacaactaaagaataagtgtctggcacatcagggggcctccaggaccaaggtatagaaagtttcagtcacttgcagttccacaattcagacccaggccctcagatctcaggaccaggctctttgccaccaaggtgcttgctgtgatcaagagaacattagcagagctccggagccacagagagagggacctggccatgatgacactggggatgttgtatcagaattatctctttgaggtagctctgaaatgtgcaaggcctgacatcctaaaaacttttcttcacaataattattcctcacttatatcaaattcatccagaatgttagcctgctccaacctgtgagttttagatctggaagggatccaagaagccttccatacaaccacatacccatttcacagataagaaaactgaggccaagagaatgaaaatcacccagttcagtggaatgagaacccaggactcagacctccagtcctgtgcccagccctgggctgtgcacactacctggagtttatacagagtctcagaagacaggagttcctccttcttcaactgcagaaaaagaaaagaaaaatgaggggaaggggtgacttttctgcccatctcttggtcatggagctcctcctggggcccagcagccgcagctccctgagatgcactgcagctgcgccccctgctggctgcgcacgcgcgtgcacacacgacacacacacacacacacacacacacacacacacagccacatgtaaagcaaagaaattgcttggtccacatgcagaggtaagagaagaaaactgagcaagctggctggatgaaaaagagcacacaagggaacttagaaagcacaaaataaaatcagcctggagaggaaggaattacttgccccaaaatcagacaaccaaaatgaagataccagctgtactaaagactgagtaagcattcactcacagctcttttgacttcagtagatggatccccactgcacgcagaatgaaatccaggcttgttaataaagcctccagaatttcttgattttaaacaaaaatcctgctatatgttctcattcatttgtaggagctaaaaattaaaacacttgaactcataaagacagacagtagaatgatgtttaccagaggctgggaagggtggtcgagggggcagcaggtggggggagggaaacagggacagttaatgggtgcaaaaatatagttaggatgaataagacctagtgtttgacaacagggtaactacagtcaacaataatttattgtgcatttaaaaataactaaaagaatataattggaatgtttataacacacacaaaaaatgaatgcttgagtgatggataccccatttacccagatgttattactacacgttgtatgcctgtttcaaaatatctcatataccccatatatatatatacctactatgtacccctacaattctttttttttaaagaccaacaggaaaaaaaatcctgctatataaaattgcttatgaaaggcgacaggccaaagagcaagtggaaagtcatgtacagatcatgcaatgtgataggcagagtgtgagggcggtggacacagaggccagaggacctcttatgtcctgagtcaaatatttcctccacatgaatatatgtacaaacggtatatacataaactacctctgaaaaacatgcacaagaaacctagtgactctttctgcctctgcggtgagaagcagagaggctgagaaggagactgcactttatatccttctaagccatttggacttcagaccgtgacaatgtattttcagtgtggacttaaatgaaatgtggattttaaaaaaacaggccaggcgcagtggctcatgcctgtaatctcagcgctttgggaggccgaggctggcagatcacctgaggtcaggagtttgagaccagcctggccaacatggtgaaaccccagctttactaaaaatacaaaaattagctgggcgtggtggtgcaatttgtaatcccagctactccagagactgagacaggagaataacttgaacccaggaagtagaggttgcagtgagctgagatcctgccactgcactctagcctgggcgacaaagcaagactcggtttcaaaaaaaaattagccaggcacggtggtgcatgcctgtaatcccagctacttgggagaccagggcaggagaatcgctggaacccaggaggcagaggctgcagtgagctgagattgcgccactgcactccagtctgggcaacagagtgagactccatctcaaaaacaggaaaaaaaaaaaaagaaaaaaaagagagcaaaccctgagtccatttgaagccttgaccctgcagcttaccaattctgcttgaaatttttaaaaaatctcatctgaaagatatctagctggccctgtgtgtctcctcaccctcttcgtattaaacctattttctcttcagtgatcagcattcataatagataaaacccattggttattctattttattgggccattttcctatcttttaaaaatatgttttattatctcctcttgttatttgttgtggatctacagagtgtcagctcccattagcgttaagtagttcctgtgtcccccaaggacagtgcagtggtggagacgataaactttggaggcagaaaggcctgcttcaaaccccagctttgcctcttatcggctgcctagccttttgaagtcaacctctccaagccttgtctcctgtcactgctctggcctcccaaggcaggaatggtcctgacggccaggcagcacagacggggatgctgagcacagtgtctgcatctgcacttgcaggacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatataggtgaggtcccccgcagacctgggcactcggccttccaggcccatggggaggtgggggtgtccaagattgcggggtggggacaaacctggctgctgcttgagggcctctgccagccgcccgctcccgccacctccaagcaggggatctgggctccgaggtaaaggatcccaagctgtagggctttcccattccaggggaagaggcgtctttcctagattgggaacattgaaagcaggcataaacaaacaaacaaacaaacaaacaaacaacaaacccagcataccctgatggttgtgctccctcccaacactccaagggaaagcaaccctgagattagtcccacttttagggcttcgtgtgctcaaggttctgggatttctcttaagaagtctgtacaaaacaatgaccttcgaggatcccagtgtctgcctcaccttcctcccatgcctagtccagactatgcggttttaccaggggatacaggtgctcaggagccccaagcctggaataagcctcatgggttaaatggacacagcttgggtctgtttttttttttgttttgttttgtttttttgcgacagagtctcactctgtcacccaggctggagtgcagtggcatgaactcgcttcactgcaacctctgcctcctgggtccagcctcctgcctcagcctcccgagtagctgggtccacaggcacccaccaccacgcctggctaacttttgtatttttagtagagacaggatttcctcatgttggccaggctggtctcaaactcctgacctcaagtgatacaaccgcctcggcctcccaaagtgctgggattacaggcataagccactgcgcctggccccaagtatgcattttaatgcccatctttgttccagtcttggcaggtgactaagttccccaaaggttcagagagcaagtatgtctgtgatggtcatggcgatgccagcatttgtatggaccggctctacatgtaatatctcactgccattaaccccctccttacagtgtaccaggcactgctccttgcttcactgaatgaaagtaaagtgaaggccagctgggcttactgggttgccacagttgatcttttgagcacctgccatgcaccagaactatgctaagcactgagcattcagctgcactcaagatgcacatactcccagagatcttctaatttacagtttagtgctttcccctgggggtctacttaacctcctcgataatcctgaaagaggtcagaggagtgaactgactgggccaagatcctctaagtgatggagctgggatacaagccagggctctcagcttccgaagcccagctcatcacaactcggctctgtgcaccacccaccatacttggtgaatgatctttttcaatcatcacagcaaccctggggaggaaagggctactgcaattcagggtggttaagtggctcactcaagaacacactcttggccaagcgcggtggctcacacctgtaatcccagcactttgggaggccacagtggatggatcacctgacgtcaggagttcaagaccagcctggccaacatggcagaaccccgtctctattaaaaatacaaaaaaattagccgggcatggtggtgcatgccagtaatcccagctactagggaggctgaggcagtagaatcacttgaacccgggaggcggaggttgcagtgagccaagatcgcaccactgcactccagcctgggcaacaagagtgaaactctgtctcaaaaaaaaaaaaaaaaatcacactcttcaaagcctgtctcctgtgttttgctacttctgatgggcttaaatattacattaaatatttgtttactcagaaatctgagtaaactccaggagctgcaaataaaactgacaagagttataggcacagaaggaaggatgccctcatgcctgagtacagccacaccaccagaaagaggcttctgaggaggcagcggaggtgaagttaaccacataccttcaacaaggagtgagggctgagggcaggggcaggcaccaggagcatagaggcgagggcctaacaggcaaggacagctgcaccgggcgaggtggggctgtcacaggaagcagcagcaagaggccagtgatgcaatccagaggccagtgctagcacctgtgctgttcccagtatgaagaacatgccaggttattcctatgccaagattttcctaaaacacatcagtctgaatctatgctcagctcactgaatcactgggtagacttgaggccgcctaacgcctctctcacatggcacaggtgatataagttctacttattaggcagacacactgtacctactgccttcactgcaatcttcctaatcccctcaagatctctaaggtcgatattacgatcctcattttaaaaatgaagaatgttggccaggcgtggtggctcatgcctgtaatcctaacacttcaggaggctgaggtgggtgaatcacttggggtcaggagttcaaaaccagcctggccaacatggtaaaaccccatctctactaaaaatacaaaaattagccaggcatggtggtgggtgcctgtaatcccagctacttcagaggctgaggcaggagaatcacttgaacctgggaggcggaggttgcagtaaccagagatcatgccactgcactccagcctgggcaacagagcaagactttgtctcaaaaaaataaaaaattaaaaaattaaaaataacaatgaagaatgtgagtcccagagaggttgaataaccagccccaaagagcacagctagtgagtggcagagcaagggacagaactcagatccagttggccttagagcctgactccttttctgatacctgatgagaaggacagtcctggaccaaagggatcccacagattccctgtgaatggagcgaaatcactgagggaaggagcatggaagttgatccacgtgagtaatcaccacctggatacactttagcataacctggggaacttttccaacctgtaatgccaggctcctcccgaggagttcaaacgttgccaggctggggtggagcctaggccttggcatttttaaaagccaggagcacctcacccccaccctgtgccctccagtgctgcttccatcccctctgtgtggccaagtgttgggttgttggttctcctgaacctctgggtgtccatcactgccccggaaggatgtttttaatgaggacgttcttccagtttttgtcgtttaagtcaataagcagttgaaattttgggcctaacatttcactttactctttcaaggaatgccccgtggatcatttgtggctacatagacacccgtggttttatactttctggatctcaatggcttccacccaggaaatgatccagagcctcttttatgttatgttttttgtttgttcctttcaagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggtaaagtaaatctgtgccaaaggcttcccaggacacagaggggggtggggcaagcgaccaggacagcctgcccgctggctgtcctccttctttacaacctgctattgactgccccctctaactctccactattataccaaagggacttggttttctccaaaatggcttattgtaaatatgtcagtttactagaggtgtatggtaaaatatcaatactgagtctgtgcccctcatattatcccctccttcttccctggggtttcctgtgaatctcttctttccttcctaagatgttcttcctctctctttattctcctttgcttctctgtcctgttgttactgacagcaaatccatatgggtctgcagcaacctcaattcttgcctcctgggcgtaaggcagaaggagagaccaaggcaagtttcagagcaggaatgaaaagaagtcaagtacacttagaagagggccaagcggacgacttgagagatccagtgcgctgtttgacctttgagttggggttttatacactagcacacttccggggtcttttgtcccttctcccctgattcttcctttgtgtgggctgtccgcttgtgcagtgccctgctagcatttgggaggtgagcatgcgcagtgtgcttaccggagttgtacgcacgatcccttgaagcattcttgccttaccagctgaatgtttctagaaggtcaagtaccagttaaacgctgccattttgcctcttaatgcgcatgcttgagcccacttgcccaactcctgagatcttatcggaaactgctcatcaccagtttcaggttttttctatctattgggagactgcttttccctggcgctggctgtaaccaattattattttagagagacaattaacagccacctgacaatcacctgatggtctcctgacattcctggggcaggggagccctctcctgccctgctcatgcctgactagctattatacccactgtaacactgtcgccaccttgctttctttcctccaccttcttttctctctgctcctccacttccctcttctcagatgcagagggtgacatgggccaggatgtacaatggagatagctagtctgtaaggtaccccgcacaacctgtggaggagctaatccctcacttccctttgacagctcttgcttctcacttcctccctccccacagctgccctgccccagcaggtgtccagagacccaccttttcagatggcccagcatccaactctgggtttacctcctcaatcttccctgtctcagcacctagccctttgtgttgttttccctatgaaatagctcctatttgaaaatgaataggtaaactcatccaagctgtcgtagtaactgataaagcctaatgtgttatggctcccagaggtccctgcattttaaataaggacagagaccagcctgcagcttctctaagaaataacttgcctgtagaggataaaacttatggcttacacacatgttgtgaaatgaccttcattccgcctttataaaatttgcagcccagcaggagatggaaaagatggacttttaaataaaaatagatgcagcatctaggcccaaattcctgctttggcccttctaggtgtatgatttggggcaagctagacaacttctatgagtctgtttttcatctctgttattttgagaatttaataaaagaacatatgtacagcactaaatacagtgcctcacacacagaggggtttaatatatgtcggattcctttctaccatattctagagccttgacaaaatccagttttctagtttcttctgaaaactgaagatctagcaacaccaggccagccatggcctcaaagcaactgggccccagggcatccccctctctctcagctgtgaatcctggtctcttttttgatttgtcatagctcccacaatgcatacagtgcatgtacacaccctcaccctgcacacactccttcttactattacctacccatctgagaggcgatgttgtcctttcaagggtgggaatagggtggcaaagagaagctgagcaggggaggggacaggatggggagaccagctgttaggatctcactgtaaattatttcagcatttggcaattccacatgaagacacaaattcagatatagaatgcagatgaatactgtgggttatgtaaggctcttcatttctgtaaataactgagaatggaccccagggagtcagggcagaggtttgctaatagcagccttgtggaggtggctcaggcaagtctgcaccagtgggaaaaagagaagtatgaaggcgggggcgttctggaatgggcagatagagagccaatataagaaagaggtgtaaaaacaaataaacaaacaaacagaagccaacattaagatatggctgaaccattagttgggaaaagaagaagtcaagtacaagcataaataaaagtgtttaaccctgctctgcaggttataggcaaaatacagagatacaggctaaacagagagctggaggtggggcaaagacatttaggaggaaggagcatctgtgctataatgagagaggctaacacttggagaatgttgtgtatccactggtgttctgagcactttgtatgcattatctcattaaatcctcacactaaccctatgaagtctatcatcagccccactttacagatgaggaaacaaaggtgtaaaggggctaagaaacttacccaaggtcacagagggaatatatttagagggtatttttataagaattcaataaaataatgtatggaaagcttttaaatgcttatatgagtggtaatgaggatgcagcccatgtgggcatttaatagctaatcaaaatgactccggctaagtaatagggtatgagccgatgggaaagtgaaaataagataaattcacgctactcctatttttcaaatctgtagtcctagggggaggcaaacatgtaaacaattatgacaagtgtcttattaatactgaaacatctaaacattggagttgatctaagatgatttttaatctatttttaattttgaatcatgtcattgtaataattgaagaaggatttctaatacctgtaggtcatggtagtataataatctacctggcttcaaaagaccaatcactgattcactgaagtcaagtttttgtgttttgttcatgaaagaagggggttggtattaaaacactgcagcaatgtcaaagtggtcaataagaccacattatgtcctaataaaggacataaaatgtgatggttcttggtcatttacttatttcagcaataacaacgttaaagcattgaattgcaatgctgggaatatacattttacattccttctcctaaaaccctataaagatgagaaagttgggcagacactacaaacagaatttgttgagactggatcgagtcttttttcctatcagtcttctttgggaatacaaatgtctccattccagaaatatcattgaagtggcatcgttgtctggggtaaatacctggggttcgtcgtctcgcactgacaagattaatgacatggacacgtgtgggtgggttaaggagcagaaagtttaatagacagaagaaaggagagaggagagcatctctctctctcttgcaagacagtggaatctgaagggaaaaccaagcctgaggtggaccacagcagattttagaggcaggcttcaggaggtgatatctgatttatacagggtccacagattggtttgatcaggagtgacatttacatggtgcagaagaggctggtcgccccaccctaatcttattatacaaatgggttttctacttggccagtgccatcttgtctgctccttactgtacaggtggctggcaaagagaggggaagacagagccaccattttgatcatgcctagtcacaggtagcgttttcctattggcacaactgccagcattcacccatgcaagcttccagcttgcttgtctatatcagcagcttgattttacaggctactctttgttagaaaagaaaatgattttggggctgctttttattaaaaggaaaaccttaccaaggacatcttaccctcactatctgcctaagtaattttttcttaactcctatatcatcatgactctaaacagctcagattctaaacactgcagataaaaacattttctgtaatcaagcactgcagaacaaaacaagtacaaaattaagaatacagaggaaagaatacattttgaagtggtcaagtaggactgggttagggcctggagcttccaacttccctatatccattcaggcatcattgccaagtgtcaataccaatattctgtgttcagacataagatattgaaggattttgttgactacagggtttaagagggtggcatgcctcctgggggctcagcctctccttttataggaactaacgcctagaagagaagttgggttcttataaagcatgtcactctggctactaatgaatccgaaaaggtgaacccatagaaccaaaaaggtcctgcagggatccgcagccactcaacatcccattattcaaagctgctaagtcagcccatcccagccttggctattgggttaggcaatttcaattcaattcagtgaggcattcgactggccaggtactggaaacacaaacacagagaaggagaaggccctgcccttcgggagttcatagtttgacactgtggggccagagacgaagcagagatgaggaccaggttccctgtgccacagaggagcaagtgcccacctctgaatggcagaatccaggagaacttccgatgattcagcaattaactcccccacaggtcatacatctagaaaagacccaagcacagatttcctcccaggtctgtatgattccaaagcctcatctccctcagccagatcatctctaaatataactgcagattgagatgtgtgagtagaactctctggtgcctctcggccagcttcagaggtgaagaaagagataagaaatagcaattaaataaagagaggatagataagacagaaagaggagggggaggatggaaggtactagaatgtggtggataaaagtatgggtgctaaattattgaactgcttgagttcaaatcctggatctaccactttttttttttttttttggagacaaggtctcattctgttgccaagcgcaatcacaactcactgcagcctcagcttcctgggctcaagcaaccttcccacctcagcctctggagtagctgggactacaggtgcataccaatatgtttggctaatttttctatattttttgtagagacagggtttcaccatgttgcccaggctggttttgaactcctggactcttatctatccacctgcctcagcctcccaaagttctgggattacaggcacgagccactgtgcccttctgggtctaccacttttaaacttgacaacttgagcaaactacttaatttttctgtgcctcagtttcttcatctggaaatggagccaatggtgatatctctcttattgtgttgttagaggattaaatgagaaaaaaaacatgtaaagtacttagaagaacacctggcaataaatttttgtttttgtttctcctagtacccttcttggctgcccaccagggcaggtggtaaaaaccagttttgagatctggttacctcatttgtgtcttgtcaatataaaatctctccctccctgcatttatcgtcatttaattattgacaaaagtgctaagacgattcaatagagaaatacttttttaaaacaaatagtgctaggtaaatggtgctagatgtatccacaggcaaaagaatgaaactggacttctaatctcgcaccatacacaaaaattaactgaaaatgtagcatagacctaactgtaagagctaaaactgtaaaactcttagaggaaaacacagatatgagtctttatggctttgggttaggcaatggtttcttggatatgacatcaaaagtacaagcaataaaagaataaataaaacagacttcaaaatttaaacgttttgtgccaccaatgataccaataagaaagtaaaaaagtaacctacagaatggaagaaaagttttgtaaattgtatatctgatgaagaacttataactagaatatatagataactcttataactcaataaaaagataaacaacccaattaaaaatgggcaaagatttgaatagacatgtctccaaagaatatacaaaaattgacaataagtatataaaaagatactcaacatcattagtcttcagggaaatgcaaatcaaaactataatgagatatcattttgcacacacaaggatggctgtaataaaaaggatgataacaagtgttggtgaggatatgaaaaaactggagccctcatacattgctggcaggaatgaaaaatggtgcagcctctttggaaaacagtttggcagtttctccgactgttaaacttagagctaccatatgactcaacaatttcacttctaggatattcccaagagaaatgcatgtctacacaaaaacttgtacatgaatagtcatgacaccattattcattacagccaaaaagtggaaaaaaactcaaatgtccatcagctgatgaatggataaacaaatgtggcatactcataaaatagactattatttggccataaaaagacgggagttgtgatacatactataccacaggaaaaccttgaaaacattatactaagtgaaagaagtctcaaaagactacagattgtgtgattccgtgcatattcaatgtccagaatgggcaaaatctatagagaaagaaagtagatttgtggtcgactaggtcaaggaagcggtggatggggagtgactaatgggtgcaaggtttctttttgcataaaaatgtcctaaaattagattgtggtgatggttgtatatgtctgtgaatatactaaaagtcaccaaattgtacaatttacatagtagaattttatgatatgtgaattgcgtctcaataatgctttttaaaaaaatcactccctcccatacagtcaactatgaatgtacagcattcttctcattcagttttgtatttctgttaggctgattatgtggtccccgtggaagataatgatgaaaactatattcatcccacagaaagcagttcacctccacctgaaaaaggtaagagtttgtcgccttaagcacctgaaaatttttagcagttgatcaggatgtataagagtatttggtagtaagcactaagaggctcagaaatgacagtgcccaggactttctcccctgggccacagtgtgtgcttctttggctggttgggcagacagcatcagtgacaacccatctctgtgtatcatagcccttccctgccttccccttcctcttccatgctttaatcttcccatctcacattatgaaagcacctgggtagttctcttcagctgccctcgcttcaaatggatttctcataaaacctaatacaatgtcacaagccaccatgttggccttgtaaacattgcaccaagaacagtttctgcagaggagtgaaaaaatgaaagagtgaaatatgccctgagtcctggttctttaaatttagtagtatgataagcctatgaaacatttcatccgtaaacccttcacagaacaacaaatgctatgaccaatgaattaccttaaaaagccagtgctacataagattaggcatggaaacagggtatgtttactctgaatatagtcactatggagaatatgatccagtacaagtgatacctcttcaggtaacattactcatctactactctcaactccatggtagccatattcaggtttcagtccgccatcatgtagcaaccctctcccgtactccgtacctatcaccaacagcttcaagacccacctgaattcccaagccacccattaccacaaaagaacaaatacacattccctccttaccaacccctctttaaaaaaacaaaaaagaacagaaaaaaacccatgaaatcccagagcaatggtgtgtattgcatctggtaggggaggtggagctattaattgggcccctccagtaaggggttcaatacactcttgatgaaaaacaaaaacaataaaactcctttatctcttagacctcccacttggcaaatgaaattcaaagccattattcactttaacaagatctctatcatcaaataatcaaataataatatatcaaattatgaatctgtcattgatattcccattctaaagatgtttcttctaagaagacttcttttattggtttgtgtgtctaataagggtgtctcccattctttgcaaattctctggtctggtcatcatttttccctgagtgtgaattttcctcaatggcatgtatctgtaatggttttatgtatatatatatatatatatacacacacatttctgtgtttaagctcccatggtgaatagatcaaccaagccaaattcctcaacgcccgcctctcctccaggaacagcttcaggtaaagtgtatgtgtgatttggtttggttttacgtctatttcaaataagaaaaacagatcaactatgaagagtaatcacttgtatttccaaatgtcttaatattgggaacagaaggccagtcctcatcctcatgcactgtctggtggcacgtgtgtggaagtggccatttccccaggccttttggcatctgctagacaagttctggttttcaccctaccttcctgggcaccttgctggcttctctgtgtccccttccttgactgagggggtcccggaatttagccctcagccctcaacccacagttctttcagaacatcatgatggttacaagcttggttttgagccagacagacctcggttggaaccccagtgtgccccgttaccagctatgccaccttgggcttgtacttcacctctccaagcatcagattttcttttctgtaaatggtgctcatagcccctactctgtgacaggagaattctgcaaatgtgaatgcgaaactcttaatgagtgcctggtacacactaagtgctgaggagagagaatgatttttcacttctgtagcgttcatcgattaatctggattcatgtctcaagtctacactggtaactccctggcatccaaccccaacctgacttcccttctgaacaccttgatgctcccacacaggactctaaactcactcctccctcccctgcgggcacccctgtttctcaatgcgtagagcctccaggccacatgctccaaatcctgcttttttttctcctgaatttgctgttccattttagctgtgaccaccctagtctgggctttctttactcagccaccttgcaccttcttgtccagcagccatacccctgcctcttggctctctcctcagcgacaaggactgagccgctgaactcctccagatgttaccagtttcatctcaccacaaagctagtctttgccatgtcacccctacccccaaaccatgaatgttcctggttgctcctataggttttggcaacccccaaggctgagcccaagacactgaggggtgcccatgacccccattaacagcacagagaggtgtaggagcctgctctccagcattctcacaggcatttcctctccctctctccccttgtccctctcccctaggcacacatatgcgcgtgtgcacacacacacacacattcatacacacacactctcttctctcacagagctgaacacaagtcattgagaggctgagctctgcttccagagacaggctccttcacagaaaatgaaagaacagtcgagtattttaaaaatcttttcctggactcatttcttgtgaaattattcactttcttcacaagttctggttttacttaacctctcctcagaacccacaagcgctttataagtggggagtggagctcagagccatcttagccagctcatcttaccctctggagagacaaaggtcaaacatgccaatctaaaacatcgtgaccaggttgcttaggccccagcagaaatggagactcctaactcccgataactcaggatgagggctgttgttactggaatagaaaacctttaacaaataaataaatgaagacctcaaccctcctttagagaaatagattactaatatctggtgtttacctcttacaaagctctacttgccttacaaggacctcctcttcctaaaacacactgccttacaagcacctcctcttcctaaaacacacccagtactccaatcagcctgtatgtcacgggtcttgcttcttggtctttgtgttctcacttttaggacacctaatcctactcatccttcaaggcccagcttgaggcctccacctccaggaagactcctctggtttctgtagccctcagagagctctcctttgcaggaagtctcttcccccttacacttagcccgtacttattccctaattactttgtgtctcagtctaatcgcttcctaagtacattgcaagctccttggagaccttgccttcaatgtcattgctcaggaggctttacctggccccaagctgggacagatccctctagtgccctgcacatgccctgagatttctgtctttatttgctcacagctgtttccagggcctaccccaggatctggctcaggggaggtgccgagactgtggaggggtcagttggttgagagggtgaatgagtcctcaaacactggttgtattaaatatttaaagaatcaccaacagggctttagccagctggatttattactcataagtttgctattaacctggtatagctgtattttaatactagggtcatcagatgaagaaagcaaatctaaacaagaaaataatgtcctggttatgtgattatcacatacaggtgggagtacctacaggaagggggaagaagtgaaataattttgaagggacaagcctaaacagtccgagtgggtttccgagtgtgcaaacagtggaaccttcagagattatttttacaaaagaaatgatcagactactagcctgtgtctttgaataaccatccattcccctttaaaggcttcagatagtcccccagtgggcatcacaaaagtgtccatcaggtgcctagttggtgtttctgtcaaagcaccacaccacatcagtttcctctggtcaatattgctcttggtcctttgatagccaataaggtgcctgccgagggtgatatagtaaatctggtgcagtgacagcccctgccgtccccgctgtgcttgagaagccagtagaatggatttagccgactccaaagccagaggtttaggtcctggctctgacatttgctaggtgccggactttgaacaagtgaagtcatctctgtttcttagtttcttcctctgaaaaaatggcacctatgcctaggggtatcatgagtagataccatgagaattaagtgactcaatatagatgacttgcactcataaaatgctagtgctttgttattattattgttattattcagaatcccttgttcaacctgccttgatccatgaccattctggcagatattatcagggaacaatattgtttcatgggccagtgacccatgaagagtcatgctccatccttccctagaactctgtcttcctgaggcaagaccataggctttccaccagtgtcctccgtgacagtgttccaccatgacaatcatgctgtcctctgattgtcagaagttatttatagggaaggaaaggaaaaggaaggttttggcagactattctgagatatgcaagaaaaggaagcatagtagaaaagccaggaggaaggtctgacaaagataatatagtggccaaaggagcccttaacatttcagaagagggaaaacccctgggatgaaattcagacttagaccttctttctacttccttatttttcatacaagattttgttccacttccctgagatcttccatcaaattctattgcagtcaagggtactttaacagtgtcagtcttaagtattcaatttgatacaccagttacttaaacacagggagactcctactacacattcaggtgacatttcagtttattgttttcatgttgtcacatgaaatgtaaacattccaaacgcaatctcttttccaaaatgtttcaaaaaatcagacccagttcaggtaccgtggaagacagctgtcatggagggggcattgcttcccagggtgctggggaaggcttccaggtacaatccacaccacccactctttgctgttgctcccatccttgagggtttaggaaaagagtcagtgggctctgagtagaagcctgggagcctctctccagtgacatacatgggaaggaacttcctgaactctatttcaatactttttgaggccttttctttttcttgtctgtgtttggatgagatgatatggagggtgcatgtatcttccctgttataaattctgagagggcagaggcctatgtctgcttcttcacctcttcctcggcccctaacacagtgccttcatgtgctttacatgtaccaagtcctcgataatccttggtaatggattattatttcaatgtgtgcttatctgtgctctatctcataaactaagaaagtacagactgagggcagcaggtccagcctgtacttacagagtatgccctataaatccattaggaattataggccaggcaccgtggctcattcctgtaatcccagcactttgggagaccaaggcaggtggatggattgagtccaggagttcaaggccagcctgggcaacatggcaaaatctcatctggacaaaaaattagccaggtgtggtggtgcatgcctgtagtcccagctactcaggagctacttagtggggaggatcacttgagtccaggagtttgaagcctccagtaagctgtgatctccccactgcactccagcctgggtgacagaacaagaccctgtctcaaaaaaaaaaaaaaaaaaaaaaacggaattgtggacttgtatgtgtagtaagttcttaagaaaacatttattcagttcagttaagttaatgaagagcctcatgaagagaccccttggtctcactgagcaatggtgtccaagcaggtgagcatcatgtctgaggcagctaggggatgctgagggggctggctcagctctggcctctcccctcctggcctgccctctgtcccacagtgaagatccatcctgcttctctttcacttcctccctcataacgattgtctggcatctatcttcaggtacaggaagggaggttgggtgcaggggacaagacccttcgggtcccttctatgacttgagaagatgagatttgggcagcagcctgcacttgtctcaatttgtccattaaggaaaacctgtcggcgaaagcccttgaaaactcagagatgagtgagtaaatatcctctgaatgtgaagttagaggcatttaccgtatttaagtgtgcttataaaggagcactgtctgaggtctgtgtcaggagtggtgggttggagcctctgtctctgggcacctctgccgtgcacatttgtgcagtgtgcacagatgtaggtgtgagctgttggctcccttcctgaaggacctctgtgggggtcctcactgagtcctcagaatcagtgggctcaggacttgccccatggggcagggggcgggtaaggagaaggtcctttagaaatgttaaggtggagtccctaacccccatcccagctctgagcttatacactgacacttttaaaatgtgtcatcacctttgcccacaagttttccttaatagcttcaatataactacctatatgtgcttaactgaaagcaacacagtatgtgcaaatatttctgagcctgccagagaggccagcctcagtgtgagcatcagcccccggctcaggacttggggactgagtagtgtatatgtttgtgcaggtcgaaacagtggggcctgggaaaccaagtcacctccaccagctgcaccatccccgttgccacgggccgggtaagtacctgttgcaggaagcagcttttgagatctggggagtgaggatggtgataccccactgccctgttgacttcattagaagttctccccatggcaggctgcaacttggaccaagagtaaggagccctgctaacatcaaatgagccaggcatggtggctcaggcctgtcatcccagcactttgggaggccaaggcgggcagctcacttgaagccaggagttcaagaccagcctggccaacatggcgaaaccccgtctctactaaaaatacaaaaattagccaggcgtggtggcacacacctgtaatcccagctacttgggaggctgaggcaggaggatcacttgaacctctgcaggttgcagtgagctgagatcacagcactgcactccagcctgggcaacagagcaagactccatctcaaataaataaataaatgaataaataaataaataaataaataaatctagaagtatttcctcctgtgaagttttagttaagtcttgagttcactaacttacagtgttccacaagacaccctgactttcagaagctccagcacctgaatcattttcagagcctctagcaggttttgtctttacttactgctgctcagttttatggtctgtaaataagtgtgtagatatatactatgtgctggtcataccagggcactccctcaaagccatacgactgaagttcctctcgaaagtgacagtcattctttcttattgaatttagaagggctttgtaaacagtcaggtgaggattgtaatgtgttaatattacaaacgtcaccccgtaaaattatgttggctcaacaggttatttggaaagcaaatttaaatatgtctaaagctggcctgaatggctctaatcttatttctgtctctgtgtaaaccaaagaaagcctccatgttgaaggtttattaaccaaaactctgcatacgtctctcttagttcagctgtatcactttgggcaaactacttcgtctctctgagcctcagtttcctcaccttaaaatgtcactgtaaggtttaaatagcacctgaggagcctaacccagtgccaggcatcttacaggtgctcaggaattcttagtgttcttcccccacacttcagctctcagccgaaaacaaagcgagagagagatatggtgagggtttttaaattaagaaatttaacacacagaaaaggagcatacaaccttaccaatattagactccagtctctattggaatcttgagttcattgacttacagtgttccacaagacaccccgactttcagaagctccagcacctgaatcattttgcaaactagaatgttagtgcaggcaagtaccttcaggaccacacatcagtggttttcaaacttgttttggtttcggatctctctgaaagaaagcctgcacagaagacagtggagaatagtccctagagacagggaggaagctggagtgggcaagtgcagctgcaacctcacctgctggaccaccctcttacctctaccctctgtcctggacagtaacccccacagggagctgttggggaagagggggctccacagaaacactgaaaatactgatcctggtcctcaattgacaggtgaggaatctaacctcacactcaagacaaagaggcccaaggtcacccgccaagtaattagtgcaactggtgcaagagtccagttctgccggactggtgccctactttatccccagttgaccccttccccatctgtcagcagactccatctgagcctaggaggatcataactaaatcccacttccatccctctccaccctgcaaggatagtcttctacacacttgtatcgctttcataattctagcttaaatttgagactaaaataatggtaaatagctccattttgtcttcgttgtgttttaacaaagctcatctctttttattccccaggaaaaaaccaacgacaccactgaagacagtaagttaattttgcatttaaaagtgcttcatatttcctgcagtgtttattcttatccatttatttaaagttgaaaatgcttccagctatggtgaacacagcaatcttagcaactgaagttgctgcccaagcagtccaagagaagcttcaaatcctcaggtagccagggaggatgctcctccctggagcatagaaggagctcatcctcacttgatcccagcagcttcactgagtgtgcgcagcagatcagaggggcagccaggttccctgccctctccacaggaagcgtctgtgtccactccccaccacagctaatggtagaccattgtgtatcaggcacacataggcctcactaaacccagattctggccagaacatggtgaacctgggccacaacactacataagggagcccacctggacctagtccctactgtgaagcctgacatttacaatcatttagcaaacacacagaaggggggggtcatgagaccaaagcagatgccagatgcctgctgtacatgggttactatgtggcagctgctgggggggtcatgatttccatcaaccctgttgacaaggcagggaggtttctccaccacagtgacattgctccttcataggacacttctggctgtttgttgcttaatgcaaaggttgggctagggactgtgggtttgtaattgttgttgtgattgaaagaatagcaatgcatcaaagaaaagtgctgccaaaatatttattttaataatattgctctgacatttatttccacattctgctatattgaataaccttgcctttttttcttttacatagactccagttgcctctcaacagaatgcttcaagtgtttgtgaaggtaaaatctattattttgaaggatgagcatgtcctctaaaagttattttattaaggatttgtatgtacacatttattacattatttttggggcaattgtaaacatgaaactcaattttctaaacaaaatagtttttgcaatgagcaatgaacagcaaaactagctcagaacctcagcatgtttagagtaggctacagaatgcatgcaaaaacctgccttttggcagacagatatgacttgccaggcaatagtgctaggaccttacataaatgtgaaaactaacgtagagccattcacatgttttagaactaatagcttacttaaagtaatgaaaactttaaaaatctgtttatttgaacaagttcttttgctaagttttcaagataatgttttcaaagttcaattgtctgtcttcttagtacatcttcaattgcttttcttcctttttttttttttttttgagttagggtctcactttgtagcccagactggagtgcagtggtgcataattatagctcactgcagcttcaaattcctgggctcaagttgtctttctgcctcagcctcctgagtaatttagaatttcttcctttatcatcactcaaaaatcttatatatatttttagaaactgctcatgttaaaaaaaattgtgtttggaaattaccggaaaaaaatagaagaatcatctataatatcagcacttaaaacattatatagaagttcatgccctgtacccatttaattccatacttgaagatacccagggttaaaaatgtagtgagtattctccctcttccctgagttgatgtgcgtatatctacataaagcactctcctttctctgatgatggacagtggatcttttctgagcatgcactacaactcacctctctgctttaatgacgccattaggttttttcatcctgtctcccatatcttgcttccctaggctatttctgaggcatcaccccttttctgctgtattgctttcttctgccttccctttgaggcttttgtcttttctgtacttccattccttgcagcctctcagacctgctgagtccaggttgtggagtgatagtgacttcaggagctctgagcatctgtaggaagtaagtacaacctgtgcagacttcatggctacaagagcctccaaaatccaggaaagaagcagggcccaaggcatgtccactgctgcttaggtgtcctcattctcaaagggttcccagtacaggagcctgccaggcatgccccctcctttgttatttatttcaagagcataggcaattaccatccaaatgcaaagtgagtgagtggcctctactagcctaggaaggaatcaggatggcggaggcagagcaggtgtagtcaaagcttataggctggcaagacctaaggtgttcattgtttctccttctgaaattaccaagttttaatgtcatgagcaaaacatctaacatagaggtttgaagtagcttgccacaaattcaaaatacaatcttcagaggttcaaggtttccaagctttagtgcaccactgaatggtaagaaaccctgacgtctatcttaccatttatttgaatctttgagttcttactacttttatttctttggggtttctgtagttctcagcctttcttccatgcagactcacacatgaacataccaagattttaacacaccccaccccccaacgacaaatttgagggagagtaaagtattaaaataatgtgtgatcacatttattaatggttcagcagtagagttcactatgggcttcaacataaatttcttacacttcaggtttatgctcatttcccaccctttcctcttctgctcaggaaaacactgaaatgcaagtgagatttacattattatagggataaccttgaatttgatccaattaattttgcaaaaagagatcatttatgaactcagtagtgtgcctcttatcagtaacacactgcttataccacgtcttatgactaatcaagacccaccagggtgttgtctccacctgtgtggaggccacatggcaagtagagggtgagttgtttagagggtggctaaaatgttctcatcttctggcttccacctatactcacacacttaaagtttcagggcccgtgggttcagtctctatgtacattgccagtggatgaatgcagaggtggtaggatgtacctgtaacactgctgggagggagtcctggtcctcatagcacaaccacatcaacagactggcaagtgcacagatccatgacatctcagtaactaagacatgttcccgggaagacttctgatcaaatttggttcttctcagctgatgttgctgggttttgggatgaggacagacatttcactctaatcctaatatgataattttcctgatccagaaaaacctatacctgctgaacgccaccgagggtcaagtcacagacaagaagctgtgcagtcaccagtgtttcctcctgcccagaagtaagaatcctttcctttaaagatcagtttcctcttgttgctgcaggaattaacatgtgcattgtttcactgcacagtgacactgacttgcagtgctaggtaaaaatccaacatttcattgttttgcagttacatgttaaaaggtgttgagcaactttaaaataactgtgtagagttgcagagacctactaattgggttaattattgaacttgactaaaatacaatactttagtcaagatttcctcctttttcaaaactaaaaggaagagtcttacttatctttaaggttttggtggctcttttatctttagatacattttattggccatttgtattgatttatttgtgatgtgcctgttcacagcatcatcagtgtaaacaaaaagtcaaacttactcatattgtgctttgtcctttaattatctgaaattctttcttgcagacaaatccaccaaaaacccatacctctgccaagtaagtacaacgaagccatgtagtgtatcagggagtggtcgaggctggatcctagagtctgataggcctgggttctaacacagcactgtcgcttccagctgcgttatcctggcatcttctcccacttgtttccttacctgtaaaatggggccaagaatgtttatttcacagagttgttttgaaaagtaaatatatttgaggcaatttttactttttttagtagcgatttaatattttactgatcatgcatccttttttaacttttttttttttacaaaaacaatacagctgttttcaaaataataagatcaagtaaaacaacatatgggaagcaccagctatagtgtttggttctaaacaaataataccgatttaaattaagtcaaaatacattttaaagatcacaaaatatgtctacaaaaggtaccttaaaaagaagatacggcaaatatctggataatttttccaaggcaaacatcaccctaaaaatatatgaatcggataagtcaggctcacagaacgtaactgcccaaaccttaatttgcctgcaactcaatgtgggaaaaaaaggaagaaaaaaactctgctttacatagataatttgggatatattccaaaataataaagcttaagtccatttaaataaacagtaattgtccacatgcaaaatttttatgcattttttttactaaacataaattggctttttaaatttttaataatattcatcttaaataaatgaaacttttactagtttttaaaaaaaattctgacaacacaaagtgaaaatgatttggctacagaaatttatttttcattatttaaaaaggtttattataccttttaccgtttttcaaaccaagtcattcattcagttgttagtgaccatatgccgtgtgccaggcattgttctaggcacaggagatacaaggatgaacgaaacaaataaagaccctgtcctcatgaaacttatattctactgaaggagacagagagtaaaaataaacgcacaaataatatcatatcaggtaaatgctgaagtgctataaagaaaaatacagcgcagcagcaggggtgggtggcagagagtaacggaggcagggagggctgctgctgtagacagggtggtctgagaaggcctgttctataaaatgggcataatagctcattccacaaagagctggtgaaaggacgagatgcacgcatgttgaaaacagaataggcctagcacattcgggtgtcagaaaatattagccatgggtactcttccaactgccagaactgcagaaaccacaaactgccctgcactgtgcacctagggaaagtctgttcactcactcacctttgctgctctcacctgggagtgctgttcccctcctattagaatacatccttccttttggcccatctttgttgggcctgccaagccctcactgccccctcctcttacaatggtggctgccttctctaaacatccagggcactattatctgaagcacttagtttatccagaattctttctcctgcagatttccccatcttaataaaggacaactctggttgctgttgtcaaaaaccttagagtcacccttgacttctcacttgctttcttcacacaccttccagctattccttcaaaatagatccagaatccaaccactctcactgcttccactgctgtgatctgtccaagtcactgtcatctcctgcaagaacaccgaactggcctcccccactctgctgttgccaccctctgtttccagcccagcagctggaatgaccctgttaaaacataggcagatcatgttacccccctgttcaaaaccctccaaaagcttcccttatcatgttcattacagctcttgagtcatgttaagggtccaccaagtcctataaatctggtcccttcattgcctcctgtctgactgtatctcttactcttctccccttttcttactgtactccaggcacagtggcacccttgctattccttagatatgccaggccttgccttcacagctccctctacccgggacattctttcctgggatgtccagtgcctcctccctctccacctgcagatctcacccacatattcttcctttcctgatttatttttcttcatagcatttatgaccctctaacattatatatatattttttacttatgtctttattgcccatctcaatccattaaaatttaagttccaggagagcagggcattttgctgttttgttaactgctgtatatccccaatgcctttgatccatggcagagaaacaagaatgaatgaatgaatgaatgaatgaatgtcagataagtctttttcgtatttcacatgtttccacatttagactgtaaactctttgagggagttgatgcctgaagtcagcaattctcagacattttggtctcagaaccactttaacactcttaaaataattgtagacccaaagagctttggtttacatgtttctattgatacctagtattttaagaattaaaactgagacatttaaaacatttattaatccatttaaaaataatattaaactcattacatgttaacataaataatatttttatgaaaaataactatattttccaaacaaaaacaatttagggaaaagagtggcattagtttacattttgtaaatctctttaatgtatgttactgcaacataacagagactgctggattctcatctctgtttctacatttcatctgttgcaatgtttttctggtggaactacatgaagaaaattgggtttcatagtgataggtaattcaaaaagaaaagacctcttgaaccacctgaaaggattttcgagatttccaggggtccttggaccacacttttggaaccattgccttaaggattttttttggtggatgtgtccctggcagcacctagtacagtgttaggggataggcatagaaagagttcaagaaatatgaagattaattgaaggacttttctgatccctttcaggatttacagaagggggaaacccaactgtggatgggcccctacccagcttttcatctaattccactatttcagaacaggtatgaaatgaactcttgatgtcactaaattgttaccaggaaactgcaggaaagagcatgtcttctgagaagaagacatttggagtgaaccttgagaacagagactgtattttacatcattatgtgaactgtcatttggtaatagggacagaatacccagttgttgttttttttcaatgactaagacattgctccagttaatgtttcctcaaaactagcaaggaaatgtgttttcattattcttcctctcacatagattttatttaaactttgtaatttcctccaaatagatctgtagaggctgatgatattaaatcacatataagacagcacagtttataaagggacagagaaaggactctgtgtgcccttgggcaagtctttctaagtttccatacaaatatatgtaaaaatgtaaaatacggataatagcatgtgtccttcttgccttcaaagaaggcatatatcctttcttgcaagaatcaaataaaataatatttgtaaaaatgctttggaaattgtaaagcactccacaaagtaagagcaataagagcacaatggaaagggggattattacttatttaggagaaagaaagaaataattcaggaacctagctaaggccaaatgaaaaaaaaatacaaaaaacaagttaacggtataatccttgtgtttgatcaaaggaaaaataaaactcatcttaaaattattggtgtaaatgtagaggcctgtcttgataatgcaaatgggtctttgtttctagtacacagaaattagagttaagtagggaccatcccatgctgaccagtgccctccatttcacaggaagctggcgttctctgcaagccatggtatgctggagcctgtgatcgaaagtctgctgaagaggcattgcacagatcaaacaaggtctgatcatttttattatttattatttttattttattttattttatttatttgttttgagatgatgcagtttcactggagtgcagtggctcgatctcagctcactgcaacctctgcctgcctcccaagttcaagtgattctcatgcctcagcctcccaagcagctgggattacatgtgtgtgcccccaagcccggctaatttttgtatttttagtagagacggggttttaccatgttggccaggctgctctcgaactcctgacctcagttgatctgcctggcggccttggcctcccaaagtgctgggattacagacgtgagccaccgcgcccggccaaggtctgatcatttttaaatcacacgttttgccctcagcctgtaatagacacagttgtcgtccttatgatatgctaattaaataattgcaacaagtgtagatacaaggatctttttcctttacttactcaagagaaactgctatcccctcctctctttcaagttcctccatctcatttctacttgtcctttcatctcctcaaggacccacagcctccactgccctccaaacagtgggagacgagaaagctccaggggaggtctatggaaggcttggtgctgcatgagctccactgaggagtgaacagtgacaggctattttggatcaatgtgcaggattaaaaatttgagtcaagatggcaaacaaacaaacaaacaaaaaatacctggaagtaaatgtttggagagcccaacttcaatcatgtaggaacaccagggacagcttggacaattcaagattaaagtgacactttttctttctctcttctcctcccattttctttttctttgttttcttgcactccactttgtcagaatatatagcatttacatactgttcttcctcacccttgttttagtcctagctctacaagtaaatatattagtgtgttccgtcagtcctttggtggacttccaccattgtctctttcctttgatgaagtgtacctgtagtagattctgaggaaaaatcgtgtttacattattccctgagttcctttatattcaaaactattttctcagccaggcgcagtggcttatgcctgtaatcctagcactttggggggccgaggtgagtggatcacttgaggtcaggagtttgagaccagcctggccaagatggcaaaacctcatctctactgaaaataaaaaaattagccaggcgtgatggcgggcgcctataatcccagctcctccggaggctgaagcaggagaatcggttgggcctaggaggcggaagttgcagtgagccgagatcatgccactgctctccagcctgggcaacaagagtgagactgctgtgggggaataaaaagagaaagagagttaaaaaactgttttttcatatcctagtagttggaagaaatcttggctggctataaaatccttaatttgagtttgaaaagtgttgctccactagattgtgttgttctgtatgaagctcttgagaagtctgataccaatgtgactttcttgcccttctatgtaatttgatactttagtctggtggctctgcagactttttgtttttaaagtctaatcattttaccagaatatatctctgagttgataattccaaatcaattttctcaagtagacagaagccctttcaatacgtagatttaagttttctcttatatccaataagttttcttagatcatagtcttaaagggttgttctgttcccttatttgtttttcttctgcaagcactcaatttacatgcgttttggatcttttttgtcattttttctcccatcactgtctttgattctatggtacttattttattaaatcccattttctctcctggttgtttccacaccttccttcaagtgtcatttcttaaatcttcatttgaagctctcgtcccttggacatcttataattttttctttgttgagataggcttgtctttttcttcagtttgtttcctgagtttgatcaactcttgttgcatttcattctgctttttgtccatcttttgttcgtaattttttattttatgattctaaatatttttattaaaaaatttaataaaatttgaattactgtcttacagtttggggatttttttttctttttctttttctttctttttttttttgatgttgtctcgctctgtcacccaggctggagtgcagtggcacgatcttggctcactgcaaactccgtctcctgggttcacgccattcttctgcctcagcctcccgagtagctgggactacaggtgcccgccaccatgcccggctagggattttttttcttataaaagttctttgaggagagaattttcataatgaggtcagtctgacccaagattttagtccaggggcaaatataaaatgaaagttttgattcccaacctctgttttcttcttatagtacttatgaatggaatttgtttgatacattttttttcatagacaactggtggctatggttcccagttcaagagagtcctctagatttgatcttaatgtgtcccttcacatatttctaaattttataaacataaaaccttatttagcacattaaaaagctagcatttagctgggcatggtggtgcatgccagtagtcccaggtactcaggaggctgaggtgggaggatcgcttgaactcaggagttccaggctgtagtggactgtgattgcaccactgcacaccagcctgggcaacaaagtgagactgtttctaaaaataattaattaattattacctttttttcaaaaaaggcaagcattgatctcactcaggattttctatgagtatatattttcctggactattttcttagaaaataagaagacaagcgctaatcaataataaaaataatgtagctaaataatttacctttggaatgtaatataggtgttcttcacaaaatgattttttgaacctgtagaaatataagtaatactaaccataattatgttttttaaaaaaaattaaacaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagaggtcagtgatttctttttaaattcaattctataactatgcattgagtataatgacatcaaatactgtattagatgctagagatgaggagaaaggatacaaaagtacttgttctaatgcttgcataaatgtcatagagaacaagataaaatactatatttaggcagtatatcctataagaacacagaaaaggaaaaagtcatgtgatgtacatgctagtcctttcattcagttatttaatgaggtcagtctgacccaagattttagtccaggggcaaatataaatcaaggttgaaatgtcaagttgaattaaggttgtaagaattagggtcaagttccagacctccaaagtcaagacctaaaatctcaactcaagtaccaaggtaggttaccagggaaggatccagaagagatgcagaaacttgagttaaaacattagactatagcccttgtaccagaatgagcttatgggcctggagcaagaaaaaaaaatcacatgggtcttaaatattaatcaaacattaactttaatgcctctttaatctggaccaaactcagtgcttaccatatctcagtttagccagcctgctcctataaatgaaccctgaaatatgagctggagtaacccatgaatggtctagaaatgcagtgatacttattctggttttgaattacgggttgaatttaaatgggtagaatgtaagttggagggatggagaaggagaaaaatgggaagaacaatctatgcagagaaaatagcataaacaaaattcaaggtaagaaatatttactttcaagattccttcagaaaaaggtacaccattccaaacccagcacctgctagaaaatatttgaattgttggaaaatgtcatgattgctgaagtgtctgtcttccccactacatgaagccaaggacaatgtcttttcatctctgtatttccagaatcagagcacagtaactggcttcagtgtacacttgataaataattattaagcaactgaattgatttggttgagtgattacaggcaggagaatagcatttgcaaaacaaactgaaaaagtcatgtgtattctttattttgccttttagacaactgtggttaaaaaaccacatataaaatttaccatcttaatcattttaagtgtacagctcagtaataagtatatttacattgttgtgaaacagatctccagaacttgttcatcttatagaactaaaaccctatacccactgaacaacagtttcccttttccccctcccttcagcccctagcaaccacgttctatttttatgaatttgaatattttagatacctcatacaagtggaatcacacagtatttgtcctttaggaccagcttatttaacttagcatgatgtccttgagactcatccatgttgtagcatgtgttaggatttccttcctttttaaggctgcatagtatctcattgtatctatataccacattttgtgtgtctaacatccatcagtggacatttgtgttgcttctacctcttggctattgtgaatagtgctgctataaacacgggtgtgcaaatctctccaggacactgctttcaattatttgggggtatatacccagaagtgggattgctggatgatatgggtattctatttttaattttttgagaacctcccatacttttttccatagcagttgcaccattttacagttccaccaacagcacacgagggtttaacttcttcacatccccaccagcacttgttatattctgaattgtgttgttgttttatagtagccgtccaaatgggtgtaaggtgatagacagctcattgtggttttaatttgcatttctctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgagactccgtctcaaaaaaaaaaaaaaaaaaatttgcatttctctgatgattagtgatgttgaacatttttcatatgcttttttggctacttgtaagtcattttcagagaaatgtctattccattttataatcaggttatttgatttttgttgttgctgagttttaggagttctttatgtttctggatattaaccccttatcagataaatgatttgcaaatatttttcccactccataggttacctttccactctgttgattgtgttatttgctgagcaaaagcttttaagcttgatattgtcttctctatttttgctttttttgcctatgcttttaatgtcatatccaaaaaatcattgccaaatccagtgtcatggtgtttcccccctacattttcttctagaatttttatattggggaattttattttgcttttaacaaagtctcagataattttaaaatgcaaaactcttgaatctaagggcactaatcaagaccaatctttggttttaaaatgtagaccgcattatcatttaacatcctaaagcttctccagcagtctagcttttctataagaggcttaagggtgggtgaagaagctgtcctatttcgaggtcctgaaattctctcacaaattttgaactccctgaggggctctggatttcgttgtcctgctaggaaactctggtaaacaggaattcctcttggcctgatgaatcttcatctccactttagaatgaatagactagagcttcacctcacttccaacatattcagcctatggattccaaaataagtaatatattactataatagcatctggaggtactgacagtcaattaaaactcttacttaaagtatctataataaaaagattatgtcccctatacactgaacatctgaatggaaaattaaagtgttggttacatgatgtcaatcatgtggagtttttctgaaagtctgtgtgtatttgtgtgtacatggctagaaaaagtaaccaattcattaactatttaactgtttatgcagctattttggcactgtgtgatacaacattgagtaattttacagttttgacaactgtctgctttatcttagtggccaatacgttgtttttctgtccacaaatacactgaatgtatctgtctcaaatacactgaattaataaaaacagaaaaaaaggagagtgaggggaagctgtaactatgttatgcccaattcttttttaaattaaatcacaaatattcttcaacttcattccctacttcaaatgtttcaactcagctcaactccctactgcacacacttcaatccccgaacaccacaacaaggcaatactcacaaatattcagggactagagggacggaatgagatatttgtttgtataagtacagcaatcctctcctatgcttcctaggttcaggacacactttttcccttgtaatccacttcaaagagattgtgctatttcgttttctggcccttgagtccataactttaactttcaactgcatttggtttagcaacatattatgccaaacaagcagaatgaatgtttaatgggatttataatgaaagaatttctttggcaattgcaagatggctgaatgattgaataggaagtaaagaataaagactaaaggtatttgaaagtccctgtctcttacctctctccctgactgaatattcagctagccaattatctaaaagacaactggtatttcatttggaaatgttggccaatattctgaatattttactttattcaatatgtagctacttggaagtcatccaaacaattaataaacacttaaaaattttactgtggatgtttgtctttatctaaaaaatcgagaaaataaaatcaattgatagtaactgctaaactcatggcactgttgtaaaacaatcaccacttttaaaaagtgattctaaatacatttaatgagtgtgaacttgtagcacttttgtatactcaatgaatttaatttcatgatctgtgttacatttgtttttatctttccttcaaaactttaattatttttcagaacaaaatttgtgataattttaaattaaaacccatagacaacaaggatcaaaatttggaaaaataagtatgtatggagagagcctagcatgaaatttcattattaattaggcactaagttaactctaagcttaccaggaaccaagtaaaaatggaaatatgaaggtttataaagctttctttatttgtttaaaaaagaaaacaaaacataattttgtttaggagatgactatttccttgtactaaatttctaaggttaatttattacatcaattcttgtatctgagacttgtgcaaagtaagagatgatctatgttttgtaaagaatgtagaaaaatgcgttgtatgatagttttacatttaacggtaaataaaaagcaatatactataatattttatcataactcagtgaagtaatctctctaagtagctatgctaattgaggctgtcagtgtgtttttcttcgtacttaatacagcaaagtccaaggtctgccaccttgaaggttacagcctttgttaaactagatttttttgtgcagaatgtcagctggggtgtaataacttttactaacttgagaatgagagaagatgggaggagtggagctcaaatttaacacaaatgccaaagtataattcatctatgttttcttcctctagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaataagtgtaaagtatattatcaaaataagaaaataatgctcttgcataaaacaaagtggctggaaatttaaacctccacaatgatcattggtacactaatgtagctgggctctccactgccaatgcttgacaattaagtcttggttaaaattttaatttgtagaaaataaggtattaaaggtaatgtatgatatctgtaagtataggcaagaaggatgtaatggttcctttttgtgagcactctcaaccatgggatatatatatatatggatatgaactttctataagttcttgtctaggattatgctgttagttttgcttactaaagataattataccctctttgatctacatgtctatcaaatagaacctaaacttgatatgaggtttgtattagtccattatcacgctgctaataaagacatactcaagactgggtgatttacataaaaaaaaaaaaaaaaaaagaggtttaatggactcacagttccacatggttggggaggcctcacaatcatggcagaaggcaaagaagaagcaaaggcatgttttacatggtggcaggcaagagagcatgtgcaggggaactgccctttataaaaccatcagatctcatgagacttactcactatcacaacaacatgggaaaacctgcccgcgtgattcagttacctcccaccaggtccctcccatggcacgtggggattatgggagctacaattcaagatgagatttgggtgaggacacagccaaaccatatcaagtttcaaagtggaatgacagcaaagctagactaaaagccagttcctagagaaatatcccacaaaacaagagcagaaaagcagacattggtgaacaccaaggaataaaagagataccatcgtggagaatcaggtccaaggtcttagatcatcccagaaatgtatcatactttgtcatatatttctactgtgtacttcagacagcagtgaagtgataaagcagctaattaagtctaataattaaatggggaacacacttggccactgcataagatagcaatctatgaaagtatgttgaaaggccagaaggtaataatttcagggtaactcatgactcacttctaaagataattgtatatttaaatgtcataaactttcataattgccacctatgttacagattgaactgtggtcccctcaaaaagatatgttgaagtcctaatccataaggccacatatctcagaatgtgaccttatttgggaatgaggtctttacagatatagtcaaggtaagatgaggtcagtagggtgggccttaatacaatggctggtgtccttataaaattaggaaatttggatgcaggcacagagagaagactatatgaagagacacacaggaacaatactactggcgtgattccatcctgtatggctgttctcttgagcagtggtcgtttatctccgtctgctttctctcccacctaagtgtgtgccgccacctgatggaagattcgatggacatggacgtgagccccctgaggcccagaactatcttttcagttgtgaactaaaggccgacaaagatgatcactttaaggtggataatgatgaaaatgagcaccagttatccttaagaacggtcagtttaggggctggtgcaaaggatgaactgcacattgttgaagcagaggcaatgaattatgaaggcagtccaattaaataacactggcacctttgaaaatgtctgtacagccaacagtttcccttggggtctttgaaataacaccaccagtgcttttatggttgaagtgtggttcagggccagtgcatattagtggacagcatttagtagctgtggaggaagatgcagagtcagaagatgaagaggaggaggatgtgaaactcttaaggatatctggaaagtgatctgtccctggaggtggtagcaagattccagagaataaaagtaaaacttgctgctgatgaagatgatgatgatgatgatgatgatgatgatgatgat

SEQ ID NO: 13848 - DNA, 46885 bp, Human
  misc_feature (1)...(46885): n = A,T,C or G
caacgttgggaaccaaagtggggtgcccttagagggttcttttccagattccagaacactggcatcaaagaggacatctctcccataccagttttatccagatgttttagcttcaagtagttaaaatcctgactctaattgggtcaaagcataagttttatggaaggatgggctcagcatttgttgatttagcagcttaaaatgccatcaaggactcacgttctctacatctctctgctctgccatcattgaatgccatcccttccaggcaggacaatgtttgaggatgaagagagaatgttttcttttttccctagacttgccccagaagacttcctccacggtcacatgggccataattaggtggcatacccattattaaaccagtcactggtgagggaatgaaattacacagacaagtccatccctgagcttgggggaaaggcaagcatctgaacaaaatggagtttcttttgggaagggagaagcagggaagtgctgtgtatttcacctgctcttccttgtttggaagcaatagataatgatgttgctaaaactttttctcctaaattttgtattgtttggtctgatgggtaaagactgcctcaagattctggggattgaggtggattggagacccataccttaatccaagcttagacttggattaagttcaagcttctgctcaagagcttcagagagagctcccatttcagtgcccagccagcttctacgtttgggaatagtttggggagttgagagaggaggaggttgagttgtcaaaatggagggaatggtgcaaccatttcatttcctgttcacttcctctatgcaatctgtttacatctgaccaaagtagcttttgccttttttttttttttttttttttgagagggagtttcactctgtctccaggctagagcacagtggtgcaatcttggctcacagcaacctctgcctcctgggttcaagtgattctcctgcctcagcctcctgagtagctgggatggcaggtgcacgccaccatgcccatctaatttttgtattttcagtagagacggggtttcaccatgttggccaggatagtcttgatctgttgacctcgtgatccacctgcctcagcctcccaaagtgctgggattacaagcgtgagccacggcacccgtttttggttattatttttttgagatggagtcttgttctgtcgcccagcctggagtgcagtggtgcgatcttggctcaccgaaacctctgcctccggggttcaagcgattctcctgcctcagcctcccgagtagctgggattacaggtgcccaccaccatgcctggctaatttttgtatttttagtagagatggggtttcaccatattgacctggctggtcttgaactgctggccttgagatccacctgcctcagcctcccaaagtgctgggactacaggtgtgagctgccgtgtccggccacttttgccttttatataattctactattggagcttttctaatgtcccatgacagaatgagactaaagacaaaataaataagataatatgaattatgatccaaaatgttcaagactcctcagcctctatgccattaccaattgcttactatgtaagggtggtttaaatgcaaggggtatgtatgtcaagccaggaaatgtcatggaatagtgggatttgttgtttgatgatacattcttaatactttttaacatcataaacattttgtggtagatttcaaaaatgaggaggggtattcttgttttttgttatttgttacttctaccttgatagatctgtgtgaactgttaaacagccaatttggggctcttctcactcctcattccatatctgatcactgacctagttttgtccttgccacagccactaactcagtcttggcctttgtcaaagtacaaacaaatccttttgttcttgaattatttcccaattactctgtaagtacctcattgataaaaaagattggcttttaatctgtctctgatgtctccaggtagccattacaagaccagacagaaaggggaggaaaatcagtgtttttgatttcttgttggtatttttttcttctgcttttggttttagagtctaacgtgaagacattttgctccaagaatatcctagccatccttggcttctcctctatcatagctgtgatagctttgcttgctgtggggttgacccagaacaaagcattgccagaaaacgttaaggtaagtcaaatatatctgtgtgtttgtgtgtatgtaagaggagatctgggtgggacagggggaggagggataaggtatgtagagcataggggacgagttgaggttctaacagcccaggaacaagtcaatttccactggattaggggagtaaaatggaaataggtgctcattctagaagagtaaatgccttgaatcattagtggtgggaagttaactgcctttatgattgtttagtaaactcattaaattgatactctagcagagatgaatgctttattcaccttatccagatctgtgtaatactatgccaagattctatattctagtatatttccacttcttcatcatgggtgaatcacaatactgcactctgttctttttacttcattattatcactatcaccaaaacaataacgtttattatacaactctgtataaagtactttggaagtcagagattgaggagaagacatgtttcttatctccagatatagtaaagaatcaaaatcaataaaagcaaatcagaaaacatatacgtgtatcaggtatagtcatttgaaatgaattcatggataggcagatttcttgtgacatttctacatttgaacaactagttaatatcattaaagatcattaggatcattaactttaatgtatttatgttttctttccagttcatcaaagtaaaatttcagacatgaatatctcacaagtactttgtaatatggtcattatattttttaatctgttaattaaaaagcatgtggtaaataaaaatttatactataaatacaccattttaaactttcactgaaattatagtaaacaaatatataagggcccagatgataccaatatgctaatatgcatgtatgtacacatgggcagtaatatatctagaagttaacttgaccatggaggcgtgggaatacatgtgtagaagtatattctcttgtatttgaagatgttgaactgggagcctggaaggatggttgtgtatgccaggcctctgaaacttttgccatccacccaaatcactgtatagcagaggcgtgggtgtcacactggcatctttttgtcaagttcaacccagtggtgctgtgtacagcagtccctttgtcaagacagaaggctgatactatctcattgttaagggtcgcttgccttttaatgttgactgatgttgtttccttggcaaaacttcactcacagttgaagcctcatgacatcttggttccattatttgtttaccagctccaaaaatacatggttgccttcttaatttgacctttttacatgttcagtattgcatcattggagagggggatgcctaggaggcaaaatccatgacaaacttgagttatgttcccaagaatatgtgtggtcatggacgaccttccctcattcacagtggtctcctttaagtctcttgtgcttctgcattgttatatgggcctggcaaaatggaacaaggtctttggcattctttaaataaaaggtaggagtattgaagagcagtcattggcatctgaagtgaatctttttaataacatcactgatttattttatacaaagatagttttatatatgcaaactagccatttgttgaggttatataataattttagtaagattcctggcatatattgggggcaaaatatttcaggaacttgtattctggtgatggctttaaaccagatgtgctgtccaatttgatagccactagccacatgcagctctttaagcttgtcaattaaaattaaataaaattaaaaattctgtccctctgttgcactagccacatttcaagtgctcaatagccatacatggctggtggctactgtattggacaacacagatatagaatattgccttgctgtagaaagttctattggacattgccactttaaagcatactcttgaatgataactctgaagtcattcaaaactaagtttaatgaatagggtgtatgataaaacattttataaaatctagaataagaaacaaaaaaactttttttcttgcatggtttgtaaactagtaccaggatcatcccaaatatcatgggctactaaactggtttgagtagtttattgaaataaatgtatttgcttccaaaaatgaccatttaaaagataacacttatttggatatttgtactgatacatgttttttgtttgtttgtttgttttttgtttctttgtttggggtttttgtttgtttctttttcaagatggagtctcgctctgtcgcccaggctggagtgcagtggcacgatctcggctcactgaaagctccacctcctgggttcacgtcgttctcctgcctcagcctcccaagtagctgggactacaggtgcccgccatcacgcccggctaatttttttgtatttttagtagagacggggtttcaccatgttagccaggatggtcttgatctcctgaccttgtgatctgcctgcctcagcctcccaaaatgctgggattacaggcgtgagccaccgtgcctggctgatacatgtgttttgagagcacacaatgacatgactttatgaccatacttcattcagcagttcttcattcattttttataaatttatgcatcgacaattatttattacactccagtctggctgacagagtaagactctgtctcaaaaaaagtaaaataaaaaatattcattgtctgtgttaggcactgggctacacaatagggaaggcagtatatagatatgactgagcttaccatctggggaagcaaacatatttaataacacaaattattaattgtaattatgataaattgccaccaaatgaaagttttggggccaggcaagtcttccctgaaaaaatgatactaaaataatatctgaagaatgattggaagttagctgggaaagacataggtaaagggtagtccaggcagggccgagcacggtggctcatgcctgtaatcccagcagtttgggaggccgaggtgggcagattgcctgagctcaggagcttgagaccaccctgggcaacatggtgaaacccaatctctactaaaatacaaaaaattagcttggtatggtggcgcgtacttgtaatcctagctactcaggaagctgaggtgcgagaatcacttgggccccagaggcggaggttgcagtgagccaagatctgccactgcactctagcttgggctacagagtgagacgccaactcaaaaaaaaaaaaaaaaaaaaattccaggcagaaggaaagcaggtgcaagagtcctgaaacaagaaggagttggatatctcctaggaactagttggagagcaggagtgggccacgtgttatataaagatggggaggtacgtggtgcaggccctgcaagacaggttgaggatttcagttttaatcctaagagtagtgggaagctagtggtatgatcagatttgtttttgcaaagatcactctgatttcaatgaattagaggaggatgagatataggaggataccaggaagaggctacaagaaaaatgtggaaggagggggagcctttgggttcaatttttgaagaattgttttgagtgttggaaagccaatgggaaatgtcaagaaagcagttggataatcagatttggacctttcttttctaagcagatatctactgctgtgctcaataaaaatataaaacaagccaaattttaaattttcaaagagctacattttagaaagtagaagaaaagaggtgaaattaattttaataatataatttatgtggcccaatgcatccaaaatattacctcaacatttcatcaaaataaataattgttggctgggcgcggtggctcacacttgtaatcccagcactttgggaggctgaggtgggtggatcacgaggtcaggagttcaagaccagcctggccaacatagtgaaatcccgtctctactaaaaatacaaaaaaaattagccgggcgtggtggtaggcacctatagtcccaactacttgggaggctgaggcaggagaatcccttgaacctgggaggtgaaggttgcagtgagccaagatcacgccactacactctagcctgggtgacagagcaagactctgtctcaaaaaaaaaaaaatttcgtttttgttttgttttgttttgtttgttttttgagacggagtttcgctctgtagcacaggctggagtgcagtggtgcgatctcagctcactacaacctctgcctctcgggttcaagcaattctcctgcctcagcctcctgagtagctgggactacaggcacgtgccaccatgcccagctaatttttgtatttagtagagacggggtttcaccttgttggccaggatggtctccatctcttgacctcatgatctgcccaccttggcctcccaagtgttgggattacaggcatgagccaccaccatgcccggccaaaaaaaaattgttaatgagatatgttacattcttttttcatactatcttcaaattttaacttatggcatatctcaattccaactagtcacatttcaagtgctcaattgccagctatttgttaccctggttaaatagcacaggcctagattaaagctatgtctctgatggcattgattgactgaagccttagaaatggatgaggtcatctaggatggggttataaaatgagaagagagtcaaggtccaagtcctgagaagctctatcatttaaagcaggggtccccaacccccaggccatggaccagtacagcaggaggtgaggaacacgcgagcgagcaaagcttcatctgtatttacagttgctccccatcgcccacattactgcctgagctccatctcctgtcagatcagtggcagcattagattcttataggaccgcgaaccctattgtgaactgcacatatgtaggatcgggattgcgtgctccttgtgagaatctaatgccggatgatctgtcactgtctcccgttacccccgtatgggactgtctagttgcaggaaaacaagctcaggcctcctattgattctacattatggtgagttgtgtaattatttcattatgtattacaatgtaataaaaatagaaataaggtagttcacaataagtgtaatgcacttgaatcatcccaaaaccatttccccctcctcaccacctctgggtctgtggaaaaattgtcctccaagaaactggtccctggtgtcaaaaaggttggagaccactgatttaaagggtgaatagggaaagaattcctcctaaggcataatgataacattatttagtgctttgcagttataaatcatttccacatgcatttccattttttcttcccgtgaatactgtgaagaatagaaggttatccccatttttttttttttttttttttgagacggagttttgctcttgttgcccaggctggagcgcagtggcatgatctcggctcaccgcaatctctgcctcccaggttcaagcaattctcctgcctcagcctgctgagtagctaggattataggcacacgccaccacacccggctaatttttgtatttttactagagacggggtttctccatgttggtcaggctggtcttgaactcccgacctcagttgatctgcccgcctcggcctcccaaagtgctgggattacaggcatgagccatcgcacctggccatgcccattttatagataacaaaatcaaagccttagatgttctctcacccaaggcagagggggagctaaaactagaatccagttttctgatccaaagactaatgttctttccatttgtcttagtgagtttttccaaacagcacatcctattaacagaaattgcatgcaggatgtttattttgggaagtgattccaaggaaacaaggaagaagggaaagagagagttaggagcaaattaccacattgggccactgaggcttgatcctcccagggaccctctcaagagctgtggagagtgaactttagaattgtctgccctggggatttatcccctggttctcattatctgttggtcaagggttgctcccatctggtgttaagtccctgtcacttccaggtttgcacgtgtgtcagaggggtcatgtgggtaccacaggtgacaacttaggcagcaggagagaagctgctgggcagaaatagagagataaggagatactgctggggctggagtaaaaagttggccaagatgtaaaatggtcacaagaggtatctgaagtatcattgcacctcctgatttttgtggaggtgagggttcttcgtacaaataatttcaatataatagagatatattcatgcagagacagtgctatggaagcccagagaaagaagctgctaattgtgcctgtttacatggaggcttcacagagaaggtagccttggagctgagtcttaagtgctatggcttgaatgtttgatccctccaaaactcatgttgaaacttaatccccagtataatagtattaagaggcagggcctttaagaggtggtgggtcatgagggctctgacctcatgaatggattaatccattcatggataaatggattgagttatcacagggtgggttagttattattagagtaggtctgtattaaaagctagtttggctctcagtatgccccctttgccatgtgatgccctgtgccacctcgggactctgcagagagtccccaccagcaagaaggccctcctgagatgttgcctcttgaccttggacttcatagcttctagaactgtaagaaatacatttattttttaaataaattacccagtatcaagtattcagtgatagcaacagagaatggactaagacaaatggtaaggagttttctagaaagtgggataggacatgttccagacaaagattatatcatgtgttgaagagtgacagcttgaaatcatatgcaatccctggggaatcagcagctcagtatggttagattgttgaatatgggggcaggaaggagaggtggaagaggaggtccaagtctgagcttagtatttttggcttaaaagtgggcatctcatccattaaactgcagtggtgttcaagcttggatccatgttagaagcacctgaggagcttttcaaaaatatggctgggccccatctcaggtcaattaaatcatctttggaggttacagttaaataaaaatggttcaaaatattgtagatcaccgggcgtggtggctcactcctgtaatcccagcattttgggaggctgaggccggcagatcacttgaggtcaggagttcgacaccagcctggccaacatggtgaactgtctctactaaaaatacaaaaattagctgggcatgttgtcaggtacctgtaatcccagctactcgggaggctgaggcaggagaattgcttgaacccaggaggcagaggttgcagtgagctgagatcacgccactgtactccagcctgggcaacagagcgagactctgtctcaaaaaaaagaaaaaaaagcccagggactgatacgttctaaaatcttccatgtgattctaatgagtagttttgattgaagaccactgctttgaagggtttcatacaaggaagtgatgcccagatttgtgttcccaagattccttttggctggagagcagattagaggagagaccagttagcatgctcctgccatggtctaggcaaggcaggcgaggccagaattaaggcattgtctgtggggtaaggggaggggataatgtgaaagacacttgggttgaccagatctttgtgacaaaattcctttgaggaccttttaagattaagatggaacaggtaccttgggacggttaatgctgagagaaaactccgaatgcttctgtttaaagagggtggtggccacaagcctctgttggtgcaacttcatacatggaaagactttcagctgtcctgtactcacttcctctgatttgtcatccctgtcctcttgcagggatcattattctgcctgcctagagtacaacacaacatgggccatggactcacattgccttgggtttgaatcttcgctgtgctcttagggtcacaggagttaacctctctaagccttagtttctccacttgtatgatggaactgatgcttcttctcttgtaagattactgtgagaattcagtgggataaagtacatgcaaatatgagtccagagcagaaggcctggcccactgcagacactcagtgattgataactcatgtcttatcatttttgcagcttacctgccttagtgacaaattgacagttatctttattttattcccactgttccccatctgacttgcccttgtctagcccatttcaggtcagcccacccatgctgatgatccagtcttgtcatcttcctgcctgacctagtttgggttcagccctgctggggagatagtgccctcatgcctgggccacatgtggcataacacagcaagaactctttattgttctgaaatgtttacttgcccagctacctaaaaggttataagcacattgaggacagggaatggatttcatttgtctttgtttgcattttatttattcattgactccattcattcatttaacaaatagccattgaatatcaactctattgtaggccctggcatatattagtgagcaagatgggcaaatttattatacccttgttttgaacttatagtataatgagggagataatcattaatcaaataatcataaaataaatgttaaattacagccagcacaacatctgatttgggtagttgctccagagaagtttgctgactctgaatagagaaagcaccttgaacagataaaaccgttccctccttgtatgtgaagaacccaggaccaacctggtagccaggcagtgtcagtgagggaagcagacctctgcctcagagttctctagagatcctagttccccactcttaccctcagagccttctcagtttgaacctccagagtgcagggcctcagaagctacatgtgttagcaggcatcctggggtgttctcatgccactgaagtctgtgaaccactgcctgtgagacacaatgagaacttaaaaaaaaatagccttaatgaactgaagagtcattagctgtacccaagactccccctgggaaagtacctttgttctggtggacctaggtggggcggtagctttgacgtctgcttggttccccacttccttgtctactcgtaactgaacactggcagttagtggttgtcagatattcttttagcacaaacattccacattttggcacacactgagtctctgtcacacaagcaccagactgacccaatgccaaacaactagccttcattaaacgctgcctcttctgtgaatgcaggctcagggaccagaccactttgattttaatcccagatatgctactttctagccgagactttgggcaagaaattctctctatgcctccccttatatgtaaaatcaagatagtaacagtacctacttagaatatggttgtgagaattaaatggaataatacaagtgacttaattgtcagagcgatgagcacatcagaggtcctcaatggagactacctgctttaatgaagatatgtcctatggaaggcccttagctattagtgtattatggtcactgaaccagtactctgcaggatttccagcttctgttaaagggtaatgacctttcctcatgcatctgctttttcaaaatgaacaaaagtgctgttcttagataagcatttgtgattttatctttttatggagactttggaaagatttgctctgatttccaacctcgaatactcttggaaaatatctgtattatttttactctattggattttaatgtgtgttttagaaaacaacatctgcagatagatggtgttgcacaacaatgtgaatatccttaataccacaaaactgcacttaaaaatggttacaatggtaacttttatgttatgtgtgttttacagcaattaaaaaataagacaataacagaactgtggtttgtattaaagatctagtaactctaattaaagaaaaaggaaaggaagaaaatggtctctaaatgtttataggccctactagcatctctgtagctaatctggtttgtttatagagtactagagtcttactcaaaattataagctttgtttataaacccaagctcactgagacagactgatgaggctgctgaagttaccattaaagctacaggaacttttaagaaagtttttgaagacacactgtgtctgaagggaccatgaaaagttaatgatcatacttgcctgtgttaccagatgtcttagtctgttttgtgtggctgtaacagaatgtgacaaacttggtaatttataatataaagaacagaaattacttttctcacagttctggaggccaagaagcccaagatcaaggtgctggcaggcttggtgtctggtaagggcctggtctctgcttccaagatgatgccttgaactctgcatcctctggagggaggaatgctgttcctcacaatggcaaaagagtaggagatagcaaactcactccccaaaccccatttaattgtggcattaatccatttaagagggcagagtacttgaatacctaaatacctcccactagggctcacctcctgatgctgatgcattggtgatgaagttttcaacacatgagttttggaggggaaaacagtcaaaccacagcatctgtcttatgagctttttggggatggtgtaggacaactccagtggtactactttatattagacaatgaatattaacctcttttagggctggaaggaatttaggaaccatccagttccaaccccctcatttatccatttgattcaataatgatctgttgaattctttctctgtgcctaatgtatagtaggatataccatcgtggatgctgtatatactgtggtaaacaaagtagacctgccctcatgtagcttacaatctaataataaagatagatattaatcaaatagctgcataaatatgtaattacaccatgtggccagtaccgtctttagagggaaaatacaggcattctgatcaggagggtaggatctaaactcaggaggtcagagaaggctgagatgtcaagtgaagggctttctcggtaaaggccctggagcagaaaccatgagacctatgggcaactgcaagcaggccagttccaccagaggtgttttctgaatgagaagagggtgaaatattctacttctgtggagccaggaagcaggctgtctgatgctctagtttctctttctttctgcttctaaatagacttacccagaagcctggtactatgacatttgtgtaggtagaattgtttccatcctaaggagatatctgccccatatctatacggcctccagtctcagtgagcttagggtctgttgcgcctacatttccaggtcttcaccaaggcccctgcattggtgtttccatgaaccaagcaaggtcacttctactgttcctctttctggaccagcacttctatccatgcaacctagctcatgaagatcggttatgatcttcatgtgatcactgcactccagcctgggtgacagagcgagactccgtctcaaaaaaaaaaaaatttaaaaatttaatttatttttagactcatggggcacatgtgcatatttgtttcatgggtatattgcatgatgctgaggtttgggcttctaatgatcctgtcacccaagtagtgaacatagaacctgacaggtagtttttcaacctttgacctcctccccacctcccctcttttggaatccctagtgtttattgttcccgtctttgtgttcatgtgtacccaacgtttagcttccacttataagaatatgcagtatttggttttctgttcctgtgttaattcgcttagggtagtggcctccagctgcattcatgttgctgcaaaggacatgatttcattcttttttatggctgcatagtattccatggtgcatatgtaccacattttctttatacaattcatcattgatggacacctgggttgattctatgtctttgctattatgaatagtgctgtgataaatatacaagtgcaggtgtctttttggtggaataatttgttttcctttgggtatatacctagtaatgggattgctgggtcaaatggcaattctatttttagttctttgagaaatctctaaccttcttttcacagggctgaataaatttgcattcccaccaacagtgtgtaagcattctcttgtatgcacaatcttgccagcatctgttattttctgacttcttaatagccattctgactggtataagatggtatctcattgtggttttaacattcatctctctgatgaccagtgatgatgagcattttttcaaaagtgtattggccacttgtatgtcttctcttgagaagtgtctatttatgtctttgacccactttttgtgtgtttactctgtcactggttttttttgctgtgcagaagctctttagtttaattaggtcccaattgtcactttttgttttaactgcatttgcttttgaggacttagtcataaattctttcctgaggccaatgtctggaagggtatttcctaggtttcttttatgacttttatagtttgagggtcttacagttatgtgtttattgctaccttgagttaatttttgtatattgtgagaggtaggggtgtagtttcatacttctacatatggttagccagttttccaaccaccatttattaaataggaagtccttttcccattgtttatttttgtcagctttgtcaaagatcagttggctgtaagtgtatggctttatttcagggtctctattctgttccattgatctatgtatctatttctgtaccagtaccatgctgttttagttatcatagctttgtggtttaaaaaagttaggttatgtgatgcctctggctttatcctttttgcttaggattgccttgtctatttgggctcttttttggtctgtatgaattttagagtagatttttttctaattctttgatttctttgggcaatacgacgcattcaaaaaagacttggaaggaaataaataaaaataaaagtgatatctaattagtagaatcttaaacatctttttttacttcattttataagtgatatttaagaaacttttagtactcttaaaatagaaaataatattgaaataatcccgagggagtgtcagatctcttccttaccacctaaatcttactgctttctttaaaggatatactcatagggacttttggaaatatttaaatataagctacagagaaatgttgggtttctccactgccagactttgaggcattcactagctaatggacttttgagcccaggaggcagagagaacatgaacattctccagacttctgggaagctttatttactgaagcccctgtaggcctcgtactctctggaacatgcattggaaaatgctggtgtggtggaaagagaacaaaacgttgtggctacctgggctctgatggatgttgtaacaaagaaaggcaagctccccaaatgctcaaattgaactttcagtcaagctttatctgtctctcaagcagcaaacaatgccagttttttattctgcaagccattttagaagacaaaatgtttggcacagttgcacaggttagcatgctagtgtactgtgtacacaagatgaaatgtcttcaatttgtgttaaaatatgctttacccccttctcaaacacttgtcaaatgaaacgtagtaaaagtttttgtttctcaactacctcactgtgtaagtaaggccttagagaaaacaagctgacagaagcaagcctggttctttggctctatgggaagaatgactttcgtatcaacaatgttagaataaaatctgatcccagataaatgctgcttgctgcttctacctcaccagtttctgtcgtatgctgctgtggttggaacattttctggcaggaagaaatcaggggctctgttaggaaacaacagaattttctgccatgtgtaattcctgagcctctttctccactctgggaggtttctcaagggtccagtggccccagaccttagtcagtgttcctctctgcccacaatggccaccacctaagccatttcttggattcctttcactgcaagcctagctgcagaggagtctgtccagcttgcttccttgctgtgcccaaagccagcatacaggcccttttctttctaaaggcataatgctaattactggagggaatccccactgtgtgtaactaggaagagaacactgtggaggttatggcaggtcaagggtccttgcaaggtctgcacggtggtactccctggtctagtgaaatggagtagagtttgacactcaataggctctacttttagcttttcctagtggtccagggaggtctcttaaatcctatttcttgtcttcttttctccctggagtctcttagattcatagcagatgatatatatacccattgccacctacattttcaggtcttcactggggcccctacattggtgtctccatgaaccaaacaaggtcatttctactgttcctctttccagaccactgcttctgttcatgcaacctagcttatatatgtagggagattcacacacacacacacacacacacacaccacacacccacacacacccacacacacagctaaattaagcatttttaaagtggcagaccatactttgaggtctgcagcttaaataagcagccacgtgacaagcgtctccttcttctcttcctttcgcttccccatttacttccctctatgtttcttctctaaggaagatttaaaagcacatgtgccatcatgctcttctcccaagttcatatcagatgtcattaatcaatcatggaattttttaatcctgagtaagcccagagatataaccaaagatgactatcagttgatcaaaatgggcattgagcagtttactcctggatagatacccccaaagaaatgagagcttatttcaacaaaatgaaatgcatatgaatgtttctggcagctatatttccagtagccccaaactggaaataacccgaatgtccatcaacagttgaatggataaaaatatagtatatccatataatgaaatactttgcagtgatggaaaaagatgaactactgatacacacagtttgagttcatcttacatagtgtaaagtgaaagaagttagacataaaggaggcatactatgtgagttcatacattgcagttcaaaaacaggcagaactcatacatggtggtagaagttaagacagtggtaactgactgagaggggcactgggaagccttatgagggctagaatgtgttctgtatcttgatctgggtggtggttatatggatgtgcacatatgcaaaaatttattgaggtgtatgcctagtatttgcacactttactgtagctacccctcatttaatgtccttaaaagggggcaccaatttgaaaattattgcccagcccttgcttctatgtttctgtgtatagtttctgtttctagttctttctcctgctgtcatctgtccttcttctcctctgctgactttctttcctcctttttttcttcttttcatctccccctactcgtaaagctaaaaacatgaagtttaagtacatatattgtaaaatatattaaatacaattttacagttatattcataatttaaaagtgagtgtatttagtgtttttacacctctccttaaaacaaactctgcatttattgaactaaaattagatgaacatatttattacgtcttactggcattcaatggagtaactcagtggttcccaaacttatctgcacattagaatcatgtgggaccttataaaaattccaaagcccaggacacaataccacatcaattagatcacaatacctgggtctaggacacaagcatcagtagccattgaagctttccaggtgattcccgtatgattccaatgtgtagacaagtttggggactatagattaatggctttctattccttccatagtgtctcagctacttcagcatgtggttctgaatcttggctgcacattagaatcacctaagaagcttctaaacaatactgcttcttgggccctgttctgcataaggtctgaatatttctaacatgcaaacagcatgaagagccccgttctagcagggttgttgtcctggtagatcttgtgatcggagtgactccagtgccatcccctcaatgttcctctcaaatactttctcctcatgtttttgaaaattccagtcctttcttttgcaagcctaatatggagatgagtgatgtgatactgataagtttttggtctgtgttgctttcagtatgggattgtgctggatgcgggttcttctcacacaagtttatacatctataagtggccagcagaaaaggagaatgacacaggcgtggtgcatcaagtagaagaatgcagggttaaaggtaagatgaagaccaagggaaggggaggccaacagtggggcatgagaacatgagaggtgtatgaccagtagaacacaagagaaaaaggagtcccacgcataggaagccaagtgaagaaaacagtgcagctgctgttgttatgttatcgttacagaaaacatattgaaatcagtcgttaatgatcaaaacctaagaataaacacacataaatataattaatagtagctcccatcaacagaacacttctgcatgctatgtacttagtactgaacatgtgttacttcagtataccctcataatctccctttgaggtatgcattattatactaattttttaaaaatgagggcactgaggttgagagaggttataccacttgtttgttactcaagctagtaagtgatggagctgcggttcaaaccaagttctgcccgacttcaagtctgcatcttagccagtgcttctcaaacttgcatgagcttgttaaaaacacagatgatgggtcccatcccctagagtttctgagtcagcagatctggaatgaagcctgataatctgtatttctaagaagttcctaggtgatgctaatctgtctggttcagagatttattgctctcttaatctttgtaccctgatctacagcttggaagacatttttcaaagctttcagcttctgtgtaggcaggaaagaccaaattataggctcttagggctgggaaaaggaacttacagatcgtttaaattttgtttcacagagaaggaaacaaaaacctggaggattagtgccttgaaagtagcaacagaatagagacaagaatctaggtctcctaattacactctaggtttcctgctactctgagctgctgcattatatatcaataatttttttcttttaaggtcataatatgttagagtggttgacattcagctttcaatccctttacccagtaccctaccatgcaccattataccacagtctctctgacttttatctctcttagccttttgagctgggaacccactgtttatttttagtcagactgatagcctagatcctagaagataattgattttcagtttgacagcctgtggaatccactaattttcacaggtcgtcaagaaagtagtagagaggagatatttccaagagagcaagtcattctacccagtagccccatcaatactgacactttggccccatctgagacagtacttctggcctttcttaaagcccaaatccctcattttattggcttttatttgacacactgccttccatttttaaaagttattttaatggccaagcacggtggctcatgcctgtaatcccagcactttgggaggctgaggtgggcggatcacaaggtcaggagatggagaccatcctggctaacacggtgaaaccctgtatctactaaaaatacaaaaaaattagctaggcatggtggtgcgtgcctgtagtcccagctactagggtggctgaggcaggagaatcacttgaacccgggaggcggaggttgcagttagccgagatcgcgccactacactccagcctgggcgacagagcaagactccgtctcaaaaaaaaaaatctagcagatgtccttcttctgagacttatcccatgagcgtttggcctaacaatgaaggattcttccctctcaaaagagagagttctctagttaatcaaatatttaacaccaaattttctgaatcaaaacaattagctggtaacttagagctgattttctcatggttattaggctgtttgaaaacctgtgaatgatctggataacttatttgaataattatccttaaagcaattactctgctatgaagcactgatagtgtagatatttatcttaatgtgagatgaaagtgttgttataacttcaaaaagcttaaggaatcttggctctaatcctccatagcaacagtcggttttgctctaaaactggaaaaacagttttgctagggaggcaggatatcggagtggaaaagtcactgaagagacatagattctgttcctctttcttgtaacaggaagcaactccacctcagaaactttaaggtgctggccaggatcagataactagttagtggcagcttccatctttttagtaaaagccaatttgtctgacgcttaatttttattccaagtgttatctttaggtcttttaggaactagtgtcattaattacagtgttctggaggaaatatcaaaaagcagctaacagagtagctatctataatatccccattaaagtctgagaatgttatgcaattgaatatgaaattgcgccatccagtggcagaattattgaacactgaacagacccaacttaaagtctggaaattaaatcctctcaaggctaggtccagtgaattaccctctaagtacaataacctaatgtatagtacatcaggaaattgttttcttgtatttttttcaaaacaccatattttgatctactattgtcaaggtatgttttataatttttttttaaaagattgttatcttctacatcttttcctaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggtatagcagcatgtagggaccaagagtatctgggagttaggcttggcagtgaaagagcctctgaagttatgggaaagggccacactccctaataccccaagttctacacacccaagtccatacttaagaaaggatattttagtaagtgaataaaatgttcaaactcttagtatatataggggtaggattttatgtatgttaaaaaaaaaagcccccttgtgcatctccctatgggggattcaaaggggaaggggcacagggagagaaagactgggcccgtatactctggggtttggggctacagatttaactattcaatatctgggaggaagaggataagaggagactcatagacatcccaggtcataaatattcacaactagcacatctttatatcacttgatacctgtgtgaattatttgttcacttgttcattcattcagcatatagtgcctgctctatccagaatatgaaaactcaaccctcaaggaaatcagtttcaatgcagggtgatcagtgttttaatagaggagtgctcagagctgctatgggagcacatttggccctgcccagggtgagaggaggtcaggaagacttagaggaagggatgcctgaactgaatcatgaaaaatgagttggaggatcggggaacagctttatcagcagaacagacagcatgcattcagtaactgatgtttattcagcacctattatatgtcaggcactgttctaagtactgaggatacaacagtgaacaggacaaagtctctgacttcatggagcttgtgttctaccggatgtgcaaaggtagggaagtgtgagaggcatattcagaggactgtaagtagttctgcatagatagaagataggtaagtagtgtaaaataataatgataataatagtagcagctcgtatttattgagcccttcctatgttcttagcactacgctaagcacttaattgcactgtcataacaactctatgaaattaacaattattaacaagataaggaagctgtggcttacaaatgttaagtaactcacccaaggtcacacacctgggaagtggtggagccaggattctgagtgggattctgaaaaggaagggtccaggtcacaaagtgccctatggggccatgctaggaagtttggagtttatcttagagatagtaggaagccattaaaggatgctacacaactggtgacactggtagagaagatggattggaggggagaaaagctggggataaaaggaaggcagttagtaggtgtggacgccatttagatgagagatgacaggggcctaatgccagctggaaggtagcatcctctcgctcagagactcccagtgttgggtagcctagatcttggaagcaattgcatcccatcttcattaagacaaccctggaagattccttctttaggtctcaaggtctcaaacagacccaagaactgagctgtaatatgaggaagatttttcccagtctggcagcagaggagattggatatctattccaggtcatttgccacctggtttctactagaaccctaattaaaaacctggagcagagtctggccatgtaaccagctaggagccacccacagtggttaatatagcacacatcagcttcaggtatggtcatcaaaccatacccagctatcaccaccacagtaattttaagagcctttgataactttttgagccagggaacttcagaacaaaagtggtattttaaggaaaaccaacctatgaaaggattggaaggatgtggatttggagagagatgaacaaaatattaattctgcctcatccaaaaaaggggtttcttggacagctatgtgcgaagatccccatctcttcatttattccagggcattatggttcacttcttagtagcactgtgtggatgctgtagctgaaatgggtaatgtaatataattattaaaacaaaaatgataacctcagctcttcctttgtacaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcaggtgaatatctcacggcatccatggaggtggctctctggaggccaatgccattgctatctcaggcagtacttgggtcgctagccagaatgaatgaatgaatgatagatggatggatggatggatgactggatgaatgaatttactctcacatttgtaagggtcaccagaggtataattctcttacaagaccttctactattgggagaataaggacatgtctttaccttagggaggcataaaggaaattaaaaatttatcattaaaaattagaatagctaacatttgccttctgctatgtgtctcccgctgtgctcagcacttttcatgttttctctgattttatccttagaacaacactatgaggtactacatcatccccattttagagccccatatcgatgcctagagagggtaattagtctgcccatggctgtacagctaacaagcgactgagtgagaatttgaacttgaatgtgtctggcctcagacctcttgtttttaaacaccagttacactgcttctatgtccggcagtctgagctatgtctttgaagcccctcttttcttgctgataatctgttgtagatcaggagcctctagtgagctttgcctcacctttatgcccctgtttctttgccttaggaaatccctgactccaatagatactatgaaaagcagggtgtccagagacttctagcactggtaactgtactgtctttcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggcaagtataactcaatccagacctgcccccttcacatctgcacctccagcccccacatcctgttgttttctgtttcaaattcagtagtttgtctgaacttggttattgtactttccaaacctttttaggcaggatattgaactacatctggttgacccctataaattgtttcagtcagacatcccctcccatgtttgtttactgcgttatctccacagacacaactgagatcttctctcaggaaataatttctccccctcgtggggttgataatgaaaattatgtggtagaatattgtttgttggagggggaattgcaatttataagctcttttagaccactttttaaagctccctttcctacaaactacaaaaaaacagagttgttagaaatgacctggagaggagaaggaaaaaaaaaaaaacacttcaggagaaacacaaaatgtatcaattgacacttcaaatcttgtcatcttgtccccagatgccttctgcattttgaagacaagaaaagttaaacacactttgggaggctgaggtgggtggatcacttgaggtcaggagttggagaccagcctggccaacatggtgaaaccccatctctactaaaaatacaaaaaaagaaaaaaaattagctgggcatggtggcacatacctgtaatcccagctacttgggaggctgagaaaggagaatcacttgaactgggaggtggaggttgcagtgagccgagattgtgccactacactccagcctgggccacagagcgagactccatctcaaaaagaaaaaaaagaaaagaaaaagaaaaagaaaacaaaagttaaacatactcaacatcatgtgagtaccaggcacaccctgacaagcaaacacaaagccaggatgtcatatccagctgttccctgtctccactgaaaggataacaagttctctgctctcctccaaagcattctctctggttttcaaaaccactaccaataagatggtcctgggagtagggggcgctgagagacatccactgagcctcaaagctccactaaccttcttatccacagcagcctcctttcttccctagtaggttgtgggttagaaattacttttttttgggccaggcgtggtggctcacacctgtaatcccagcactttgggaggccgaggcgggtggatcacttgaggtccggagttcgagaccagcctgaccaacatggcgacaccccgtctctactaaaaatacaaaaaattagccgggtgtggtggcacacacctgtaattccagctactaaggagtctgaggcaggagaatcgcttgaacctgggaggctgaggttgcagtgagctgagattgcgccattttactccagcctgggcgacagagcaagactccatctcaaaaaaaaaaattatttttcttggataggagaatgcttgaagaagaaaaaaaatttttttaataatttttaaattatgtaggctcctggagaactactcccaggcccaaatttttgacaaccttgagagtttccttgtgaatttgctcctgacctagatgattaggactaagcactcagggacatttcaaactaatggcatttctgggcccagttttaactacatcagcattctttgactagccaaatacatttatatctgataccacttctggtgcctgttacacaaatccatttttcatatttattcctaagggtaaaaaggcagggcaggacatattgattccaataccaagtggtgggatgttgtacagtgcctacatattgattaagtcagactgtaccttttgtatccaaagcgttcacacatgatgctttcaagtgatttttccattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggtaagtttgtgaaatgatgaggtataggatgtcttgtttacaagttatagaatatgtgcctacaaaagatttaaataataggatgcatttttctcttacataatgtcttgaggtagatgattaggggttggttcttcagctcaactatgtcagaacttgggatcagttttttccactatcgttgtgatctttttgtgctaaggtatgttactgctccaagcaccatatcactaggtcactgcctcctttttggctctaggcagcaccttaagcccaggttcatctcctttctagtcaacaataagagtactgcctttccggaatgggggaggtcccaaagaggttagccccagcagtgtgggaaaactgactagggggttgtgcccaggggaccttgtgggacagacctcctacagccatagaacagccactctgatttggcatctcctttggccaagtgacagagcagacttcccagggctggggatgctaaatctgcctcttccttgtctctgcctgtccccagggatatctcccttcaggatgtcacgatgcttactgtgggttaagacaaagacaggtttcctgctagggaacccaggatgatggggaagctgattgtccaccttgatctcactttttccagtgtacaaattgtgagtttgggggaaattttccacaagcttggtgtcaggcagaatcgggggagaggtgacatggatgtggaagtttgattatcttcccgtctgcttggagttttttcacttctttgtggccccaggaactgtctcatcttcatatttgatttctgggatattgctggtgataatctcagtgctgtacatttgtttctggttgtctgtggttggggggcatgaagccagcttgcttccatgccgccattttggaatcagacatccaagcatcatattttctttcacatgcaaagccaaagcaggaaagatgtttaaggttttccttgcacacatctcttgcacacacattttgcagaagtgccaactgacatcttttcagatcctgctggccagaacttggtgaaatatatactctaaaccaatctgtgataaagagaaatggattaatatagttagtttagactaattattgtttatcacctgaggagtcgtttttgaggatattgctttcctctacttgggtaaaatcaggacttcataagcgaggaagaagggggctagctatggggtatgtgcctgttagagtttgccataggtggcttctcaaatgttagaaggaggaggagcagcagttagatgacacagctgagggttttcctctataaagacatttaggaagtagaaactcaggaaatcccaaagaaacattgaagataacatcattgtcattatgttttgaagagttgggggattatttgaatcctagctccaaattccttattttcttaataactccagaataagataaaatatttgagcagaggcagaagagatggctcttaattgactcagtcttcaaatttcttattttggtcccagaggctgagcattattataatcatagtttagtagcatattgaaaaattagctaccatctgtcaaatgccaattattgactatgcactatatgtatattatctcatttattcattcaagatattcaaagaaacaaggcttttgcctgccttcatgctttctcccttttcagaaaacagatcagcatgtaagaagggaggttcagctcctcccctccaggaccccagcaagagagtttctcctaaggtcacctggcttggcccaagacaaagctctagaagagaacataggcactgtcgtaatcagatctgattctacttctggcttcttatgaactgtatgagctcttcattttcttggtctctgagaaaacaataggtaatgccatagatccagacttaccttaaccatggtccaaaccacagtctaccctcccctcaaggttcctgagggaaatacatgacaagacaatgactggcagagtaatatttggttattagttggctgcaaacccaaattcagaagaaactgaacctcacttgaatgccctgtggctgagctggcactggctcttcaccttggacttttttttgggccagggcccttgccttagattgaactccttgaagaggaaggagggtgccaccttggccaagggcctttttcattccagtcactgcgaggatgtaaatctaaagtcaatgaacatacccttgtgtcttgagtttgtaacttctcagaaaggttcacttcctgggaaacatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttattctaagtataattaggagccaccaaggttttaagcaggggagtgatatgatcagatttgtttttaaaagattcctgtgactgctgtttgtaggatgggttggactagaaccagaaagctaatgtggagactaattaagaggccattgcagtatccacacgagatgatagtggcttgggttaagagggcagaaataggaccataccacgatctttttctgcacctgggatacaatgataatggaagtgctggaattcctgagttcagggcatatggaggctctccagtttctgcagagctcgacttcctagaggaatgagcataccagttcagaggctaaatgtatttataccattgctcataggggaaattgctggaaatcaggagaatatctaccagtagagagttgttgaataaattaagatacatctacaccgtagactcttatgtggccattagagtggccccagctgacttggagggatttctataaaggattgttaagaaaagcaagatgaagaatctgtttaaaatttcatttctaaaacaaaccctttatatgtgtgtgtttgtatatgattataggagcatgggaaaaatggaaggcttcatattaagttgttagtatgaactcctgttgggactgaaagtggaagaaaaaaatcaagccaaaaaaaggaaaatttattaaaaaggactaatatgctcacacttatgttattagatatatatgtataagaatattgaaaaatgcaacttttaagaagctggcactgggtttatgtcaattggaactgaggcatacggcctgtttgcagcaggaaattgcctggtggaggatatttttcctcatctctgagtcacagtgagcccccaatgggatctctgctacctcctgtttctttgcctaccaaaactctgtttctttgcctatgcgaattacactttgggaatcacatttgctttctacattcacttctagttaagtaattttacagaaggcaaattataatccccaatctaaccgtgtttgccacagggaaaactttatgcccccctcaaataatctcagtaaactatgactcagcacagtgtctagcaaacagagctcagtgtgtttgctgaatgaacaaatgatgtgctcctttaatatccaacatgatttccccctaaaaactggcacctttttgggtaggaaagaggaaaagcactggagttggggtttgaattgcctcatctagcaagctctgctcaattattttttcccctttaaattatgctctattaaaagagtaaaaaggcagttatagggtggtatgaagtataataaacattttatatgtatcatagaatgagaaagatgctagaagcctatatactatattgaatagcagttgtcactaagtagtagaatttagaggtcattttaatagaatttttttttgttttactgatttgaacttttaactttttttatagttcttatgtttgatgatgataatgatttttaaaaaatttcagttgtgtctaaaatagtacctagcccatagtagacctgtaataaatatttgttgaataaagatggattttttaaaggaaagcagtacatattcattatagaaaataggcaaaaaataagcacaaggggaaaaaaccaatttcgctactcagagataactcaatagtgttgtatagaattttccagttgtttatatttattaaacattcatatgtagtacatagtatttttaaatgggatttttgcaacccctttctctctcttttcttattctctttccccatttttctttctccctgactcttctattacaattatggagaaaagtaactgccaggtggcttagaaatgtgtgtcagcagcaaagtggctcctcttccaggaaggaaacagctcttgggcctgcaatatcactttgtgtgttaatttactcagcagaactttccaggcacctgcacaagggatgcggcctttaggagagcaagttggcatccctctgtgtggaacacagcctaaaactgcgattttctcttgtaggcattttcagctttttactttgtgatgaagtttttaaacttgacatcagagaaagtctctcaggaaaaggtgactgagatgatgaaaaagttctgtgctcagccttgggaggaggtaagtgactaggcacagcagctctaacagcatgagtgccctgtgtcgttgctgatgcagaggatgtgagtctgctctgaaactcctgctggtttgaccaagatccagcaaatgtgttagagaagaccagatggtggactcaggaatgaatttatcagcattccttgataacttgacatccagtggcttaaataagatcttatttttttctcacctaatacaaagtctggcagtaggcagctgctggcatggggtcagcagctctgctctatctcagccattgcttcttcagctctgctgttgtgcctgtttcttcatggacacaagatggtggctgtggcttcaggcatcacagccatgttcagaaaggtcagaaaaggggtcgaaccagatacatctgttcctttttacaggaaagcaaaagctatcccagactcagcagtcttccccttatatctcaatggccaggattgactgggaaaaccaggtgcagaattttgtgaccagcttagagcttagacctataatgagccactgcctcgagctgggcacattgtggcccactctcctccttcagtccccaaatcagagttctgttagcaagaaagcaggcaatttgcagagtctgacacagacacaattgtggtaaaatcctctccatttcccaggtccaagatatctcctacttattcataaacttgaagcacaatttttttcttatcagaggcactgagccattcaacatccagtgccacaagatgaaaatccagggatgagaggtatggaatccactccgattataaaagacatagctcaaaacagcagctgtacttaagttgacagttgcaaaagtgaatggtgttttcattcttaagaaatactattaattaaaaatagatgcttatccctgactgcactgacaagggggaagaaaggctgagcaagagcctggaagcttgccattctctccaggtattttgtctagaacatgaaagaaatgtggtcagggccttcatcaagagttgctcaaatatgtctcagcattttacaaaatgcttagcggtggttttttgcatctggcggtgatctgtggaggaagataagcatgttagagtggaggcaatttgagaccaggcctacatgtggctgctgaggaagcagatttaggctgctctttgaaaaaaaattacttctggtttagattaaaagttctcatcctggctaacatggtgaaaccccgtctctactaaaaatacaaaaaaaattagccgggcatggtggtgggcacctgtagtcccagctacttgggaggctgaagcaggagaatggcatgaacccaggaggcggagcttgcagtgagctgagattgtgccactgcactccagcctgggtgacagagcaggactccatctcaaaaattaaaaaaaaaaaaaaagttctgtcaggtttcctctcttatccacatctcatgttttacttcataagactatgttaggctgggaatgcttatatttagacctgtagttctgctcaggtaagtcatgtggggagttgttcagaggccctggaagtaagctaagaagggcctgcatttgggagaattcctgaagcatttggggaaggggttgcagggttagacccctgtcttcacccagagcctacagcattgaggtggatgttatgacccagggttcactttcccaagctgcatcgtccacccaggtagaaagcatagttttgtcaagtacattgttagaaggtgactctttcttctttccctcctaacttcatcatggactgctactccagtatggcttgtgtttgggaatgttcctcctaaacacctttggtagagagataattaacaatgtttaagcatgtactatgtgttgacagtggtggacatttgcttgctgtgctttatgcatatcctatcatgctgccttcccctgctttggcaagggaaataaaatgcaaaccacacctgctgacactcagtcaggtacctgaagccattgggtctctgaagtggagggaccaggagagtgagtggaagggagactccatggttgtcttctggcagcttcattagagggctagtagaatctttcagcagccagaacacagccaattttctactctgaaaatctggtcatccaagatctggtcagcccaagtgaacaatgtgatcagattctatgtgtactgatgaccagttatatttcagtgtactctggatcctcacattcagcctcatgaatatttagcctttctagggaaaggcatcccattcttgaagatccatcaatgcccctttatgtggagggcagaaagaggatatccatgaagagaaaagaacctcatcatgttccactgccctgggaatagaaaggagagaagagagaggggaaggtgggagagagaggagagaggagagtagacttcccctcccaatttggagagcacatagtgatccacccacaggcatgagcatgatcaattctggattgatgaagaaggtggatgcctttttggcttctatatttttggctactatcataaccttcaggaggccagactgcatagccaatgtacagatttccagaaggaggaggggaataggagtattaaagaattcagggaaattaggccaaaatggcatctcccagccccccacaagggataggccagccttcaaggacctacaggggctcagcactttcaagttggacctaagtagattcttgggattttgtgtcccataggcatccttcaattgacaggcccaagactacttcaataggggaggaggtcttttcacaaagggaaagcagaatgcagtgactgaaaggaaggggtaggaacctggacaggcaatgccaactgatgtccacaccaaggtctcaagaggatgtcacatgcagaggaatcaatcaaaggataatttccagaactgtgctgaaaagacaagctccaagctgggtcattctgagaatttcatcagagcaagacaaggcagtctagttatggacttatccttccagaaactggggacaggcaagaaccaagtgagaaacagaccccagccagcggttaggatttgcatatgggttaggacccacggaagggagagaaatctgggaaaagaggggtgtggtttaggcatcaaggagatactacatataaaacatctggcatagttccagatggtacatgatgcatgcataacaaatgttctctctctgccgagggtatccaggagggaatgcctatctgaagggctgaggaatggggcagcagacagaagtccaggctgaactagagaggtcctggcctgttgtcctcaaattgagggcaggagagttgcagagcaggctgtgggtatctgggtgtatattcacaacagctaggctaggtaagggcaagggatggcaagcagctcttaatatttttagtagggagtaggatgagtaaacataggaaggactcaaggaaacaaccactttgcatgactcagatgcaaaaaaagacattaagacagaagatagaaggtgagatgttggcagtgctagcagtcctcagcaaaatgctgcctaaactgtgtccacagctgtgtttctcaaactttactgtgcacgtgaatcacctgggaatcatattgggatgcagattctgaattggtagttttaaggtgaggactaaccagctcccaagtgatgctgatgctgccagtccagggactaaagtgagtggtaaggctttttatggctgtgggccaaaggctctggtcaagagcatatagaaaactcagattaaacaaagtctagggcatgaacagaggtactgaaatttagtgtttcagaacctactagaccacaggaactacttttttcctggaggacctgttattatctcatagaagcctgtgcaggaaaagcttccttaagagaccctaaactataaaaccctgctcccactgaaggagtgcagcaccacccccaaaaccctctggaagaggccaaccttcaggtgcactggagctggggctttcccctctcttcatcagggctagtagagaaaaagagggccacagagaggtgcctatcatacgagtatgatctccccctcacttcacttctagataaaaacatcttacgctggagtaaaggagaagtacctgagtgaatactgcttttctggtacctacattctctccctccttctgcaaggctatcatttcacagctgattcctgggagcacatccatttcattggcaaggtaatttgggggcctgttgggctggggggaggttggggttcggtggtagtgactgaagcagtttggggcttgaaaaaggggggagtcagcatggtgtagctttggcttgatgtcctgttctgccattctgcttcaaaccctggcattctgtgtcaagccctcctgggtctgttggcccactgtgagcatcctcgctaaggacagctacttgcattttcagttgcaccttcccacataacagtgactaattccttacaaaacaaaacacaaaacgagatatattaaagtaacagcatttcagcagctacagtgactctgtgtgctgacttcagcagccctctgaaaggccccttccataagctgggaaagtatgatcatggtttcatcatccttgttggttattacttcaaggttgaccaatctgaaagctctgtgtgaagaaggggactgagtggctgtgaatgatgagaccgttgtttagaagccaggcttagcctgagtccggaagaagcaacctcaatgctgtgctttaccatagcaccacctgcaggtatccaggaatagagaacccagctgagcgactcatgcttgaccaaaaatacccagagcagtgtgtctctacctttttaagcccatgctcactagtggggaaaacattttaccccctgtattaaatatggtgatttcaagcaaaacaaagcattgagacagagggctgtagcaggcctgaggataacagtgtccttacactcttgtcagtgctgatcttgctaattcaaacttaaatcttttccttgttataatattccagacttcctttaattccagcagtttattttgtttgaaagattatacctatgtcaaatttaggactgacacacgaggtagtcatgatgtatgtgtgtgtatatactttttttttaagagacatggtctcacgctgtcacccaggctggagtgcagtggtatgatcacagctcactgaagcctcaaactcctgggattaaatgatcctccccacccaggctcccaaatagctgagactacagacatgttccaccgtgcccagctaattttattttttagagagacagggtctcactatgttgcccaggctagtctcaaactcctggcctcaagtgatcctccctccttggcctcccaaagtgctgagattacaggcatgagccactgtgcccagccagtgatttatattgtttgaactcttccaatgcatgatccaataattctaagccctaggtgataactcttctaactcctccaaccacaaacagactttccccactgtttgcagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattct

SEQ ID NO: 13849 - DNA, 86945 bp, Human
  misc_feature (1)...(86945): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcaccgtgagtacccgcgcccggctcctgtcccggctcggggctctccgtcccaaccctgtccagtcccagcgtggccccggcccctcgcgctcaggtcccatcttggaggcctccctggcttctggtccctcttttcgttctttctctccctcgcccggtgtttctaatgcctccagtttctctcctgccttctgtcacccattcttacctctctgtctgcctgccttcctaccttccctgatccctatcacctgcctttgctctttctatccgctccttcttaggtcatgggatccacggcctcggagccctggttccagccaccctctccctagtcagcctcttgccctgggctggggggcaaattagcaggcagttttcagggtgttgttttgttgttttctctgtcttttctctctttctctcttcctctgtttgcctccctctcctgtctccccacatctttatctttctcaaacttaagagtcgtggggtccaggagactccaagagtattcagcctcagtgtcaggacaattgggcagaagagtgtgggggtggggtgcccccttctgaccctcatctctcagcatctccaggcccttccagcccagcataggcttcttgtgggttggtttgaaatattttcttcctcttcctttctttcccaccccccttcccttgccttcccttcccttcacattgggaatcccaggttgtcaagacacgatggtcatctttccctgcctctgcctgggggatgctctaaaaacaaagaggggctccgagaagaaatcgaagtcagggagagagccagcagcgcagccttccaggtgggcccccggcagagtgcagctctgctctcagctctggaggctccttgcctagactgccgactccccattgaggatcacgcagccagcaacctggccagggggtcagcaaagagcaaaaaatgagggggaaagaacaaaaggaaagcaaatgccaaagctgaggagaaaggaaaagagaaatccaaacacgggaaaggaaattaaagaaagaaagttgacatgatgttacagaagaaaagggagaagggagaaaaaaatagagaaaagagggaattattttaataaaatttgaatttatgccatgtctttagcttgaaaaactattctgagattttttttgcaggctttttttttttaaagctaaaattctaaatagaaaactcctccctatctgcagattaataattaaggataatttgtaacttttcacaaggaaactttagacctggcttggacctgtgtttaggacaagagagccgaggagggagagctgtgtttttcgctaatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaaaggtttctgcacggccaagcagaggtcggagggagagagccgcagcgcgggcccgcgggccggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccggtaacgcgagttctcccggggcctaaattattgatggtcggggtttggagggaggggagggtgagaagtggggctagagatagggagattaacggggtgggcaagggggtaaaagaagaggcttcagtctctcccagcaacgcgatcagaggtctttccccagggtttcaccgagcttgctctaggtaccccccgagaaagggaggggagagaaatgaggggggcacagatgtccccgctttctccgaaactcgcgtgaggctagcggggcaggggctgcagcttgccagtccgggccgacccgactcggccgctagaagtctctgcgcttggattgctcagtacctgcggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggacgcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtgagggcttcgcagctgtcccgggagacgccttgcctacttccccggccagccctgggtctccagctggaggacgtggctaaaagtccagcgtgccaagccagagagggagatccccaaaggggtctggagaggtgctccttttggagagagtgttcagatggtggctgaagacccaggagcgagggtggcgcagtgtcacccagtgcttgccctgcccctggtccctggtgagaaggcagcccgtttctggcttcagaaagggaaggatgactttcctaatggagttaaggcagatacggggtgggagacattagaggaatggggggggagtgaaaatgggtccccgagaggagaagcagcagcatttgggaggcagaaggagggtcctggttcccacagatgctctgtgcccagtaggaaagggctcgaggtggtgcctcaaccctggcctcccagagaccttgcagcgctgttcgttttgctcttcccaagtgaaaggctgggctttcactcccacgggtgcctatttgggctggtgcgaacccagcccctggtgtggccgtctccctggagggatggtaccccttgtcctcctactccgcggcgctcctcctagccaggcaccctcaggaagtcagctcagccacactgggccttttccctccactccgctgcctcggccgggcaggagagtggctcagcagctctggaacctgcagcccccctgccccgccacagtccgcttctggctgaccccgccggctttcccggcgcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacaggtgagcaagccacccgggttttcagggctggactccagctcctggctcctgcctgcaggggtgtcccacgcccagtctctgctctttgtccagcctctgccctttctccctgcttccagccccaaatccttctgtcagagaaagggaacctgtgaggcagagagttagacagacagacagggctgtctgcagttcagggctgggtattccctgccaggcttctcccgccggcgtcctggaaatgaatccaagtgtttgtggtaattaagactccaagattacgagcatccagccttgggatcttgagacaatcacagcctgcagccggagcctttaaaatgaccagtgtctattcatccctccaaacagactggcctttctaaaggctgctccttccccaggggccgccgcttgtcctggctccctcaccctccctgccaactcccacaaagctcacctcccaggagtctggtcttgctagccagctccacacaaatttctggcctgtaggcactgggatccgggcttgcagaacaaatgccaaccaccagccagcaactggcagggagtagaggagctggacaaggagggagtgccaagcagggagggagaactccagactttgagactgaaccttgggtgataccctcaaccacctaaggtgcctgtctccaggctgaagtctttgcactgatgacaggctcacacacgtgaggacagcacagggctgagtcagcttgacgtgtaggatatttaggtctcctggtctccaaacccctccagtgtgctctcggggagaacacatgtgcacactccatgcatgtccaccctagccagtgtgccaatatgcctatctgtggtagctacagaacatacaagcagcactgggctcaggaacccaggctggtttcaagatcacagaactgtacaaactgacagttgttcacagagtccctgcacaagtcacacaccagccttggccccccattttgagacaccccaaaatgaaaagagggctaagcagttcatacctttgttattttttgcattcttcataagctcattatcagggcaactaataattcacatggtgccttattctgaaattggcatcacatataaaggattttttaaatattttgcaaatgatatggaattatcccaaatcatcctgaaaacagcaggtaaaattagctggtagaatgtaccttggctaaagaagattccctctgccacactcgtgctgtaatgtactgcgaggcgaccccagaaattatcccagtgtgtgccatctgtattaaaatggttatccagttatgaacagggtaacataatactgatcagctaattatacaccctccgaaaaccctccagctccctcggcctggctcagccaggtattgaaagcatagcgatttgacattcagataccttccaaaggagctggagaaagacgctgggtggtttgggagaggaataagccctttgctttaaaagccaggagaggaggctggggcagctttgggctgaggcaagagtggcacttcgggaggggaaggggacaaagcattgttttatgagccatgtagagactcagtctcttcgctgattgctggtcctgggcatgagttggaactgagatctcaagagaagaacagccaagggccaagagtggccctgctgtgtgcagtgttgctgggactgggtagtggtcttctgcagaacatttaagagaaatgcttgttgtcagtaacagaattttcaagcctttggagaaacccaagtcatgtaggatttaggtaatttgtttctcttgaatggggtagaggagtggcgcaacaagtcaggtgtggtggccccgtccaacaccccctgcccctcccctcaacaacatgcactcctcattggctgagatgattttggaagctggcttaggcataagtttggaaatacttctatcctgaaaagccatggagaacaagggccaggtgaccctaggatcaagctccagaggtcttgaggtgcacccaccagaattaggacaaagtagacaagtgagccacaagtgagatgagggtggggaaagagtagcctcagcttgacagctgtgacagctgcagaacctgcccagcacagagccctatcacctgaggggcacacaggcttcctttgggtgtggagaaatagccatctgtgggcagatgttgctggagatggagagggagtaggaggagaggaacaggtaagccaccaacaacacgggcagcctaccctgggtccgtagttaggcttcatggctggctttgtctacaaggagcaggaaaactattcccaattttgcttttgtccagaatcctctcatggttcatattttggaaagaattctgggggcttccctgtgtgctgctgagttggggctggagaaatccacctggggaaccacgctctcatcttcatccctgtaggtgctttttgctctgaagagggaaggtttatctgagatgtattgtttcacccaaaagcctgataaaaacaggatgtttctgctagtgctggttatatcagaaactttgccttttatcagttctgggaattctcactcactgtaggaagagcccggagattttcctgtgtgcacaaagtgtggtgcaccggggaacgggtggttcttgagtttagagctttgttggtagtgacctgcccacttgtgttgggtactttataacagttatgagtaaggttgtgcatgagctggtggttggcaagaaaagaagtccacacatgctcacccacctgagctagtggtttttcatcttctccttcccaaaacagatgctgtcgccacacttgaaatatgctgttatggttataaactaaattgcttttttcactctttaaaaatggttttggcattctctgattctgttgtgataaaggcctggccatccagcctgtattctccactagcaaatcctcagaaatgcctctctgaaccagaggactgggtcaggaaggcctccccactgccacaaaccacgttcaaaaatcccaaggcttgactgggctccttagcatgtggaatttatctgaatctttctaaacattgggttaccaatggctgagcatggagttgccagctttttggtttgtacaccgctgctgtaaagggcaggtgtttataaacaggggactttagattgaaacctggtgtgggacatggcctggagaggggagaggtggagggagatccatgctactgaaaaaggaaaaagtcgtctagttacatagctgagcaattgtctaagcaggagggattttcctgattatatgccaaaatcttctggtttggctgttactctgggcagagaatacacctcctttgaaagaacaggcacagaccccaaatagagtctggggttactgacaatcccccgagggtgctcttttgggaagagctgacaataagggtgtcaccttctaacttttttagcttgcctaacactctttggagtcagggcactctctgcccctagatctttggagtggaccctggcagaatcaacttctcacggatctcccactatccacactctctcttagcctgttaggctctaggtgagtacattcattctcctagcagtggcaacccagggctgtgttaaggaattccatcctgtatcatttgggtgtccctcttctgtcattctcaggtctttgagtcattctcaggtcattgttccccttgggtcaggcagtggggtgacaatggtctactagttgttcgttcaaagacctttccaaataagctgggagctattaatcctagccccgtgaatgttgaagatatgttccgggctagggtctgtttctccctctctgaaactcaggttccagaacattgcctattctactcttggacctggcttggcatgaagcttggccagaggggtggtactgcctaccacatctccatatctttgtagctgtttggtggtcagggctgttggtctcatggcaaagagacagggcaagttggagagttcagaaaaagacttctatccacagaggaatggcagaaacaaggacagggaactcaccttctgtggcctgagcctagcagattgggcccacaaatagcagaccaacatgccaatttctgtcagagaagcctcgctcacctgtcctttcccagagacagtcccctactgtgaggttacccatcattggaataacatttgaaacaggcatgatggttgaaattctcattccttaaaatgagctggagttgtcctcctgaaaagcctctttttgtttttgtagttgttttagcctgggcttcctggcccacagtcctgttggtctgactgtctccctgttggctggttctgtgggtgttcaggctacaaaaggggtttctggtgagagcaattgctgcttgccctgccttcctacctcagctggcaactctcgagaagaggcagacaggaggcactgggcctgacaacagctccaggtgcatttcagaaggtgacgcaaagaagaaaagagagggaaaacccaaaatgaataaataaatagtgtcccaactgttctgagaactcaataaaacaatcacatcaaatatgaagaggcataaatcttgtgtctgcacaggtaacctactcaattgcttttattatcgctcaggctgcctccatttattaccgttcatggcctgggcaaaggaggctgcgtggagggtggtctccagtgcaatcctacaccctgagaggcaacaatcagcccatacagccagagatttcgatgggagcccaggaagggcccatctgtctgcatgaaaaccaatcaataactctgtaaccagagcccttgtcacagggaaatggacaacacaacagttcaatagaggggccacagggggaattagccaagtggagatggggccaaacaggagcagcccctagagaagggaaacaggggtgcctggagtaggggagattagggaaggggtggagatgtggcaggggagagcaatagcttcatatgcatgttggtattagatggggagtattgtgcaaaatagacccagggaatgacaggcaatgttggaagttgaggtggtagggaacatgtgttttggacagcatttgggaaatgggcttgttctggtgcacatgggagagtgtgactatgcatgatggcatgtgcttgcggactagaatgttacagcttctacagaaagaggaacaatagtagtaactggtgtggaagattaatcacactccataccccctaaaacccctctgaaaagggggttcctatgagcccacatgggataggggtcctgcttcccagtcttcttagcaggactgatgaaagagccccattgtccgctcccagcttcttaggtgtccaacaatagctactctgcaggttgcctcttaatactcaagtctatcttcaccccctccttgtgtctacctggaattggagtttttatattaagaagagaacaatggtgtaaaagtgacaagcatccagtagaaatcatacttcaagtacccaaacaaccattctgtttctcactttcaatacagtattcaataaattgcatgagatatccaacactttggtataaaatagtctttgtgttagatgactttggccaactgtaaatgttttgagcatgtttaaggtaggctaggctgacctatgatgttccatagattagctgtattcaatgcattttcaacttacaatattttcaacttatcgagccattaccctgttgtgagttaaggagcatctgtacactgaaaataatttatttttcacttcctgtcctttaaaagaatgctcatccgacctgccagttctctgcatccctgctgtttcttctcacacttcccccgcccctccaagccaggtgtccagagctcagattcttgcaggggaagcagcttcaggtgcagctatccccagtgcagctccccagccatgcagttgagtccagagaaggggaaagggctcctgaaactgagatgtgggaaatagagtctcacaaccaatgcccaaatagcaagtgaaatattagacagctgaaacattaaatcacgtttggtttttctatctaccactgaactactaggttgagatggttttctcttgtggaacaggctatttgttttggggctagcaaggcatggcttgaatatattcatgatggtttgcagtgtagaagttgatatcttctgtgcgtgtggatttgtgtgtgtttgtgggtacctacctatgtctgcttttaggtgaaaaggccctgaggccaagaggagaaaagggaggaaggctcacaggacatgacctgcagtcacaggcaaggctggacaccttgtacttgggccatcagatcaattggcaagtagtcattgggccactgggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcctcctcctcgttcctcaggttagctggtttgggttagggggccaatctcagaagactctaattaaagagtgaggagaatctgataagataaggaaggccatccttcctctagggaccaatggaggtttcatgttcctcactccccgctgcttctctgaggagctgacactagggcaggcagccttccgactgtgactgtctggagtctgggagagccagagagaaggaggtgtgactggggttgggactcgggttcctacccatttgcaatggtcctggaagggaaaacctagcagactccagatgagagcgaggggagggtagaagagagagtgcagaagtcaggaagagagaagtgggagccagatgtgatcaacacagatatgcctcgctaagtcctagtttttggccacagaaatggactgtacggggtggggtgtggtacctttttttttttaattagggaaggggctatgaagccatttaacccatctttggggctgagcacttagctcctgcagagagtacagccctggttagggttcagctcctcctagaaacaatgctcacctgcgctctcgaccctccgccctcccacctagcacatacacttttctttttccccaccctcgtttcctctgaacttggctctgtggatcaggtcactcctggccccatggagacagccaggaaggccatgcagactcccttaggagatgacctcccagggtgggtacaaaaaaagttgagagaaattcatttcatggccagtggctgcttagaaaaggcgattccagcatccgaatgtgataaatgctaactgagcattaatcgcattaaagagggccctataaacttttcacttctaattaaatttgtccagtggtgctgcccaagcgagtactctgggcctttgtttatgtggaaaattaaaatgcaaatacaatgagatttatttccaggagtggagtgatgggctggcccctctggctactggtctccaggcctgtcaggtcaggtgactgcttctttggaggtgctatcccccttgtgacagattcttgtgtgaagggagaggccagagttcaaggtcaaatagagttagtaaatggggagaagatgtagaaagaattgaagagaaggagaaaaaggcaatagattaccaggaatatagggagacattattctggtttcccaccctccttccccaccaactcacatctctaggggtatagacccccaaaatcttacttgttaatatcaccacaagcctcctctgaagctatgagatgaaggagtacatgggagagagaatttggaggaagcagccctgccaggctcggcatggcggctcacacctgtaatcctagcactttgggaggctgaagcaggaggatcacttgagaccaggagtttgagaccagactaggcaacagagtgaggcccatctctattaaaaaaaaaaaaacaaaactaagtggccatcaggaagggtcaagggcctggatttctctccagcagtttgagggtcatctgctgtccacaccggggtttcactgggctcttcctgccagttccaagtggcattgacatggggcagtgaagcatagaggcacaaaccaaggaggacattgtgcatgcacgcctgcacgcacgcagccttcttgcacataaggagagccggtttctcataagaataaacaaatgtcccttgcaaggagtcatttagtgccgtgatcccttgataaaagtggtaatcctaaatgctactgaatggaacaatctaaatttcctatttactgagaacataaattaagtcgaggggagagaaaacctgcataagaaaaattagtagggtatatcagttagagacactgaaagatagctatgctgctctctggataaggaagttgtaaatagcattaaaaagtcaagcaggaaaggaaatggaggtaggagaaatgataaaagacagagcactaaatcacaaataggggtacatgtacgaagtcacaaaccggctttatgccaagctttgcagaatccacagcttggactgacaatacatagagatgctaaacacacaggcatgcagacttccagagagtgtcagtatgcagagggtggattggtcgcaccatgggcaagctgttgtctgtgctggactctgggattgatccatcagttcctccttgcagggatctgattgggtacagttcggtaggcagtcgaggatacagctgtatgaggtttttaaaggtctttaaacacatgagtctcttgtgagctggatccaccttctaatggatctccaaggtagcaacccattcccagaacactgcctgcttgactggttttgtcaaatagctgctacccctgtcctcctttttctgttttattctgggctactcttttcctttttagtgttcacttatgcctcttggaaattcatgagcacttgctgacaaacaggttaatgactgtggcaactcccaaacatctggatggaaaccaaaacttcagtcaatcatctataaaggttgtcgatatgatgccaaagatctggcgatttagaaatgtccacataattgattgaatttctcagttttttatccaggctcagaatcaacacattgggaaacacctgttttcagagaaaaatattccaggaaacaaagtgttctcattagaaagcatctttgatgtgttcgagtctgatttctggcttgaaaggaggctgggctgggctctaagtcagatggagatctggtggttagagtagttagtattggaacgagcacagctggtgagaggtttccttcccccgaaagttggccaggagggtagatcactttgtccaaataagcttaggctgcctgttaggcctggtttctctaagggagtccattttgccattttaagggagactgtcaggttcttaagacatgtggctttttcttcatttatcttttcattcatccattcagaagcaagtaggtgcttgctaagcacctactatgtgctaggcaattcacataaagctatgtggcatagtgttagaaagcaggctctggggagaaactgccagagtttgaagctggcttccctactcactggctagagggtactgggtccaccttatatcctctgtgggccccagtttcttcactcataaaatgtgggggataattgtgtaggtctctcataagttttcatgagggttaaatgagtgagtccacataaaccagcttagaattgcacctggcaggtattaagtgctcaataaatgctagttattattattgcagtagtaataatcaagtctgtatttcttgttatgcgtctatttcagtgtgtatgcattctgctttgtgtatgcacaaacattgaattttttttttttttttttttttgagaaagagtctcgctctgtcgcccaggctggagtgcagtggcaccatctcggctcactgcaacctccgcctcccgggttcatgccattcttctgcctcagcctcctgagtacctgggaccacaggcgcccgccaccacgcctggctaattttttgtatttttagtagagacagggtttcacctgttagccaggatggtctcgatctcctgaccttgtgatccacccaccttggcctcccaaagtgctgggattacaggcgtcagccaccgtggccggcctgaaatatttttaaataaaaaagtttgaagagccaaaaggatattctgtgaacagaattgtgtatcatgaatgccagtgagaatcatggtccctcgtgagcccagatggatttaggaaggggacccactcagtgtatttccagaaaaaaagaccctctatgattcagtaatctgaccattgagcagaattagtcagataattgcccctttgtcaactttgagagcccagaccttgtggctgtgtgtgtgtgtgtgtgtactttgtataactacacattccttctcttggaagcctgctattgcttgaggaattcaaggttggcattttctaggcttcatggcattttcgtaggttgtggtgctttgcattttgtagtttttttaaaagataaaatgaaatggtagtggggaaaaagtccttatttgatgcatttgaagggttccactgattcttaaatgtcatacaggggagaggaaagggaggtaaacaggaagaggaggggaagagaggagagaaaatggagataagacaaaggaagaagaaagaggaaagggagaagtgagcaaatacttaacaaattcaaatgaaatctgtctattcttgtctggcatgtctggatattctaaggaagtatgggagtttgacaatcattgcagttatttccattgctaaggagtaaaagtttttaagaaaaaaatttcaggaaaaaattactttgggcttaatctatttgatgaatggctccaactaactggacaactgcaaattctatttattctttgcctgacaagagcaaatatgaaacccagtttcccaaactcatgacaatgtgtttctcatctttatgggaacttccatggaacaagactgaggtgcaatcccattcttgcctcaagttctccctgcccctttggcttagttaggtgaccaagttcagctcaatggatggctgtaagacccacacccaaatacttacagagtcacttatctgataccttttataccttttgcatcattctcaaattcctagatttcattattcgtcatttatgcctattagctggtaaaggttctgattttcaaattagaaagtaaatgtttttaatgagcaaaattagaatcctgaaagctcaatcatccttacatttttcttgtagtacgaaacaagtcaagggctgcctattcattaccagatgcagggccagatgctgccctctgtgtggacataggcagtggtgagctctgtcaatccccagcccctgccactgcccagatggcagggagagaactaccctctgcccctgtgctacctggctgcaatttttgcacttctctgcttaaaacacacacacacacacatacacctcttaatttgtcttaggattttatgtacactagcacacatgtgtacatgtttatacacatacacaggccaatcttatggctgctttactcagaaagcctttatatttatcatcatcatcatcatcatcatcatcatcatagtggttaacaagtgcttactacagtaggaaccgttacaagcatgtttcatgcattaattgatttaagcatcctaaacaaccccatagggctttataggattgttatagatgaggtagctggagtacagagaagttaaataacttgctcaaggtcacagactaagtagcagaagtaggatttgaacccatgcagtcctggctctaaaacccacatgcttatcccctatgccatacttcatatctactttggatcaagggaagtgcaggcacaggcaatctcctggggaactctgtatattttgcagtctcttacaagctcaaaacaggaaacctgcaccctagcagatggtcacacctctgtgtatctctgtactcttccatggtgtgtgttcctcagtgcaggccactgctgagccacatcatctagagatactgggaaggaagaagatactaatagccagagccacagagtagagtggaatggggattcttggaactagagtttatattgctgttcccattgggattggcaagtttactcccgtccatcctcctccagctccaacagggatctagactctcaattggcataaggtttggactaggggcttaactctccaaatcaggcagacctgttctcgtttggtaaagtcgtaactgttcagcagagcagggacatttgcttccaagaagaatagaatcgtatttttggttatcaagaagagatttgtcctgcatctctagaatcttccttctgaaaagcagcagtgcaaatgaccaggccagagtaagctaaaaaagctaaaggatggatcctctcacccacaaccacaccaagaaggcaattaaagcaattaccgaatcatacaccatcacccagatccagcatcattactcaacccacatcaccaaggagacacccattaacctaatctctgagacatacattagggaaaaaagatgctgatatgatcaatgaacacaataattcaaagcagaaacacagacactgccaccaaacaatactcaaattcctccaactcagtgttacacaaagtgcagccacctcaatacaataccacaaaacaccaagtaacaaacattaagctagctgccggaatgcgtcaacacaatgcaataatacacggtaatgcacaacacagttcaaactctgtatcccataggcacacccatacccacaggctgaaatcatgtggccacttgagccacatgggcagacacacacagagacagagccaatagcgcagcacccaattctcctgcacacccagcagaaaacgatcacagctgcagtcctcccaagcacgatgcagcctgccagaaagcagcagcaccatgccgtttctccagcaggtggacgtgtccagaccatcacctctaataaggcctctgggctctcattgctagtaagagagtaaactgtcccctgagcctgcttcccgagacaggacaattcagttctatcctggttggggtttaataagacttcgctgttagtgaaaatgacagagctccagggataaagggaaaggtggtggtgggaggggagctcactaagctgggtgcaggaattccccttcctctacccagccctaccttctgtggccattccagagccaaagccctcatgctgggtgttcacggagtatcgattcagtctgcaagcaattttgatatttcttcagggactttccagcaacagcacaagtcattaattcaccctcccaaattgcttattcaatagcaggaacatggctcctgaataaagtcccagaatttatgtgactcgcacgagtcaggaggtcaaacaactgttatggagcgaagttaaaaatccaaataaaatattgacacttttttggggagggggaggtgggaagcaaaggtatttaaaataggtttttgttgcaatgcccccaggataaagaatggaaggagactgaagacaagttggagtttataaaatcaatggaatttattgcacagctacttggcatttaataattctctcatttccacatccccctcccccaccccatcctggccatagacagagagatacacaggtatacaaatgcacatttttgtacgtcaatactggtgcatggaccaatataaaaacacgattgtgatgtgaaaatctcaaacaccccaggaagggaacaatgatggtgtagagtctcgctgtagtttacatatttgacagaaatgggcataacttggcagatactcatgaagcaggttttgataaatatatccactattataaatcttagatcaatgcattggagcagacctgaatataaagataaactaatcatagaaatagattctcaaaacagaaattgagaaacacatctatatgtagtatcatcctgcaatcatgtacatgatttggaaactagatagatgaaaataatttggaaaatttgccccccaaacctaccagtgcatataaaattcaccgaagcctatagcagcttaatctaaaattgtgatttgttagtaacacagacatgatgcttatcaaatacagctatggcacatgcatgggagaggataagcgtgtttaaaatcacagctacctgtgctctctgttaattgtctacatatataattgctcaattttccaaaatcatggatatgaaaaggctgaaggaaaaatttgttcatgtccaaatagttaataaataaatatatatataaatttcccaaaaagatcaactgattcagcctacagacattgaagtcacaagcctggatccaatgtcgggctcttacccgatgcatatgtataattatatgtcaattgaaaaaaataaacaccaaccaaacaaacaatttctggctccaatgctattaagcatgtgactttgggcaagttgcttggcctttctgttgtttcttaggcaaaatagagaggatggctatttgatagagttatagttgaattcgaatgagaaaacacattcattataatgcctttcatacagtgaatatgaaataaacgatagttattgcttttactattattagattcagctcttctattcaggcctagcctctcatagattctaccatcggttcttgatatgactgactcattctactcaatggttagccgcataagttctagagtgagacactcaggtttaaattctggctctgttacttaacagctgtgtgaccttccgtaagttacctaacctctctgagtctcagcttccacatctgtagattatggacaataatcttcataggtacttgtgagaattaagttaaataatccatataaagtgctttgcacagtgcctggtacatagtaagtgtatattggcccactgtgtcccttaagattatgtcattgttattattggccaggtacagtggctcatgcctgtaatcccagcactttgggaggctgaggtgggaggattacttgaggtcaggagtttgagaccagcctggccaacatggtaaaaccctgtctctactaaaaatacaaaaatgagctgggcgtggtggtgtgcacctataatcctagctactcaggaggctgaggttgcagtgaacctgggaggcagaggttgcagtgagctgagattgtgccattgtactccagcctgggcaacagtgtgagactccatctcaaaaagaataaaataaaataaaataaaataaaataaaataaaataaaataaaaaaataaaaaacaaaaaacaagagtatattattgttattattattaataataatattcatttgttattgaacaaatagctatcaagtacttacattataccagacaccattgctaggtgctggggaaagacagtcgtgagaaaaatagcagacatctgccttctcagagcttggaggggtggactctatgtgaactgagtaagcaagaaaacaaggtttcagctctgtgttagaccctgagaggaagagggaaacagagagaaatagattggaaagctaggatagagccagataagggaagattttgaaggccgggctgaagaattctgaatttatcctataggtgataggaagtgattgtagggtttagccagatcacattctttcaggagacagagaaagactgacggactgtttttgaatgcctgagtaggcgaaaggtaggaaaggctagaggtagggaggccaggcagtcactagcgggccctacatctgctgctgctcatgtgactgcagagggaggtgagcatgcctgtggtgggacagggttgggggatggacaggtgcagagtgggagactttatcccagcaatgaatctatagcagtaccttgttcaccttatatcaagcagtcttcaagcctctggagcttcccaaacaggatcatgggggtggacagctggtagattccagctctagccagaagctctgacagatgagggcagggccagtggtgagaggcgctagtctgtcatgctctgggcttggcatgcaccacagactggtttccaaatggttagttaaacacattgccccttaatttttaaacctatgcatatcttgaagttaaatcaatccatatgcttagcattcatcatataaaccatcactattgcccccttgggccagccccatggcccatctagcctggtaaattgtctctggcctgggctctcaggggcacgtggcggaaagattatcgccctcaatgccagtcttggaaggctaagttgatgcagaatatatgcctggtatctaagtaacccactgggaatttatcatcctggaatgtaccaaaaaccattttgaaattatttcaatttttaacctatggttttgtttccacagagcaactgatagcttattgaattttggtgactatgtcagctggagtcagggttaatagatggagagaaatgtggatcgatagagtatgagaaaggaactttcttaactcactaagacttattcccagctcttccaaggatccccttgagaaaccaaccagaaggatggtttcttcacctcctggcttaagctagtcttctcaaatagagttcagaaactctaattcaggtctaagatgggacccggtgatttgcattttagcaagcaccccaggggattctaatgcaggtagttcaagggcagtagtttgaggaaacccttctgccagctttttggtaggactttcatttcttggagctcagctatgacttctgagagtcaacaagagttgacacatttgggaagaaccctggtaacctggaacctgtgtattccagcaacatcctgccacagccagaatggaaggtcctgcccacagctctgaagaatggcctggcccttatcagtggccatgttcagaaccctgcctgacatatggtcagttatccagactgaaacctgcagggcatatgagtgagcatgggcaaaaaaacctctaaactcagcccaaactgcagccagaggctacaaaaacagtgtgttaagtgattcaggcctgccttaaaggaagccacgtgcaggagagatgctgtttcctttgtgtttctgtggagagcaggaagtaaatttcaatttttcagttcctggggtatacaaagggggagactctagttccttagagttctcaggagtagggaccatttccaggagaggtaaacatttcctgggtgatctatgacatctcactcaaggttctgctgtgaaaagtctcccgctgttagtgttgctgacttgcctcggggccaagccatggatacgtgcctgatataggcagctctcaaagacttgtgttgaagcaataaccacctgcattagctgggcaaaatatcctttgctgaagcaaatatcttctttttttttttctaagacacagtctcgctctgttgccgaggctggagtgcggtggcgcgatctctgctcactgcaactttcacctcccgcgttcaagcaattctctgcctcagcctccccagtagcagggattacaggcatccgccaccatgcccggctaatttttgtatttttagtagaggcgaggtttcaccatcttggccaggctggtcttgaacttccgacctcatgattcacttgcctcggcctcccaaagtgttgtgattacaggcgtgagccactgtgcccggccacaaatatcctttttaatatcttttttgtgtgtgtgacagagtctcactctgcagcccaggctggagtgcaatggcaccatctcagctcactgcaacctccaccgactccagtcgtgggttccacttcaccactgcaatcgtgggtttgagagattctcccacctcagcctcccgagtagctggaaccacaagcatgtgacaccctgcccggctaatttttgtattttcagtagagatggggtttcaccatgttggccaggctggtctcgaactcctgacctcaagtgatccacctgcctcagcctcccaaagtgctgggattataggcataagccaccatgcctggctgcaaatatcattttgttctctaggatgattgagtttataatgcccaggcagtctgagaccactggcagaggcccccatgaccactcgtctggcttagtgggcaatggggccagctagtctggcacattttctaccctggagtgcctttgatttactgaatcaggaaagaccctccccataccagggattaaatattttctgcaaagactctaaagtggacagtttactccaggacaatttaaactgatttatacatgtatataacacatatatccagatacttgacatcttgctcctaagagcagcctgcctcaagcctggtcatgtcactggtttgttcaagctctgctaggaagtaattttgttcctctagggaataattctaaaattgggaaggaagtctgttctagacagcaggaaaggatttcatggtgacatacttggagatccaatgtacaggggttgtcagcaattgggtccagcaggtgttaatactcccattttctagtgaggacaactgaggttcagggaaacctctcacccttcatttctcagaagggactgaaaatagaagtttcaatttggtgcctttgggtgtctctcccctggaggcagtataatttagcaggtaagggattagtccctgggattagtctatgtgaattcaaatcccagatttactgtttattaaatgggtgactttgagcaagttgtaataagccttatgtgcaaaatgcgttgttgtaaggattgagtgaactatttatttgaagtacatagaacattgcctagcacatagtagatactcagtagacagttttttgtttttgtttttaaactggagcctctcctgaggaagcattgctcctagaaagcctgcccagcctagtccagtaaatgctgccacctcactcctcccaaggtgagctgtctgaggtcacctcaatgctaataggacctcttcttgtctccacctcagggagtttttgcacaccatttattatcatataatataatgcaatataatatcatacataacataacataatatgatgggtaggttaacttggaaaccctgaggcggacagtggatggatggatagatgaatagatacatttgtactaagtatacatacattatatcattctattgatttgtaaaaagttcccggtctgcctggctgtaatgagatttttgaactttgcgtggcgatcaatgagaggaatattattggcctggagaattgatatacctgctctcagtggcttgttctgctcccaggctgccccggccccccaggtgtatgattccagcagacacttaaccttttttacagtgtcatcaggctaaaaggaatctaatagtgacacaggacttgtgctcagcactctgccactattgctttcctgtcacaaataatttatagccttctatttccacccctgagcctgcaccccagccttgcctcctgcttcccccagctcccaggaatcaataaactcacatagccacggtgggacttcagggtgcaaggagacagacagacagacaaagagaggggaagtggagagaggagcagagaaggagaagaagagagggacagagagtgaaacacagagaaaagaatggggaaggaggaggaagagagagagctgaactagaagatgagtaagaatgcctggtgctctcttaaaaggtggagcgcttctctctttcttcttgagtttaacacagtgttaatagaagtttcatgcagggctttcattcttactcacagagcctgagactgtgttgatatccaagttggtgagaggtgggggtcttccgggaatttaaccagtaagggagtggcctccccacctgccctgtcatcctttgctctgaagtcctgccacgaccccctgccatcccttgggtctcctgtggatccttgccagtgaccctagtggggcttggtccagcccccagtctgtctgcttgagagtctgacgcaacctccttttgggtcagatgtcgctgccgccactgctgctatttcttgtcttctcaatgctcttcccagggtctcagtggcacctgcattgaccaggctggggcatactgggtagggaggtctcctgcctgcatcggcctaaattgaaagcacccgggcctaggggtcacccataggaataataatactggtcatcattgttattataggtagcatttatagaaccaaccatcatagtaatcacattacatggagtgtccctatttagtccttgccacagtcctatgaagtgtatggtagtattatcttattttacagagaagggaataagaaactgccaggggtttcacaggaaacaagtaacaaagccgggattccgactaaggcaggctgagcccagaacccatgtccttcttccttttgctgctctcactcccttggaagtgtgggagactctaagtgcctggaagtccccatgcggggcccaggccaaagccctggaggtccccaggaaagggtgagctctcatcggaaatggtggaggagaaagagcatcttgtgaaggaaagagaagtggggagcaggcaccctggcagggcagtctctcagtggaaatggaaaaatgacacctcccagcttctgagcagagctgtgtcctccagggtcccagctgcaccctccagggatctatatccagaacttgaccttccaggtcaaacctgcctggggccgtggaggtttgatgtgtgtctggctgtcttgtgaggccaagtatgaaaaagaattggagaaagaggaggaggaacatggggaaacggtatcaggccgtcatcatcaacaactgctttacttcattcatcctttagccccgagtgaaattgccatgagttgttgggttgttgtatgggagacaggaggacaatggatgaccatcagatttccatgatcccagttcttaaattctccgagatcagctctagggactggcaagtgcccactgcctgaggtcatggatggacaccaagagcattagtaactcacagcaggcaccctgcccagctcctcccccatgcaccaccaagccgctgtcagggagtagtgattttccatcactcgctgcctcagctaaatttgcgccagtgccctaggggtcagaggctctgggtaacaaagacagaaactcctcaagcccgtccagttctctctctcagccagccccacccctggggttcccttagtcaagagcccatcagacctcaagccagagccacccacaggcccagtgagctcacagaagctgttgctgcagtaaactaggagcagctgctctgagctgctcagcatctttctagacttttcttgtagatgattgtacactgcctctcagctactatccaatcttttccattgtgatcaaactccaaatcttccctccaactcttgggagatgaccttgccttctgctttgctgagagataaaagccgtaaaagctccttttcaaagctttggccacctgaaaatatgccatttctggctaacacctccctggagtctgcactccatttttccttgttctcccttgctctgttaatcatccacagtcccttaggcaacttcagtctcttcctcttcactggttcttcctcctcagtctacaagcttatccaggtctttcctacccaagaaggccttccctccacttagctgcccgttccatcctccaccttccatactttcctctcctttcgttttccaaaaacttctgaggcaatagtctccgtttactgccctgcctccttttcctccctatgcattccctaaccttgttctgtctggctcctgctccagtcgctttgctgagactcctcctcaaggtcactaatggctaccagaatcccaaatctgtgcttcttcttgttcctaattcccttcggtccccatgttgctgttggcactgcaggttgtgtttttcttgaaacattcttctccactgacttaggtgaaactgacctatcttggttctgccatttcctctgcaattaattctctgaatcctttgcaaggtcagtttcttttcccagtccctggaaataaatgtcctccagtatccactccttaggcctcttgtcttttaaacactcctttccccggtccctgacagtctcctaaatccatacctctgtgtgcctgctgatgcaggggcattgcccctggacgctcctctttcacctcaaatgctgcacatctaggaccaacatcaccacttccctccaaaaccagtcacctccctatagccttattcctgacctgctgatgtaaactccaccaagcttccagttacacaaatctgagtttgtaaaaccatggttgactccagttggttgccaaactctgaccattctgccttcctcttgtcttgcaaattcttccctttctttcctgagaccagctccctatcgcctcatgcctcatgtatatgtatgttgctttactgggatctgtttgtagagatcccccctagtttagaaatcactcatggcttaaggccctctaaacctggttcctacatgttgggggcaggatgacaaagtaacaaaaagcatagattttagaggctgcattctgagtcttccctaattggtactgtgattttttttttttttttttttgagacggagtcttactctgtcgcctaggctggagtgcagaggcacaatctcagctcactgcaacctccgcctcctgggttcaagcgattctcctgcctcagcctcctgagtagctgggattacaggtgcataccaccacacctggctaattttgtatttttagtagagttggggtttcaccatgttggtcaggttggtctcaaactcctgacctcgtgatctgcctgcgtcggcctcccaaagtgctgagattacaggcatgagccaccgcatctggccttttttttttttttgagatggagtctcactctattgcccagactggagtacagtggcttgatcttggctcactgcaacctccgcctcccgggttcaagcaattctcctgcctcagctgcctgaatagctaagattacaggtatctgccaccatgcctggctaatttttgtacttttagtagagtcgagatttcaccgtgttggccaggctggtctcaaactcctgacctcaggtggtccacccgccttggcctcccaaagtgctgggattacaggcgtgagccactgcacccagccagtagtgtgatcttgagtgagctacttaaacttgtctcagctttggttttcaatttgcaaaatgaggataatagtctctactttggaggtggttgtgcgaattaacaataatatatatgtcatataaattgtgtataatattggcacatagtagatgttcagtaagtggaaaatggtgatggttctcatcacatccaagttttcattcttgtttcctcttagtcccttgcctgtctccactcattctggctgaccactctgggcattaacccagaaggcagcaggctcgcgtggcttccgcttccaccagcttgtgatgccctcccctctacttctttgttcatcttaggatcaagttattttttactggggaaagagacagtggagatcctgtagtccaaccccttcatttaaagctgaagaaactgaggcccagagaagttgagaggtgagaccaaggctatgtggcttcttaaatgcaaaatcagaagcaggactcagggcccctgccatgcagcccagtgtcctttccgccatcctctgtgcctctgatttcagccctacttggctttgaagatctacatcaatttccctctgttcagcgacttcttccgcagttccctctcctgcaaggggaatggttcctctcctccaagtttccagcactaactacctgattccctcgggtaactgagcttttttggggattaagtctcccctccccaccttcatatccagcactgtgagctaggggccttatcccaactgcctgcaagtgttcaggaaaagcttttagagctgacttgctcatggcttgtgactcacctggctggttgaggtgagcttggctcacatgcctctctgtggggacaaggaacgctatcagaaaagtggcttccaaaggcccctcatttgaccagtgggtagggggagcattcctccgtcttggccctgggactggtctttggcatcattgagccctcggtttttcagatccctgaaaagcaggctcctggaatgtttgatttggccccttctccccaggatgtacagggagggcaccagacctttcaaccaggctggcaaagacgctgcaatccaagtaagaacctcagaaaaggaggccagcaaaccagccagccatataggaacagggctctgacttgtttgagggcagtaagtgggctcaagaagagattgttcagcctgacatctggcaaagggactgtgtgctgtgttggagtcctggggacaaaagaaagggtcacctgtgacccagcccctccctggctacttctcattctttcaggatatggggaaatctcatcctctcaactctgaaggactgtgacacagtcccaagtaggaaagccagctccaaaatgatctcaaaacccaggaggtcctggtaccaggaagagatgcgtgtgtggttgaggagagaaaggtggacaacaagccactagggcagtcctcaccctgcagaaaaagaaaggatgctgtgctcactgggtctctgccctgatctttgctaccaaaaatcaaacaataatttgggtgatgcacatagcaggacataaggcaggctgcattcacccagagctgcattacgttggatctgcggagccaacagaaggaaaaccctgtgccttgcagcagtcagtgagggcagggacacagggagcagatggatgaggaaatcgctgaggaacttgggagagagcccctttgcagggctgggctggaattggccgggataggagtgggcatttgatgtgtgatgctgttgtgacgctgttgcagaatcatccggaccaaagttcagcagcctttccacccaacgccggatggggctgggacaggagtgaccgcccctggccacaccattggtaagagggctcagggaaggggaggaaaccagatcccacctagagaaaggcaggaaacgcagctccacccctgggaactgcctgcccgcttgaggtccagagcccaacctatttgccaactcctctcacctgagctcctgtccacatagggtcttcctgagagatactggttctctaggactgttctctgcctcccacttgtgtcacctccctctgccctgctttagtcagtccctatcctctcccctcctctcctctctcttaagtgtttttcttctagcatttcttcttctttttcttcttctcctcctcctgcttccctctccctcattctccaacatcttttgtttttatctgattctgtctccctacctgtgccctctttcttttatatcaactttcttattccatctttgtttaacattccatcttgttcttaacattgtcctctgtcttctccccttggctcctcttcttttctccctctgcccttccctctcttctctcttcttcttaggtgtagctctggctctgttctgtcttcctccttcctcatggcctctttcctcttggcctttctctcttgattgctcagcctctgtctcacccactctgtatctctcatcctttctccatcctcctcattctttgagccatgcttagggcctctcaaagacgtgacccaggcctactagaacacctgctaacactcctcctctgtccccaacgcacacagactagcttccctctggcccaaggagaaacttggtgctactgtagccatagatgaggcccggggtttgaggggctgggatgtggttacatttttcctgctgctcctcttggcagttgtctccttctgtcttgaccagcaggtaatagaaatgactagttccagccctccaggagttggcaggagctgttgtttactaggccagtgttacagtgtgtgctgggagggagggttgggccaggctgtacctgagttgatcaccatagagcgaatgggttcactaatcttgccctaagggggaaattaggagtttctcaagtgatttcaagaccaaaagcagctgagagagagaaatgcacactcctggggaacatcaggaccagtcttgtgtctcctggagaatcagagacagatcttagaaagccacagactctaaatcaggattggtaaagactcagcccaggagactgagaacaatgagctggggcttcattagaagggtttgcccagccccagggattggatgagctgtgcaagggggtatccaaggagctgtgctctctagaggaccatggaggtgctgcctagaaggagacaggtttgctgtttcctgggcctgtactccatccgtctttaggagagtgagtttgagaaccccagtgaaatccacaggtctgcagagaaggcctggggttaactgggcaccacttacctcagggctggacagaagtgaataatagcctgtatatggcaatgcagtcccctcttaaatagaccccagaggaagtagaggaatgagaggaacgtgggctcctcatccctccttatgtcctctgcttctctctgccccccagccttggggctttggcctacgatcacaactgctaaactgctatcctgatgccatttcctccttcctctcatccagttcccagcacggcctcccctcctgtttccagcgcctccaatgacccagtgggatcctactccatcaatgggatcctggggattcctcgctccaatggtgagaagaggaaacgtgatgaaggtagggaggagggaagaggtgtggcttccccttcacatgctttgtccttggactccaagctccggtttcggcctggcctcgcagctgctctgctgtgagatcaattttagtagcaaagcccaggtccccccactgccctgctggctcctggagagagggagggtggctgctagtggggccatcagcttcaccatctgctcagcagccccggctgcctcacctgccactagggctcaccctatcgatccctgtgggatgtcaggaggagaagcaagaaccgtttaccttgggaaggttttggagttgggggaacagctggtctctgacctgaggatgaaaggccaacctaccttgtccttacctgatcccaatctgtctggaggtgagggagtgatgtcatgtgcagcctagcctggtgtcctttctctttaacacctgcacaccgcccccagttcaaacctcacagggagctggacatgggacccctctctcctcttcttctccatgagtagaaatgccactccaaatcccctggccctctccctcacctccctgaaatgcctcaaggtgcagccaggctgttaggaagggtgtcaaagggaagggggaaggaagaggaggaggagagaagaaaagaaataagggggagagtggtagggatgatcctgggacaaagtgtttttcaaatgtcgtgacattgggggtcccttggtgaccatctggttctcttctgatgcgtgaagctggggcacagggctggcagaccctgaacaacagagacaccagtgtctccggcctgcgtcctgcccccattttctcatggttcccgctggagaagtggtaacctcctggccttcagaggattttaaagacatctcccaggaaagaggcagaatcctcaaacaatgagcataaaggggtgaccatctatcccattagcccagaacagtcccaatttatgcctgttgtctctgcatcttggccagtcagcatctcagcatctcccttttctctcaaaaatgtcgtgtttggacaataaattatgtggtcattccacacatagacaaaccctcggtaggggaagcctaatggagtgaggagcagagaaaagggacaacactgagcttgcctgggcccacagtccaagatcccccagcctaggctgagggaagagagtgggagaggccaggcccccagcggaagggacagcgtggaggggaggcctaggcctgacaagacagtgatgacctggcgctggcctccttccagaagccctaatggcctcgtttcacagggaaacagcttgtctggctctatttctccttcttccaaaatatccaaaccgatttggccgccacggcctttgccattcactaaatttcattgtggttgttttggcggcagcccctgatgggcagggggaggttgtgggaaaggccctaagtcccagttctccctgaggctccctgtgctcaggccttggccaagctccttggcaccccaagtgctttggtagaatctgcctcaaaccctaaaggtctctcccttaaccagcagcccctgtgttttttaggggtgagaggcccagcagcccatgggaggccacagatacccctctgtactctcccttttcagtctgaggctgtggccaagtatgccaacctcgtggccaagtatgccctctgctgcatgggctcctgtggggcaagaaaggctgggggtagggaggcactggcatgaggttgtggtcacccagggctgtgcctggctggcccagaacagggcgctctcctgagtggttgatcgccttcattgtttctaatcaattcagttcagtgaacctttcctggacatcagtttcaagaaaggcttggtactataggatcccaaagcagaacaagatatgattcttgtccttaaggagcttacattctagtggggcatgttaaacatgtgagctcaaagagcagataggcccatcagatatcctgttgcgatggaggtctggtggcgggccacaggaactgggctggggagggagtacatggccaggaagggctgctctttgaggaggggcctgagggatgaagaggagaatgttcagagacaatggtagcctgaaattctatctgatagactgagccttgtgaccagaaggccctttggccagccactgcagggcagctttagcagggatagaaggcacaaagagatgtggtggacagtaaggctgaggagacaggttagggccacaggatagcaggccaggtctagaccatagaaggagtttgggctttttttttttttttttttctgaaagcaggagtagtctgagcaggaagggacaggagcagggctgggtttgggaagctcatgctccagcagtgtgacagtgatgcaccagggccatgttgcaggaagcagtgaaagccttcaaagcaagagattacggtgcccccaagtttcctctgaaacatttacctgctgggcctatccgggtggcaagacatatcagaggcctcactcttttttgagagacggttctcctcctcttaccaactcctcttgaccaaccccaggccaaatggagatgtattttccctggtggaggcctggcctatgagggagaccagttctccctgacctccccctccaatcctgatccaccagcccctggtgggaagggagaggagagagcaaaggtagagctgtggcagcccctcctcccctttcccccactctggatgcttctaaggagccaggcccagtttgcattagggagcagctcagatgattaagaataagggagataattatgtgtcaagatgatgtagcccaactctgcagtcaggccaaggtagcaaagcagctggcaggccagtcacagaaggcagcctcgggcatgggctgcagacacccaggtgtgtccttcagtgactgggccgggactgcagcaaaagagaatactgaccaggggactaaggggtgttgggatgggactgagcacgcacattaaagggctagaccctagagggaatggaggggctcatctccctccaggaggacccttaaagaccctgccagactggccctcctttggccccaagcactgtggcatcttcctaggagtgtcataccccaagggcaagctgtgaatctctttgtcctccaggaagctgctcctcttttgctctgggtacagttcggcctattcttcagctctaacaatgtcacggtgatgggcattagtgaggacaatcactgcagtgagtgctggcattattggagacaatctcagcagtagttattggtgttcacagtgataatgcccagaacattattggcactggcactcggaatatggacagtgttattagtatctgcagcaatcatttccctggggatattaggaaaggactgatcagctgtgactctggggaaaaactggcagtgactgtgagcctgtttgagaccccttcccatgccttggcctttgagagtatggaaaacaccccctgactttcccttgagaaatgtgctggtcaagaggctttgaccctcatcccaagagcccaggagctcccagaatgagacaggtagacagtccagatagatgaggaagttatgttctgaagcacccagaagacaggctgtccatcagtccgagaaggtagaatccccattcatatcattcaaaaatcctcacttcttagctgtaattatgggtgggcatgttagtgctggattccctgggccctttgaagggatgccaattccctgaacactgtgtgagctggtttatgtggctggaggagagagattcttgtatttccctatctacaatcaggctgaaaactggaagtccttcgcctttacccagttgctttcggctggggcccaaaacattgctgttcatcggtgatggtattgaagcgcagggcagttacacaacttgtccaagaatccaaatgaagtcatatggtgagaatctgctggtctgtgtgagggaggtgtgttgggatcatcctttgaggtgtgagattgcagggggccatgattttgcattccattcattaggtgtacaatgaattgtgccattgagtggtgccaagctggtgcagttgtgcgtttgcaggcagggcaggttgcatggctgcagatggccgagtcctgtcactgcctttaatagctcccttctgctttggatgaagccataaatggaagaagcagtttatttccttagttagctaccatcctagaggtccccaagagtgttgctcaggttagacttggagcaaatgaggggattaagccgtggaaatgagaagcacctgcccttgtctacgagcctggcttgaggcagcagaaggttgcaaagactcccaccaggaaggaaggcacagggtaggagtgagcatgccatccctagagcagggcatggatgggcagtggggctcagtgggaatgaatgtggcctctggagtgagcacagcagggtctgaatcctggtgcccctcactagttgggcaagtcacctaaccttcatcagctcaatcttctcctctgtaaaatgaagatggtaatggcacttccttcctgggggctgtggagaggattccatgaggtcgtgaatttagtgttgagctgacttcatcttggagacgcatccttgtgtatctgggaaagaaagcctaattggcaggtttatgtttcatgaggaaatgaagttgtgttagaaagaaatttatttgggcataggcgccctaaccttggtgcagctccttgtaactagggcagcctttagtggatgctgggattagctaacccggatgggaccagcgcagtggaggaaagctgtcgtcctcacacccgggattgggagaacgtttgtccatttctatctgttcatttactctgtggttacccacttgggccacatgtcatctttcagcctccacaggcattttaggtgtgtataaataaataaacataagatcctcttctttttctaacatgtgggcatctctccctctattcatctgtggacattactgctcccacatgcaagtttatttctttaccttggaaaatgtatgtttgttttataaacccaaatgtaattttttacacagtttatgcaagtgtgagtatgcatgtgttctaccgctctgaggtctttgggtataaggggatgggaatgtcatgcactgggaaggtgtgcagttacctgggtagtgtgcgtgcttggagagagtgccgggtgtgactgtgtgatcggggagagctctaagccaggcctcagtgtgttgagcgcccatggtcctgggcacaggcatcaccctaccttctgctgataaagggaggggctgtcctgagcctgcctccaggggtggcctagggcccaagactagggagactaaggcccttacagccaggctgtgagggaattgcagctcagaacccttgtagcccttagaaggggagtctggtctcccgatcttgggatcctgcccccaatcttctgcctgcctgtctttcgggatctctcagtgtttgtctgtctcttatttgctctagttgaggtatacactgatcctgcccacattagaggaggtggaggtttgcatctggtctggactttaagaggtatgagggccagagggaacatggcgtgggggtcaagggaaatagcttgggggtggcggttagagaacattcagagagtgggttcctaagggccagagcatggaaaaggaggagttggctcaggcttccactgggagacctggaggctaacagagtctcagggcctggattacttccgccatgggccactgatggggtttgggagctgaggccccggtggcctggagggtcaggcactcagtggatggggggtcactttttctagcccttggaaaaacaaagagcagatcgggtagtaaaacaaaagcaaaggagacctggaagcacctgacagccctaattcatcacagcccaagttttttcctgtgttcccattatatttgtttgtaaaagtggaaatcaattttgaaggtaattttctggaaagaatggaagggaggtgggagggccggataaggcagagatggtaaaaggaaaaatttaggccaggcacagcccaggggcagctcttggcaaggtgaaagaaaattgcatattcaatctccatccatgaatctccctcactgctgcccgcctcctgcttgaaaacaatgaaggctttttcccaacgctgggcagggcctcggtatcagcctcactttaacttcagggtcattaattccctgattattgaaggagaagagagggttgcagcatcgtcaattccaaaggcaccccctcatgtgatcgggcactggctggggttgggtggggggcacccagggcaaagtgaggtgttgtttgagaaaggtgtgaggagcgaggaaatgggggagccactggactatgggggaaggaagccaggagggtggaagaaggcagtcattactgcatacctctgttgtgttgttattgcaaattaaaagtagcatgttccactccacagctatctttggggagggaggggcaccgagggaggtgggggatcttatcattgcttcttcagcagaccagccgtggtgtcaccgtgtgaggtgacatttgaatttacaattccgctgagaaaagccattaattcacaaattaacatttctccctctccctctctctttaacactctctccctctctcacatggatgtgcaagcaattgaaaagacaaaggaaatagccttaaggaagagactttactgctagtctgtgctgagattgctccccctgcttccagatagataaaccaattacctgagcagctctgctcctggccgcccgcgatcgcctccttttgtaggctgcctccatggctggattacactcggtgtatctcattaatgtaaaccaggcgtgccctggtcaccaagctctcttcccggctctccttctggaggggcagtgggaggagggctggggtcagtaaaggcaggcaaggaggaccccgaggaagaccagaggctgccactgcctggcttcccaggccctgggcactcgggtgcagcctgccatgttggctgaggctgatgggggaagtcggtgggtgagcgctccttggtgggcttgctctgaactgagtgagggctgggtatggctgggggcagaggaaggagacagggcctgagtctctcagcggcattttggtccagatgcagggggctggcagaaccagagagggatctgagtgctccctgcttgggaagagcttggagaagttttgctgagtacacactattttagtgggatgggattcagcctgaaggagcttggagagaggctgaggagggcccaggagacttggcgaggttgcaccatattgggtaaacaaaaacccagcacttggatacaattatgtctgtttaccacctaattcttgcatgcacacacaccccccccgacacacatacatgcacaccgacacacacacatgcacacccagccatccgactcttttgctagagaagacggggagaaggagtgtgctcccaggtttctaaagtgagcttacatcgtgggtagggaattgcagggcctctctctgcttttgctctcctcccagaccctggttcagcactgtaagaaggcatttatgttggtagggggcagctgagcagagtttttgcttctctctctctcttttttttggatgaagtttcactcttgttgcccaagctggagagcaatggcaagatctcagctcactgcaacctctgcctcccagttcaagcgattctcctgtctcagcctcctgagtagttgaggttacaggcacctgccaccatacctggctgatttttgtattcttagtagagacagggtttcaccatgttggccaggctggtcttgaacttctgacctcaggtgatccacccacctcagcctcccaaagtgctgggattacaggcatgagcgactgtgcccagcctgagtttgtgcttctctaaggagaggtgctctgtggattattggtgggattctatgatttcacacactgtactatctagcacatcacagactctcccctccctaggagacaggccctatgaaagtccagaaaccaaatctatatgatggtaaccatctgtctagacaagtttctgactttaactgcattggctcaacctatgttcattttccaactcatacccaaaacctggctaaggtccacttagtccaagaaagagctgaggttcaaaggtcagcactcaccaaaacacagggggaaaaaaaactcatttatgaacacacattcattgctatgattatatctccctagtaaccaaggaaattaaactgttcatacctgaggggggaggttttctgtcttagttggatcacatattttagccaaactctctgggtagagttggccgtgagcctgttgaatactgactatgtcattatccagaggtaggtgtaggttctgtcgatgttttagaaggacctttatcttgggccctgtgcataggtgatttgtactttttttgtggggaagtacaggggtttagccctggctgtgtggatcaacataggtgcatgcatctgcatataagtccttgcctttatatcagagacagcagccaaatcaccaactacctttgcttcccaactagttaatgctgttgtggatgaagaattccatctggttgtttggggaagtattttgggatttagcacaaaagagtatatattttttcatacaatgccagaaattcagaatagagaggtcaattccaccctaccaggagagaatatacagaattgccctagaggagactgtatgtgtccatccaccgctggaaattggggtgggcgggtgtaggtataccactgtctcagcaaaggctgtctggtactcctgcccagctccatgtttgcaccctcgtggacgagcacccatcttgtcagaatacatcttcaacttcctagtctttcacttggcaactaccttccagccctgcaggtaggcattgttctcctttcccacccagcaagggcaccaagcaggaaatctgctgcctcagctctgcccttcttccccaagcacaggctatggaagcaggaaggaggagatgagcgccgaagctatccccgggccctgctactcctgagttcacctccctgggcgcctcttcctctgcagacaagcaggaagctgagaagcgcaggccactggaaaaagggtttggagaggatgtaggctagggagaccccagatccctgcctgccagcggaatggtcctggcagcctccttgaccattgctgcccgccctggagcccagaaaaggacccctcctgccctgccttcctcagagccatggtggccttagggctgtctgggaccctctccattttgccccattggggtggaaaggcatagagggctgggggagggctgggcctggctcaggggctgcgagacagatcacgagcctcagagccaagttgcagcctcagagccgagttgcagcggagccagtaattcaaaccatcctgacccttcggtgaacctgaacctgctgaccttgacagcactagacaacagaggcctcacaaacctcaacctgcacggaggcctggccttccctccctcccattcttggagccctgtggcccatcctccaggtggctcctaatttggctgcccccatgaaatgtcagcatcccctccctccctgaggctccgcctgcctgcttcaaagcaccctttgtgctcatctctactggagacaagtgtgtgggcatctcctgggggcctttccaggactggggctggggctttatcctgcaggcagagcttttacaccttgcccttctctttctgccccaggcttcacctttttcaggaggactggctagagtgtgtgtgcatgtgtatgtgtgtacatgtgtatgtgtgtgcatgtgtgtaaggttggggtacacacaggggcagcagtagaatgtgatccagacagcagacaaggggagggaagagaagccagaggaaagcagctccaggaacctgcattaaagtaaatgcagtttatgaagtttatgctttcctcctagggagagctggattccatccaacagcctcccagagcctgccaaacagctcctgaagcagaaagtgtgagcaggagagcaagcgagccagtgacagagggagagatgcgcggacacactcacacacccttgctggctcacacagatctccctcggcccaggcagcctgggaagcctgggatggagggatggggacagtaggtttggtaggagtgactccaggagccgttctttcctcctttcttccctcctcacctgccatctccatctctttaggcagagtgcccagcatgagcccttgggcagtgtgggcacctgggtggactggtggtgtggggagccgagggcactgtgggccacctggggcagccagcttgtaggagccgcctgggtgagggacagtgtgggtggtcttgggcagtgggtatgtggtccaggcagcaaaagggaccagaatgctatacaaaggaacctctagggacttgctttttcttcggatgctggggatccatttttctctggcattttggtctgaaccatgtgggtgccttacagccactgaagataattattggagtcttttaaggagaaatagagaccgtattttttttcctggtaattcaaaggaaataagtggttgacaatgttaaagtatgaaagctcacagagggacttaaaagcaagttggaatattggagtatctgttcttctggactcttcttcacgtgcacaagcacatgggttcgtgcgtgtgtgcactaataatgtgtaagtgggccaggacccttgactttagatgaaaggggagtgtgggggagaaaatgcctggagaggaagtccgcagcataggcctttgctctggcctgtgggcttggcaccatcatgttgcttgcccctatggcttctgcgacatacctcagctggggacagacagtgagaagtctatctcccttctctttctgggaactccatgtctgctctattcaaattctaccaggaactgagacagaagaggatgacagaggtagaaccatccagaagcagaggatggggagaagagggcaaaaggatagcgaaggatgctcagaaattgctgactgtggaggacgccttgggaagccaggaggtgctaggcacaggaggcagaaactggccaaggatggcgttggtcctttctcccccctgctctctccctccccctccctcccctcttccctccacacatctttattggttctggtaatagcgttgatttgcatgtcaggcaaagccttgctacacacacaaaaagaaaaccccagccctggcggtgtggcagtgtcagctctcgctgttgttcgacagtgtaaaattaaattaataaagcccccaacacaagaaaacataacaggaaattaatggcctttactgtcgctctgatgcagtcatttgcaaccctgctttccgcaccaaagacttcataaattcaagcagtttctctaaacaagcatacttagggcggcctggtatgtaatttttcgccttgcttgtgtcctttgagctaacaaagccccctttcctcttggttccagagatttctaactggttctggcccctgctggagccaaacggggacagcaccaggcagagggccccacccgctccctgagagcccagagaaggctgggaaagggctagggtcccaggagctagacgctcagtgagccctccttccccaccagcccctgcagcaggccagcaggactgcataccagtgctcccaggcaggaaagttgatctcctcggggaattcccctaaacccactcaaggctcacccctctccttcctccccgggtctgtcctccctctcccacaacttgtgtgttcccttcctgaggcctctggccttcacctccctccttgtcggtacccactctccaccgttccacttcttaatacatggatcgcacacatctaggctggctgtgacttggcagtggggtgccacgctcttcttctccacaggtaacctgggggctctttttcgggggagctaagttattcaaagtgaggaaagtaaatgtgctggtacaattccccggggttctaggtttcctccatatctccctcttctctaccggttggttaggaaatgccagggccctaaggggcccctcagacaatccctctgtcctcggcagttttcagtgagctaagagtccttgactgctttggtgtgtaaatcggtaggatactgaggaaactgacaccttcctctctggcctctctggggatctttgtatcaatgtgggcccaggtgcccagtgtgttgggaggtatgagaggagcagagaaccgggatgtgactctcaggagcttatagcctgctggggaaggcaaggctgttgcactcagacaattggctgttcattaaatgcccagacacatggctgtgtgttccataggaatctggggaaatggactagaagggcaagcaggaaatggggcttcagcctgggagcctgggagtggctgagattgagagaggccttggctgggctggatggtgacaaggcagagtgtcagattcttaagggtcatcctgtcttatctgccactcaccatagaactctttcctccaacagttctgcctgaaaggccacagccctgcctggacatatgtcagagatggacagtggccattgtttgtttgcagcatcactttataccaagtcatgcgggttgagggaagaccacgggacatgggatccaaatgtccagatgtgggtccatctccactccctacttgctctgggaactttgactcattacataatatctctgaatctcagtttcctcatctttaaaatagaggtaatggcatttgccacagagaatggtggtggtggtaaagctctccatttgacaccctcccttccctatcctccctccctccctttcatccactccaccttatttactgagctcttggcaaatgctgggctgggtcctgggtggatttcagattctcacatgatatggttcctgcccttggagttccctcaccatcctggttacccatctcagaattcattattgaaggttaaagttcctctgaaatgaacactgaactccagagacagtctaaccaatgccaggcacagtagagccttgccactctcccatctggagactctacatccataatatagcctaagattacatttgattttttagcagccatgtcagactcaagctcatattgagttcgtggtcaactaaaacctcgagatctttttcacatcaattgctatcaagccaggtctaccccattctgcacttgtgtaattgatttttttttagcctaaacatagggcattccatttatccctgctgaatttcatcttgttggtttgggttcttaattctacccgattaaggtcataaggatgtcttctatatcatcatccaactagttttttgcaaaagagttattttccttgaaaacacaggaaagccacatggcccaccaatggggacctcctcctggctgctgtaagtgaatgaatgctttgggaactactgagcccaacagccatcaatcattttacttgttttcatcttgtccattatgctaggaaggagattcttggttaaatgttaacactcactacttccacataatttccttaataaattatttttaaaaatctggtttacatcgatgagcaaattgagtgcctgctatgtacaaagtatggcaggactgatttacaaaggtaaataggacacagtccttgacctcaagaaacttacaatctagcagggaggtagacatacacatcattatataatcagaatgtgatgaatgccgtgatcaaggcatgaagtcatatgatgaacgaaaaaaacaaaggagcagttgcttccactcagggcaactagggaagtgtttatgagggagatatttgatctaagcgttgatatggagtaaatatgccacaacttatttttgtgagtgcgtgcaagctctgggatatcaccattttcttttctgttgcccataaattaactgtataataatttcatttaaaggatttccagagcctgatcctgaatttatgattttgagtgtcatttgcatatgtgtacctcttcccccttttctgacaggcaggatggccttgggcttgtcactgcctcaccctttctttgtgacatctcagggatcatcaacagcagttttagggtcctgtgtggacctgggaaagttcactgaaatggccagaggttacctgcctggcccctccctgaccagggcactagtgccctcctactgggctcagtttgaagattctttcatttggagaagacaaaagcaagctaaggttgagaagttctgccttctctctcaatattacatcctcttccctaggactgagccaaaacctgcctttcttttctttctttctccaaggcccttttttgttgtctcagcttgttctgagcttttgtcttcctgacaggctcatgccaccctcatatccatccttggttatggtccccgcttccatctgtcatgtatcctgcataagaggaaaaaaagtgacttctatgatcctaagtgcaatacatgctcattgggaaatacctggaagagatagtaaatttttaaaaattcactcacaatgtcgtcaccaggagataaccactgttgaatttggtatattttcccattctctttcttttttgtgtatatataattttttaatcaaaaattgaacaataccatataaacagcttcatgtcttgccattttcacctaacattacttaatataggaccattttcacatatcattaaatattctttgaaaacacgattttttaatggctgcataatcttccgctgttcgatgtacatgtccttttaaaatctgggatcatcatattttaaagcttatctgtgtgcaacaacagtgattttccttaaatgtccttctcttttcacccctcccccactcccactccctttatgctgtcaggttgattatttgagcttatagaagcagaatttcatttttagagcatcccatcctcgtggaattatggtctcttttagaatctcttgccatggaatccctggccatgtctttcccccagcatggagcattttgctttcttcaattcagattctgccctgcacccccttcctgagctactgccaactctagacatgcttgctttctccctgcatccccatcatttccctttcatcagtttttctttcttggtcagaattaagtggcctgcaatagtggaaagggatctgagctaggaacctcagttcccattcttatgacgactagctatgtgacatgggaaaattacctaacttctctgagcctggcttttggtttttgtcttaattttaaatatctaagagggaatccaattaaattctcttcatattttccagctgtagaacatgagtgacactgaattcagagtagcagcctcctttgttgcttctttttccttctaaaaggtaaaatgttgagcataacaagttaagaactgaccaatctttgcttttggaattcttgtcaacaaatcagccaacattcatgatcaccttctctacatgaagtttataaagttgaaaactatgggacccctgccttcaaaattcacagttcagaggagaaaacaaacattaaataataactgtgatacgaagagattctaaatttggctctgccacttattggctatcataagttgttctgggtaaattacctaatctctctatccctcagtttccccaggttaggagcttagctgccagaggcatgttgccagggttgagttctggctcctctgccatctgtgaggcgtgtaaccttgggaaagttccttaatctctgcactttcatttccccatctacaaaatggggacaataatgtttaagttcttgtgaaaattaagtgagttaatatatgtaagattatcagaggagtgcctgatatatactaagcacttaataaatgttagttgctgttattgtaaggattacatcagtgcatgcatgttaagcatagtgtctggtatccaagtagaaactggatctgttttagttattattagtactatttctacaatagaggtttggatagatggctgttagaatgcagagaaaggagaaattaatggtgagggaggagctaacagccctcttgtatatgtctgaggaaactcaatccagaaaagctcaggagatttatagcaagtgagcaacaaaactaggatttcaatccaggagatgttacttctggtccagcattgtgttagggtcactagtacagttagtgtccctagaggccggtgggtgtgaatgggtacagcaagcctgaggtcagacaggcccacagccaccccagcctctccctattcatgaactcactgagtgtttagaagctaggcttggtcaagtacagcaggtagtttcccagggctagaaggctgggcagaacctggtcttgccccgagccaaggtttgggccagatttccaaagccttcttcatgtccacctctttttttttttttttttttttttagacagggtcagggtctcactctgtctcccaggctggagtgcagtggcatgatctcaactcactgcagcctccatccccagggctcaagtgatcctccaatctcagcctcccaagtagcctggaccacagacacatgctaccacacccagctaatttttatatttttggtagagacggggtttcaccatgttggccaggctggtcttgacctcctgagctcaagcaatctgcccacctcggcctcccaaagtgctgggattacaggagtgagccactgcacccggcccactttatgcccacctcttgagcttggcttgggaactgtggccaggccagactcactgaatgtccagtttaaagatgggaggcaatggggcatatcatccatctccctggacaagcagtgtcaccatagctcctttcccagcccggccctctggagccccttccctcctctctcctttttcctatctattcctccctcactcccggaatcccactttcccctcatcctctcttcttccctcccttctcctatctcccttacctctctcttcattcctgaacactccttccttttctatcctcctccactctcccttgtgacccccccacccaagccatcaatcctccctcctctcccagtctggacagcacctgacctctggggagccaccccattcctcagctcccaaacctcactccctgttcccagttggacctccacctccctggtcctgctgtgccgccgtgggggtggggctgggcctgcacaggcaggctgccctgaatgacaagcggggatattgatcgcgttctgaactcagcccagccgatagaaggtaattaatgactccatttgcctcactaccgaggagaacaattgagtttgaaactgcaacaactggcagctgggaagactggggggcagcctgggggtgaacccctcagaggcggaagtaatgtgtggagtagctaggcagagagagcaccttctgagcagaggccaccatcagaacgggcagagcccccatccccagcacagctggcccctgagccccactgctcccccagcccttgaggcccaaggcccatcacccactggtccccccacctccacgcttttctcttttcttcccatatcactttttgaggtcattttctgcctgcggatgaagactcagttttcccaagactgcttcttgccagctgtgcaatcttgcacatattttgaactctccctgagcctgtttcctcgtttgtaaaattgaactaacagtatcacttttgcaagcattctgtgaagactgtggataatgtgtataaagtaccttgagcctgcccagaacacagtaagtgctcagtaaatgatgatgggtccttgacagagaaggcaaacatggtagagtggagagagcttcagagtccgacatccctgagttcacatccaggctctgctgcttcctagctgtgcagtgttgaacaaataattttgcctctctaagactatttccttttctagaaaatgagagtaataataagtacctcgtaaagtttgaagaggttgatgagtgtaggtgaaagccctaatatcattactttctccatagacagatagatgtttgtatttgagcttagaaaactgaagttagtgtaattcttttttttttttttttttttctgagacagagtctcactctgtcacccaggctggcatgatctcaactcactgcaacctccgcctcctgggttcaagcgattctcctgcctcaggcctcccaagtaactgggattacaggcgcccaccactacacccagctaattttttgtatttttagtagagatggggttttaccatgttggccaggctggtctcgaattcatgaccttgtgattcacctgcctcaagcctcccaaggtgctgggattataggagtgagccaccgcgcccggccaaagttagtgtaattctttgctatacttaaattcttctcaaatacctcatcttgcttcctgggatttgatgggcaaccccgttcatcccaccctgattttgtagactttgatgagccttggtgctttctgcccaagcaaatgacatcatttcattttcattttctttatttttcttttcttttctttctttcttttttttttttttttgagacagggtctcactctgttgtccaggctgaatgcagtggcactatcttagctcactgcagccttgacctcccaggcttaagcaatactcccgcctcagcctcctgagtagctgagccacaggtgcatacaactatgcccagctaattttttatttttgtaaagatgagtctcgctatgttgcccaggctggtctcacactcctggacacaagcaatcctccagcctcagcctcccaaagtgttgggattacaggcatgagccactatgcctggcccattatttcattttatctattaccaccacccccaactgtctcttgtcccttgcagtgacccttctgtccctagccctgttcccaagacagggttcagggggtgtctccctccccaagctgctgagaacccactggacaactccattcatgactggccagtgccagggccctgacctggggtgagaggtgtgagatagggcccagctccagggccacccaggaatagatggggagtgagtgcagggctgaatgaatgaggagatgagatattttggttgaggagtaaagacatttttaatagtgattttagaagtagcacatactaattgcacaaagcctggatggtatggaaaaacttagatgaaaagaaaataaaaattgcttgtgattgggaagtaaccactgtcaccatgccggcagctctccttccagtcaagttgatctttggttttggagttctcttcgtttgcctggagactagggtcctgctgtcagtagccccacactctgggctctggctgggcaggcagccactctgtccgtctatttagtccacagctgtcagggcacctgccctgtgccaggatccccagcaaatgtccccttgagccagtcacttgccctcgcttcacctgcacctcatttactctgagcctcagtttcctccccagtaaaaagggattaaaatccctacctaccttggagagtggttgggaagcccatataacctaagatctatgaagaccttttgttaaatgctaagcaaataggaaacagtcagataagaagacaatatgagctttgttatcctcgaaagaataatctatgtcaaagttttgactcagcagtttgtttaatcgaattaatttatttacatactatctgtgttccaaaaagacctgtagtagctcacccccttgagagtgctcatgccacagtggacagagcacctggaatggcccagtcctgggagtcccattccccagttgtgtgaccttggaaaagtcactgcccacccctgctagttatggtaacatgaaaaatttggaccagacatcctctaatcatctgggcacagtctgcactcagccagcacctgtgccacaggctgtagcctccatttggggagggtgccaggcaaagaacgagggatgccgagaggaaggctgtgccctggatggagccaagtggccttcaactgggcccactgtgtttggcacccaggctgcagagtgaaatgatttagagggcaagctctgtactccgacagacctggattcaaatctggctgtcatttactagcttcatggcctttgacaagctacttaacctctctttgcttcagcttccttatctttaaaatggttatcatagtagttccctcacagggttgtcggaaggattaaatgagctctgtaaataacagcaatggcatgtaatgagttcttgatacttgtgagctgctacagaatgggagctgggcagggggcagacggagaatgaggctgaaccctccctctatggggactgactagcacacggtcccttccttgctctgtttggtcttattaaacccacagccaccatattttccagccccaatctaaaaatgtggccagagaatggggaagaatactggaaatcagaattcctcctgaaagcccaggacacatgaccagcagcctccagccctcttggtgcagggagttcaaatgtagatgtgttctccaggccccagtcttaagcagcctctgccacctgctttggatggcagctcagcagccccggggttaagttctgctgctcaccaggaacacagtgttctctgtctattggtagaggcaccagagatgggcaggatggtgttgctgagagtggaaaaggcctgtgcgtcagagctgatgctgttagaggctaacaagcagtggggatagcacatcttttgctagccagggatgtgtggggcttacctgatgagagactgggtgtccttgggtgccaggccagtcagatggccagtcccaaaaccttctgccagaggtatggctttgaatgccacccgggagagtctgagtacctactcggggccattcctgatgctggagctgcagaaatgcattagtcacggtccctgccacaaggtgctctttgactggctgctgggcctgggggcaaaggggctgttggataggggatcttctttgaaatggatggtgtctaatcactcacgcgctctccttccctgctcactagattaagatctgcttttacatcctagaaacctagattaagatcggcttctgcttccacctctgtttcagcccagctctgccagacagcccttcaacagctgggcctaacagtggtctctttcttcctccttgccgtcccgtctgagactttgcccttggaaagtcccatgccgagctcgctccccatcttcccgggagaaccctctaggtggtcagcactgacagctgtcttccttctttcctttttgactcttcctcctttactctcttcttcttttcctcctcctctccttcccctgcaaagccaccctcatccaggccctgggcagagaaggtatcaggacacccagtcttcagcgaaagtagagccagctggttttattcctgcagtaagtgtcctcaccccagccagcacttccagcttctggtgcggaaggcttcttccctttcttcccctccttctttctgcccttccacgcctctgggcttcctccttccctgagcttatcctccttggaccttctgatccagggcttctcccaacctcctttcctcattcccttcctgccctctctccttgccttcattcctcccttccttccctagctgatggaaggatgccaccccctcctctggaaagagcccttgagagcctatggtacgtgtggtgtatttggagggctggctggctgtcccccaccagtaatgccactgccctctcctgggccctgcggctcacctccctgcaccccataagtttctttgtgctccttcgccattcatcatgactgctgccttccttctcctacaggagttcccgcaagcctcctccagcctctctggggggtgggggttctccgcatgctttcatcacaccactttgttttccttctcctctaacgcctcctttctcctccccacttccctctcctctgcttccccgcctcccactgccacctcttccagtagcaggcttccttagcctttgcctcctttccctcccccttcccctcctttgctgcctctgtaacctgtcttaccaccagggcctgagtatacaaaaaaataaataaataaataaaaaggtcagtgagtggagggagcagcaataacccctaaaacagtactatcagtggaacatgattgatcaattgaattccatagcggctgaaaaatgtgggattaagtagtgtattatacgcacaatgagttgaggcatgatgttcatttcaagttcatttcgccggcctctgccaccagatcaggcaatcaataggggcagcagatatcatatatcacctctctgcgggccggggagagagcaccataatctctcgcaaatttagagtgacagatttgtcaagatctgaagggcccctgaataaatgaaggcaaagagactcctccagccagtgacctgaggacaaagcttcagttcagcccctacacacacacacacacacacacacacacagacacagtgagccaagccacacacagacaggcatatacacaaatctacacagaggcatgaggagagtcctgccacacatgcacacacataatgtgtgaacacacgctcacaaatacaccctctctgcccctacaataaccatatatgaagatatttgatgctttcctcagccctgagagtccggcttccccaaaaggtaggagggctccaggaagggagaatcaaacacaataggacacgcaaatagctacagggagtgaaatgaggatgatggcacatcctgaaaaaagaagtaggcacaggagaaacggggcatgtggcctcacagtcctcatgcaatcacacacagacacacacattctttcaggaagcttctcattctatttccacacatgcagacccttgtttatctggacgtttatatatgtacaagcgcgtagacacgcaatactcacacaaaagggaaaaataaatttaccacacttcaactttcaactcatatgttgatgcatacatcccgtaagactgaaatgattccagagccttatgcagaagaaaccacaaccaccaagttttgtgttcatgggaacaaataccattgaagctgcttctgtctgtcttcttcagatgtggtcctggtcttgatctctgtctctctctccctctctttctctctctccttctctctctctctctctctccttctctctctctctctctcacatacacacacacacacacacacacacacacacacacacacacactttctttgctttcccaccccctccagaatagatatggagggaagatgggaggtcacattaggaaagcaaaccccatgctcggtctgggaggccagcaagggaggatggctgcaggttgagttaatcaatatgtaatattttctatggtctcctgaatgatactgtatggtgttactgtatataatgcaatattgattatatcatatcgtataatcacctataaactgatatatataacattcccagaggaacaccctggggcctccggcatgggctggccccaggcccaaggctcctcagctggtcttgggctgagggaagcctggagtgaccaagctggtatggggtttgggggggaaaccccactttggggggctgcaaggtgtgggttcagagagaggccacagagcaggcacattgcctactgtacaccttgaaaactccaaggaaccgacgctgggaggcaaggataggggagggctgagaacgcctgaggaaaggggacatggagacaggattggcctgtagactcaggggagcaggcaccggtgtgataagactctgctccctctggagacttgcaggaggaaccaggtgaccaagaaactggctcctgtaggaggcttgagcctgggtctaggttggagacagaggccgagaaggcggccagggcatagaggcatccacaggggcccttctgtgggctctgcccaagcgggagctttgctgctctagcgacacctctttcctcccgcttggtttccctctggcctcagtcctggcccaacccaagcagagtgcctcagctctgcctcagagcccctcctccctcagggcgaagttgattacttcacccagtctccaggttacactcggcctcggaaatttgatggttttcaacccttggaattagtggaactgaaattcatctcggagccgagttcaattctccacaggctcagtaatgccagtctgagacacccagcttctttcttccccaggctggccctggcttgggggcagggggtggttcagggagacatgccccagggagctggctcctgggagccccctggctccacctctgcctaatccttcctgaccccacagtgtgaccgctccatctcttaccaggtcctcaggtccttctcttccttgggcttcctcagccagatctctgaggcagggccaccctctggtgtcagccccactggcccaggggctgagagtaaggggtcccataggggtgcagagctcctgggcccggaaccagatgcccacctctttgccctgcactgttcctgtgcctctgctggcctggcgctaacgccccgagtgtccatgtgttctccagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggtgaggagggagctttctgcttgcagaagtagaaaggagccggcagagcaaggcctctcaaaaacttgttcactaaacaccacatgcatagccagcattgtatgtgttacacacgtgtgttctgtgtgtgtgcagtgtgaacaggctcacatgagacagtatggtatcgttaagacaaatcattatggtctgtatatggtaattagaaatgagttctgggtgcaagagtatggccttgggtaaatcatctctgttcagagcctcggtttccccatctatagaatgaagggcttggatgtagggtttgtcaagtcccttctagctccgcttttctgtggttcttgcatggagtactcaggaacatcctcttgctgtgtcccttgcccacaccccctcagggtcctacagaaagtctacgctagactggggagctctccttgcccagtgtcaggagagcctgcctgtgcctgcctcctgctccccaagccagcaattcaatggaaccctaggtaggctggcagcttcccacttacacccaacactttctgcagacactgagcagcccaggacacatagcatggggcacagcatgtaacacaccagcaaaacgcacaacgcagaaaccatctccgaacttttctatgtgctggtgtgcatgtgctcacactccaccatccacctgctcccctcacccacagcccatggtactgtgctcacacaccactgtccacctgctcccccacccacagcccacggtactgtgctcacacaccaccgcccacctgctccctcacccacagcccacggtactgtgctcacacaccaccgcccacctgttccctcacccacagcccacggtactgtgctcacacaccactgtccacctgctcccccgaccacagcccacggtactgtgctcacacaccaccgcccacctgctccctcacccacagcccacggtactcacagctagccccggcagccgcatggagccagtgggtgtgtgctgcccccagatcaccagctcagcatacccctagcatatgcctccacccacatacgctgggtggagcccccagcacacccgctcccacacaggggcacactcccatccctgctacacatgcagcccaggccaggcccacagtcacagcacaagacagcattgctgtgcttgcatgcatgcacacacgcacccacacatgcacgtcagtgcagccccacagcgttgaacgctgtagttccactcttaagactccaacagctcccagccactcgcctttctccccgcccgtccttttatcccataagctgtttgtcttcataaaacaaaaatcaaaagtctttttaaggtgccctgagccataaaccaacaaaggaggagctggccgaggcgggcggctcagtgcaccctccctgagtccccgcctgtattacaatgaataacctttatttactttcattagactattaaacaccagcacagtcatttttccccctgaaactcggagcagggcccataaagcaaatccgaagcctaattgagttcattttaatttctctccgatcacagcgaattactctggtgataaatcagggggcagcttcacccccagtagaaggcctaatttgcagctaattacaaaactgatttctacaggaagatcaatacgagaaggaattggaaatgacgaggcaatcccgtccagccatggaggggagggggtactctaggggggccaggaagcggaagggaaaaaaacagacccgaaagagcaggaaatcagttttaatttaacgtaatattaatcagagcaacttttcctgctttgtgcaggctcccggtctgcccagctctggggtctggcttggccgtggctgcaataaaaaggcaattacccgagtgtttcaggcaggacaccctttcagagtcaatgactggccccctcctacccttctgttagccatgtggactctccccctccccaatttcataccccagtgcacaggcagacagcgaggggcccatggggctgtcattgtttgtttttaaaaaaggggcgcccatacccgatcagccagcagtgccaggctgaaggccccactaggcccttctcccagctactggctctgccagtcatgtcatggttccccctcctccccaaggctcctcgacatcccatgcctctcaacaagggtatccccactactacaccctacccgcaggggtgcttaggcaggagatgctacagaaacataaagggtgctggcattaagtgcccaaaatgtgtaaagggtgctgtgcctccggtttcaccaagtcaggtctactacccgcacaaaacttgccatcatccaccaagcccccgcatctcccctctgccccaccatctctttctaccccatctgggcgggctcccctgttcctcctccccatctgcacaccgagccctttctctgtgcgtgcatcaatagagagctgtcacttttctctctcctcccaggggaacgagtactccctcccagccctgacccctgggcttgatgaagtcaagtcgagtctatctgcatccaccaaccctgagctgggcagcaacgtgtcaggcacacagacatacccagttgtgactggtaagggggcttccaggagggtgggggcactgcgttcagtggagggtgcctcagcccatgccatctgaggcccagtgtgaggagcaggtcccccaccgtgatatttacagagagaacgaggcttctaaaaccagggtgcttcctgaacaggggtgtgcagatgtggggagaaaaaaactggggtcagggcatctgtgggcttcaacctggaaaggctgatgctaggaggggctgttgccagttcttcctcctgtccttcgcctctccctttgtctatttctcttccctctcccaagttgcccagaatcatgagcctcttgttaggatgtctgcagaaagcaaataagccaggctggtgagagtggagcatgggtacccagtgtccagcctccacacttgggtctccaaggctcctgggggacccgcttaccgctccctccaggcagcatgggtgatcatggctttgggcttgagggcatggcacccagctctgtggagtttgagatgagtacaattattccagccttcctcctgcttcccagagaggtcagtgacaccaaggcttgatttcaaggccaggtaggatcaggcttggcccacaatcaaatgcagagctaggggcgccatggccaggagcccctacaaatgaagagcagcagggccagttagtttggaaggggaggtggagtccagggaaggccgcagagctccaggctgtggaatgcacgtgccactgcagaagggtttccaggccaggagactgcccaaatgggagagacacgcattgaggtgttattaaaattcacctaattattctggagacactaaagccaatgtgccgtttgttccttgggagacaggatgattgagaagggtctcggtggggattgggagacactgaggcgttacctgcagagcgaggcaagcggaggtggcctgcggacccagcagcagggctgcagagccagcggcaaaggcagggaacaggcaccgcccactctaggactgggccctggttctgcctgtgagctggtctgagtgcggctgcatttgagcctgagctgggctcagtggccacccagcctccacctgggggcttaggagagccctgtcagttttcccagcctctccctaaggggctgtactggtacaactgtttccagcctagatctttggctagggagtcagaggttgaattctagaagtgttggagacctggactgggctttcgggagtgacgaccttagctgggttagctgggccaggacacagcccatgaccaaatggccctcagcatgagccatccttcgcccagctgggaagctctctgacctgctaggtattctgacccaaggcagagagacggcccaggccaggccacctttctcctgacctgctcagaagtacagtggtcacttcccaaagatggccactccaggcactgttcaaagagaacccgggagacttctctaaccccatctgctgcccagcgctcaggccatagtctagaaggcaagggcttcctagggtggagctatggatcttcagggtagggctcctgccacaggagacccaggggctggtacagagaagtgcctccaccttgagcagcccccacccgcctcccccccatggccctggaacagtcccagctcagcctgggaacatctccggctgatccatctggatccaagtgtgagaaaagttcatttcagacccagcttgacattcccaggtggcaagttagcactaacatctcaatctgtatgcgacatttcaatcaagcgaggagtaacaaaagcagaaccattaacattcggagctgttcaccagtggtaatgacggggaaactcgctcagaaactggaaattaccaaaaagagacaagtgtgtggagaggtgggggagggaagatggggataggggtagggaatgatttttccacacttaggccaagatccactgtttggattaatagtgccattacccaagaaagagctgcagattatgctcattcttaaaatgtttttgctggcaattaaactgctgcagttattgatctttgttgattttatgtcctcctaatttgcataatctattaaagatgaatgatttatgatgtgtttattatggggacaaacagaatttgctagaggtactgtcaaggtgagccatggggcattgctcagagactccatatgccatctcagcagtgggtccagcatgttggccttcaggccaggatattgtgggtagtagtgagcagtgatgcaaggagaacagaaacaggagagtggactttgggtgagttcttctagaaagatactggcatctgtgagaactgggctccaggcagagctggagtgcgggagaggcccttagtgtatttgtggacactgacctcaaagagtctttaaaagcttattttcttggcaaatattaagggctttggtgggagaagagaaaaggaggctcttttaggtgggtaggtgattctggggaggtgtgtgctaaaggtaagggagctgttaggtcacccagtgcccatagcctggcttaggagtgccgaggtgttcaaggagccctctttatcctccacgtctcaggcaccctgctcatcttcttccccaggactgacagctgcggctgcaaaccttaggggatgagggaatgccctagcccaacctgaaaagccagaccttattgagattcctgccacctcctggccctggaggctgatttcaaacttcaccagccacttgatgcagctattccacaaggtcaggactgagaggagagaggaacctagactattgtgtggaggggagagtggggcccagtgggccaggacacagctaatcacattgcaagcaagggtggctgccggaggctagggctcagccccatagcctcccctccccaccttccatcagggaaccgaggagagagactgattttgctgggtagtgtttgcaagttctgccgagattttaatttcactgcatcacaactcagcaagctgccaagtcaagctggttatttaaatttatcacccactttcccttccgccgctgggctgctctagctcagcggcatctcttctctccagcccacggctctaggctgctggtctggaacggagcctcgtctctcctaagtgataaagaaagagggaccagctacatgagagaatgggtcacgggcattctggccccaggctttttcaggttggctggctgtggctggtacctctcatcaccttcttgaccctccaaaggagcccagaggggctgccatccacctctcagtagtcccagggccctccgggtcagggcatctgcagtgaggactcgctccaactgcatgcaggaggcttcattccttaaagtctcccatccctggaagaaaagatagtccctgttctccatagcattctcaccttgaccccccctccccatgtctggccggggctccagtgacaaaggagcatgcagagacactggcagtgatgttgatctgggaggagaagatgagaacttactccaggattcccaaagtcactggggatgtttctgagcattagagagtcccttgacacagtgcaagtccaccccgaaggagagagcccagatgcaaggaacagtgctggagaagtcagagactgtgcagttccatgctctctagaaaagggttggccaatcttttggcttccctgggccactttggaaggagaagaaattacttaagtcacacataaaatacactaacactaagatagctgatgagctaaaaacaaaaacaaaaataaaatacctcataatgtttgatgaaagtttacgaatttgcactggaccacattcaaagctgtcctgagcagcacgtggcctgtgggctgtggattggacaggctcgctctagaagctagggaaagcaccagtccctggagccactgcacccacaggcttcactggcctctagtgggcattgctgccgcgcactggcagagccttgagcaagtgcagctctcaccgcccttgttttagtcacagagaggtaaaggaggaatgagattgatgtctgggacccaggcaggctacctcaccaaaacataactgaataaaatataacaacaaaaatgttaatacgcagcaaatctcactctttggtgccagaaatagaggggaactcaaagccagatcagtattggagaggccgctggcatcacactggagggagatgctgactgggagaggatggggttgtaacacaccagtcagggaatgtgactttgggaatcaggaagccagaactgagtatcatcctgcataaagcaaggaacagaacagggaccacactgtccgtgaaaggcaaacacatacactcgtctgagtagcccagggaaacaaggaagggggcagaatggaaggtcaccatgagacatggagacgccaagcctgatgccagatcagagtccaaatttataccatgagtatgttgcaggaaacccaagccaggaacttacataaaaatttgtacaggatagtaacccattctgaaacctcaccaggagcaatgacaaaccttctttgtagagacattctaaaatccagggcacatgggactcccacagggggaagaaaaaaccccaccactaatgatgagcttactgtaaaaaaaagtacacatctcatgtgaatacaaactttcaaaagggaaagttagtagaagcaataaacagaacagttaacatccccccaagacctgggaacaatagaataatccaaaagtgctataaactcagcatgtttaatattctaaaaaagatcaaaggggccgggcgcggtggctcacgcctgtaatcccagcactttgggaggccgaggcaggcggatcacgaggtcaggagatcaagaccatcctggctaacatggtgaaaccccgtctccactaaaaaaatatacaaaaaattagccgggcgtggtggcaggcgcctgtagtcccagctacttcggaggctgaggcaggaatatcacttgaacccagaaggcagagcttgcagtgagctgagatcgtgccactgcactctagcctgggcgacacagcgagactccatctcaaaaaaaaaaaaaaaaaaaaaaaaagatcaaaggaagtatcagctgtatctttatcacagatccagatcccccagtcccttcccaccactgctcaccaaattgtcagataatggagatcaaaaagggcaaagaatgaggaccatacctatagattattgctttggggtccaggaggcatggaaagagctgagcctcaggcaactctgaaagtagagcctgttccaggcttgtccaggctcccagactgctaagcctcagcagaaaatcttatattttctttgagaaaatgtctgaacattagagagctagagatgggcacagtacctttctccccagtggggtgggggcaggtgggaagcctccgtagcttccccatcctggttgggggaaggtggttttattcaagagcttgggagaaatgtctcttaattgctgaagactgcagttttgaaggaagctgtaattaagatccaggaagagatgtggatgctgcccaagagggaagtgcccaaggcaggaagagggagcagaagaggctggtctcccagaagctggctgatttgagcagaggtaggggaggccagagaggcaaagttcacagctggacagcagcagggaccagtgtgagcagtgtggatgtagcttctgaaaagggttgccaactcagaagctcggcctcctggcccacatctgagatggtcagcaaagtggccttttagcagatagaggtgtggaccctgggaaacctcctcctcctactcagggcatcctgaggacctccaggaactgcctctttcctgtagttaacaacccccttccaatgcaactgcatttccctccataaaacaaacagcttagcccttggccagcccccgggggaggagagggcaataaagactgagaaatgtttctcaaggaggctgggagtctcctagtcttgtctgtcagctcaaagcccctgattagctagaggaatttagggcacagacatcatagttcctctccttgaaaggagagggctaagacaacttcagacgtgtggcaagtcagagatccctttactgtggaggccaaagcaagccagagggctgttcctcagtgctcacatgccctagacccttcctttaggctgtgagggtcccaagaaaagaggctagcctccttcaaacatccctgagtctgctggccacatccccaaggacctccagcccccaacctcagctctgatttaattatgggggcatttccatagcaatgagacattgacagatatgcggctgctctcggcctgcagcctagggagtcattggatcaggcctctttcccttcctcctttatccagtccactgatagaggtaaaggatatggaaaagaagaggccctaatccactgtcgggatcagagtcaggccatatttgaccagcataaaagctgtgccacctcaatctcaggtcccaatcccatgtccttgtctgtgcctaccggccaccctgtgctgctgggctgcccttcccaggagggtgccatggcagaagtaccctggctgagaatggggctgcagagggaggagcatcgtagggagggtgacaaaggtaggaagggtttggggtgtcttagcaaagacgtagttctggtgttttctacgctgagctcaaatttggcccttaaccttgggcctttcttcttacctcctcccttcatctcttccctctgtccgtgaggcccaaaaacctgaacatgccaaatggagtgcttattcctccaaggatggcctcacttgttcatcagagatcagagagagagagaaaggggccagtctgaatttgaatcaaaatattttctaagaaatcaatgatcttgctatcaagtgcataacaatagccaactcaggccaataaaggattgcccagttgagaatactggccactgctttcatgattcgtcaggttacgggacccttttggtttctgtagatgtcatttagatacttgatgtgtcccacaggggaattctccaaaaaagagatctcccagcactaagctttttagtccgttatttggtactttttaagaagaaaatgttggctaagtaaaagtaaggtcagtcaacccaacattttttgaatgaccggaaatcctaaagactgctgtcccaatgaaacaggtatgtattggtaccaagggctcagaaatgtctcagtggcctcaaagccacctaggcaagacctgaaaacctgtttcccccagagggccggccacctccaaggtgacaggaagaccccccacttttttcccagggtagccagaatcccttccacctccacaattagctgtagcctcaggacaaacaagctagtgcttttgcaaccctgagctttgggagacaagctccgccactattgtcacttctgagagggctttgcatgccttcagcctgaatcctcccctcttctccccagtggtggtggcggctgggctggcaggcagggaaggaggaaatcctgcagggctcggagaacagcctaatgctgcagaggcttaagtggccgttttccttgggattagggtttcacttacacagagcgcctgaaaaacactgcgcttttggaaggattagagctgacaattcagtgctctcagagaacaaaataaagccagagaggaactgggaggcctggagtatcagaagactctgcaaacaggcttaacctctgcccacccagcatgagggtctctcatgctctgagcccatctttgagcctgggcccaacctcttgagtgccagtacctgcccaactccaatcttcatttgtgatttgctcatggagccagagaaggcaacacagggacgttgccttctggaaagaggactgggaagttgccaactgggaagaggactggaaatgtcttcccctctctctgagcctcagtttcctcctccgtaaaacaagggagttggactagaagatatccaagttccttctcagccctttgaaaatgtgattctccccaacattccctggtgttatcctaggatgctgaagctgcatttccatccatggtccagctgaattagaaggaaaccacctcctgtgaggccctgagccaacaggctacacagcccagaggagggcggggtgctgggagaagggatggaaacagcatgactggttgtgtccggccggttggctgtcaaggtgtagacctcactaagcccctgcagatctgggtaacatccctgcctaggacacaccagggattcaaggtggcagtgggagctgagatcaactggaagagcagccaccctgagttggaggcacagccccctctgctggaacctggagcaggcaagcctcaggtggggtatggggctgaggccagagcctggggctgtgggctgtcccatagtcccttctgccctagaggacaactcaaatcctgggaggatttggaagcttgggaaataagaaatgaaaggaaatatgtagatagttattttcctctccttttaaaacatcttgtgtggatttaaagtttgttactttagtgtaatagatatacgttgaattggtcataaggtgctcgtaattgttatagtaaataccaattatgcatttatatatttaggcagcaattacaaatttaataactgtgtatttttgtaagtattataaatgcctatgtcaaatgcaggcatagactgccagccttgaagaaatctaatgtcttcattttcgctaccttatgagaagcagacagaacttgaggatagggcagtaaaacaagagttatgttttctggccttagggtcctccgcagtgtcaagtgggtagcaaaagtgctcattttcagagaaagatgctgaggaaaagcatctctgaactcctcgatagaacttttgctatataaatctatgtctaataagtctcatctgagccatcatgagcagcagtttctgcttctttcgtggcttcctttttatttccttgatcttctgaatgctgacattttccttgacttgagatgcaactccctgctacttcacatgttattttgctgtgctttgtatcatcctgtttattgatacaattcaagtagttgcaaacaaatcagtgtcttatgccaaagaacggggctctttcacttttttataaacagtgcttattaatctttaagccatattttttgagaatatgataaaagtcatgtaccatctacacagaaagatacagatatacaatgtccataacattttatgtatagatttatatagaccccttgaagtgatctatgggttcttgagggatcagttaaccccaatttaaaacccccactgtaaaaaagtggaagaaactgaaacacataagaaacaagaagtgacaagatgttctgttataggaaggattcacttagcatgatcccatattactttcctggaccaaacacctatctattttctgggtctgcactatttgagaacaatatcattccaggatcatttcccaagtatacagcctgttctgtaatccagtttctgccatctactagcagtgaaatctcagacgtaatatttggcccctctgagtttatttctcatctatagaatggggattaaaggccgggcgtcgtggctcaccctgttatcccagcactttgggaggccgaggtgggtggatcacctcaggtcaggagttcgagaccagcctggtcaacatggcaaaaccctgtctctactaaaaaatacaaaagttagctgggtgcagtggcaggcgcttgtaatcccagctactcgtgaggctgaggcaggagaatcacttgaacctgggaggcagaggttgcagtgagtggagattgcaccactgcactccagcctgggagacagagcaagactctgtctcaaaaaaaaaaaaggggggggagtttaaaaacatatcaatggctggtcccagtggctcacgcctgtaatcccagcactttgggaggctaagacaggcagagcacctgaggtcaggagttggagaccagcctggccaacatagtgaaaccccgtctctactaaaaaatataaaaattagccaggcatggtgacaggtgcctgtaatccctgctacttgggaggctgaggcaagataatcacttgaacccaggaagcagaggttgcagtgagccgagatcgtgccactgctctccagcctgggtgacgagagcgagactccgtcttaataaaaataaaaataaaaataaaaacatcaacatcatagggttgatatgaagattaaatgagataatacatcatataaaatgttaaggacaccgcccagcatatagaaggtgctcaatgaatgctaggtagtcctggcccaagtagaaacacagctctgaccttgaatcttagacctgatggtgaaagtagcacaaattacctgatgactacaatttttcaactttcttaataaagtctttcactttgcttttctctgtacttgtaaggggagctgcacttagattctccaaagcagttgatttgatctggcccatttggtaaggaatgtctgacgaaagtgcactgtctgatgcagttgtagtgattgctgtagaaattggctttagaatcttcagggacttctgcagttgaactgagaagacatcctcatcaagtacagtgctttgaacacttctggggactttaagattctccactaccactgtttcttgaagaccctctttgtttttcagaaaactctcacaggagattaatactccaccccatggagttttattatagacttttggcatcgggattttattctctgagtcctttttatccacagccatgacgatatgagactttgtttgtcagatgacttcttttccttttctttggctcttttggggagtatctggcttcgtgttattaaaaggcagtgtggtataaacatggcttcaaattttggctgtatcatttactagctgtgtagtcatgggaaaactgtgatgcatctttgtgccttcattgtctcacccttgaaacaaggaagttacctcatcatctggaaggctattcatctttaaaaactttgtaaccttggccaggcgcggtggcttatgcctgtaatcccagcacttttggaggccaaggcaggcagatcacttgaggtcaggagtttgagaccagcctggccaacatggtgaaaccctgtctctactaaaaatacaaaaattagacgggcatggtggcacacaactatagtcccagctacaggctaaggcatgagaatcacttgaacccaggaggcggaggttgcagtgagccgagatcgcaccactgcattccagcctgggcgatagagcgagacttcatctcaaaaaacgaaaaacaaaaaacaactttgtaaccttggaaagcaagtgtccaacatgaaatgcccatcttcttgtaataatatgtggggttttgtccatttgtaatttctgatgctgtttttatgttactggccattgtcattgagcaacaaaaatcctctactgctttctgttgggtggcacatattttataactgatgtattctgccacataactgttttctcctttttctgtgcttttgcttgtttgtataaaggaggtgctgtgctgttgtacagttttagagtctgtctgcactcatgtttttccatccatctatagtacagcaaggcccagtgctctgtcgattcttgcttgcacagattccattacccattcatattctttcactaaaagaggcttgctcaaagaatgctgctgggcaaatggtatgacagtcttagtaatttgaaaacttcctgcagtatgtgttttccattattgacaatggtgttccagaagaatatatggcaagagtttggtcaattttttctgctctttaagtgtcacctgtgtgctaatgaagcaattgagagtgctttgtatgcagtggccagcacctttgctggctcaggggtcctgaacagggtactcctttgtggagatactggtgttatagactccgcagcagcaggtgcacagctgtatgcagaacacgaggaagcttgcgtgctttttccttgtcttgggactcttctttcacgttttaaaaatttctacatggcactgcccaacttcagttttctaaatagaatttggcaatgtgcctttcaatcagctgttcagtgggtgactttcagcatgcaaaagttcctacctgagggaagttgccattttgcaagacagaaaggcagtagaaataaaactttccaataggactgcatccaggttagctggaaacatctttctagttatccagcctgtcttccttcctcctgaagtgaggtaggagattccgtgacaaaaccttagattataaggaattcatggtgacagattgtgggaatcataaaactgaaaaccagaattcagatgcatttaaattcctgtttattaagaaagaggcacaccccttttcctgctgctttgcagactttatgatgacagggaaggaggaattaggtttctatatctgttcagcttcaaaacttctgcgtcttccctaactcgatcctgtcctgggcctttctcttttttttgaccaataaatgccatattattaatctctctaggaattgattttgatattgctgtcattgtctacttcaggtccactccactgagagacagtcaggaggagtgtagctttcaatgacaacagaagtcaataaaagaaaacccacatcaaagcaaacacaaatcctttattctgtctctctaggagtcaaaagtgatctcttgtttggcagttctactctgcttgttctcgagttttaggaaatgaaagatattggctatattagacaggtatagaggaaagtcattctattgcataataaagtcacaatatatgagtccctcactgtaaacctcttatcagcctataaaaaatcataatctattgtttaaattgttttttaaagaaaaagcatattctaatatttacattttatccaagcctttacttctttaatgagaccaatatacatgaaacaataaaaaaaatgataacccatcaggaattggctgttaagtgcaatagattgatggacgattaatcaacaagtgtttattgagcatctaccacgttctcaactatgcaggataaagcagaagacagggtcctgccctcaggttgcttatgatctgtttgaagaagcaagctatgatatgaaacatcagggctcatatattatgaaatataatggcatggtaaaccatgcagcacagatgctgtagaagtttggaagagagaaacttccctgatgggtagaatggtagggattttaaggcttcagtggggaaggagaggaaaaccgtaaggaagaagaaaaggtcatggcaaaagcatagggggttcacatcacacaagccatgaaaacagtcaaactaaaccaggagaggtgataatcttaagttggatggagagagtaccttagcagctttaaaagccacagagtttcatttcaaactatagactacagggaatcagtaatagtttttacaagggaagtggtgtgatgaaagcaaagtttcatgaggactagccaagcagccacatttaggacagacaggaggggaagaatgtggagtcagggaatgcaagcaaaaatattctgtggcaaaaagaaggtgcttagaagctgagctaggaaggtagtggaagaaatggaaattgagcagatgtaacagacattgccaaggagaattgacaatacttggtgactgacttcatctagaatgggaggaagaaggctatgtcaagaaggactccaaagtttttggtcttatgatattcaagatcataagaaccgacagagggaagatgaatctgtttttattccagttaggtttgaggtaacagagggacagccaaggaaaatgttcagcagggtactagaaatgcaaaaacctgagctgtagctctgtatagctagggaaggataaatcactcagacgtgtcaaggtagggatgaggaaactcatacagctctggaatgcagggaggtgaggccatcttcaaagggagagtagcaaagagagagagagatgctttggaatagccattgggagaataatgactatggcccagctgatgaaaagaaagtgaacgggcccaggtatgcatagttctgttactttctccagccatgccttgccttcccaaggatagacagaggcattagagtaatagagtggcattggctagtgaggagaataaggggaatctggaggggttaagggggttccaggaggtccaggagaggataaagagattatggcagaggggagaaagcaaattattattagagatcacagcatgctaaattgcaaagggaggtggtggccccttcatagccatggaggatgcaggcaaggtagggagcccagtcatgtgcagctgtgtcccagaggacatgtcggtggaccaggggtagcaccctcatcttgactcgctttgtctcccaccctccaggctttagctgatagagccctccagggacagaagtccagcagctggtgggggagcagattttgctcattggaactttatctggtccacttgcacttttggctcaaagctcctgattcacttcagggtggttttctatcatgtaaatgccataaacactaacagcaaaatagcccactggctgcccccctgctctccacacctgccaggaccaggacctgcagctccacttggagaggacaaggaatagccatcagtccctgtaggggtgatggtggggtgtcctccaagcctgaaggaaagatggggtgttagggagaggaaagataagcaagatgatagaggtccatttggctgctggagagaccacagctgaatatcttgctgagaaggaggagtaaaaccaggtcatctccctcccatctccatctgggtttggaatgcacagagacacaggcaaaggcagatacacacacacacacacacacacacacacacacacacacacacacaaatacacagagacacaaagagctacacaaaacagagatgcgtacacacagctgatcatagacatttagcttagacacatgcaaaggcacactcagatggcgcattcaggtgcacagtggcacacatacccctgcacgtctgcacagagctctttcctctccaagagtttcctctccgtgcagtaccctggtgtgagtagaggcaggcccctttcttccaggcctcaccccttcccctttgtgtttttccaggtcgtgacatggcgagcaccactctgcctggttacccccctcacgtgccccccactggccagggaagctaccccacctccaccctggcaggaatggtgcctggtaggtgacaatgctgcagctgcctaatctaggtggggggaactaaattgtgggtgagctgctgaatggtctgtagtctgaggctggggtggggggagacacaacgtcccctccctgcaaaccactgctattctgtccctctctctccttagaggctgcagttggtccctcatcctccctcatgagcaagccggggaggaagcttgcagaagtgcccccttgtgtgcaacccactgtatgtcatggcccctccacagcgcccacccacccaagtctgtgcccgaggagcactcagcctcagctccaccctcagtgcccagcccaccccagccagctgacactgcttggaagagcctgccctggtttccatggaaacttggagccaagaaccatttccaggggcatgtcagtcactcagacaaagccaccctggtccacaccaagacacaagggaagaccaatgttgagaaccaaccccaaccccaacccagagacagtagggagctagtccctaagaggaatggaggtcaggctgcggcgggaagcagggagagtcgctgcagtgagacaggctagaacacccctatacctcttcagaggcacccagccttccattgcttccctggggctctgacccatccctaatcagaggagttgggtttgggttgtttgaatcagagagacagaggctgtatttaaggtctggtgactgcagctggaggttgtactatacctaacccctaaccccagattgggagcagggtcttgaagccaaagagagttgaagttcctatgtgcacaaacaccaaaacactcttgtcttaaggagggttagactcactcagccagcaactcactccctctggccgccctctatgtggcctttccctgaagttcaactctcattggtatggggaatggggaggatagaagagagtggttggccccatccatccagggacatttaggtataaccctgggtaagcagagcttggggtaggggcagcggcaaagagggagattgctgctgggtcttatggactaggggctgaagggagttagaggtgtgggtaaagggattcctgcccagatttaggggaaggaaagtagaagcctgttgggaggcaaggagattttagggagaaactcccagcagtgagcaggtgggggctggaggaggttttaaagaggtggggtgagggaagagtggggaggtgggggcagggagtctgcagggaggtggggaagaggggagccgcagagagctcgtggtgtcgaggggggagtcgttaaacagaatctagtgctgatgaggaaattacacttgtttcattagcgatggggaaggagatagctcagttcctcttggtcacagttgagctcagaagctcattatcctgctgcacgcatgctttccctcctcgtcaataaacaggctttccagtggctgcatcccccacccccaccccagctccctctcagagaggggccccttctcctctacttaacccgcggttagggatcactgtaaacagtctggggtcatcacacaggagaaagggcgagggggaaacctggaggcctggcctttctcccgcagagggagggaggtagcttccgacgacggctcccaacccacgggccctccgctcaccgctagcggaccagcgggcagtccacctgcgccgcctccatcccctgccgcgtagcccacgcatccaacctcttgagggaaaggcgggagggcggtgtctcccaaaagagctcccacctcttgtgttggcactgcacattgatgccattcttaggactttctgggagaaaaatgtcccgaaggcctttcttcgccaccgccccccactcccatttccacccattaggggccatgcctcctagaaccggagtggcatctataaaggccctggcccccagcgcgacagggtggacgcgccccaatacaaacccttcgtgggtggccgcgagcgcctccgctgggaagccctgggcgggcaccggcccacaggtcccgcccgtgggtgtgcgagcgcgtcggtgcctcccgcctccccgggctctctccacgcggacgcggtgatcgccccacctccgcccggcccgcccgccacggccattaccctgcccgcgacacctgcgcctgagacccggcgggaggagcgggcggagaagccaccggccggactcgtggggtccgccctggcttgcaggcgtctgatccccactccccgaccctcccgcagggagcgagttctccggcaacccgtacagccacccccagtacacggcctacaacgaggcttggagattcagcaaccccgccttactaagtgagtacgccacctggctggccggcggctcagcgcggccgcgcggcttctgggcacggtcccactcccggcgacccgacctctggggacccggccgggccagggggacaggcttgttagtgcagcactgaggcccggggacccctcgaggacgcccgcacctcctgccctcccgtgccctccctggtcgctcgaaggctctgcgccgccctcgccctcggatcccctggagggtgcgcagccgggcgtcaccagatcgggtccctctcatgccccgtgaacgcaactattctccggggcaactggctccactgcccagccaaggtctcccagtccggatcccgctggaccccagccaggggaggtcttttctgtgcttttctttccttttttgttctcctgtttgtcctctcacccagcccattcttctcctgtgttaacttccaggttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcctcccaactacactcccgctgccacctccaactcctttgccgagacccccttggcggcagctgaaccacggcgaaggccgagactagcctgccctttagtagccaccctcccccacgcaccccggccctggggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccgaagtctgcaatgaaacgcgaagaccgcagacgcttgccgcaagtttcctcgctctgcgtttacttctgggcccgaagaatgccccgcagaggccctaggagctggttcatgggacttcacgcgcctccagtgtcttgcggagccccagccccagcaagcagcggctgaaattggtgcgccttgtgctgtggtctgggtgtgtcccggagagggcgcgcaggcgcctatgtctgtcgcggggcggtcggcgggttcctgcataggtatggctttctgttcatctatgtgttcgtctgtatgtccctggatgggtctgggggtgtggtagtaggagaattgtttttttagccatccttgctgttcttgtgtccaggtgtccagtgaaagatctgtatgtctccacctctctgttctctgtttaggagaggttgcagggggaagggggatgtggtgactgtccaggattgttctgctgcatcagagatacttgggaggatcgcctttccatcccttcagcagcttcccagctctggtcctcccacactcttgtcaacacaaagggcccagcttccacctggaaactttccttctgtgcccctgggacaccttcccagcccagcttctaccacagcttcctcccacttgaaaggctcttgaatctctgagctgccagggatgcaagcaggacattggggcagactaagaagtgaccttcccctttggcttgggacagtgtctcctagacacctccttcccatcagaatcccagagacctttctttcaagtcaatctgcccaggctcacccatatcacggcaccctctaggggatgtacaggaccccaacaaatcagcaaaccttcaataaagtccattcctttccccctccctctgcacctgtgtctcccgattcttcatctcagcaaatg

SEQ ID NO: 13850 - DNA, 86945 bp, Human; identical to SEQ ID NO: 13849
  misc_feature (1)...(86945): n = A,T,C or G

SEQ ID NO: 13851 - DNA, 86945 bp, Human; identical to SEQ ID NO: 13849
  misc_feature (1)...(86945): n = A,T,C or G

SEQ ID NO: 13852 - DNA, 86945 bp, Human; identical to SEQ ID NO: 13849
  misc_feature (1)...(86945): n = A,T,C or G

SEQ ID NO: 13853 - DNA, 86945 bp, Human; identical to SEQ ID NO: 13849
  misc_feature (1)...(86945): n = A,T,C or G

SEQ ID NO: 13854 - DNA, 86945 bp, Human; identical to SEQ ID NO: 13849
  misc_feature (1)...(86945): n = A,T,C or G

SEQ ID NO: 13855 - DNA, 86945 bp, Human; identical to SEQ ID NO: 13849
  misc_feature (1)...(86945): n = A,T,C or G

SEQ ID NO: 13856 - DNA, 86945 bp, Human; identical to SEQ ID NO: 13849
  misc_feature (1)...(86945): n = A,T,C or G

SEQ ID NO: 13857 - DNA, 86945 bp, Human; identical to SEQ ID NO: 13849
  misc_feature (1)...(86945): n = A,T,C or G

SEQ ID NO: 13858 - DNA, 86945 bp, Human; identical to SEQ ID NO: 13849
  misc_feature (1)...(86945): n = A,T,C or G

SEQ ID NO: 13859 - DNA, 10237 bp, Human
cgtaggtttccaggctaacccacaaaagcaagttgagtctagctcctccatattgatccacaccaatcatagctattctgaaatgtactttcctcacatctgtaaaatagggagaatactcatctcgaaggattggtgtagagtttatattgttctccataatactaacatctgtcttgttgtatttgcttctttgcttattgtctgaccccctctatagaatgtaagcttcatgaggtcaggacctttgttttgttcactgctatgtcccccatgcctagaacagtgcctgacacatagtgagtacagtactcaataaatattattgaataaagagatacattctttgttattcacccaagatgaccatattttgttgtttggggctgtattcttcaggagagaacagaaatgaataagccactctctgcctccaagaagatctcttcaagtggaggtgacagacatgcccaaagcaaatagattgcaataagacttgatgggagagaatgtgagtcttcacatcctagcatctttccagatagagacagggcctacccaaaagtctaatctgaaactgaactgaaatagaacagaaatagatcccaagtgatggaacctgtgcctttcccaaagcttggcttctaaaaggtagcaaacattttctactggagaggggaaagacaggaagaagaaaaagggagtttcctccttttctcttgggctctcagccagacagccactggcaaaacgttggaaaggcctaaatttgtcctggatgcacttccctgatcctagtcccaccaagcccagcccccacggccttaagcccctatggctccctcccaagattccaaacgtaagaaaagaacacacaccacagtccaaaggcttcttgtctggaatagccaaccctggggtaattgttaggtggaatgcaatctggttgaattcattcaaacactgtaggaattgcctctttcgaaccctgtaggattttacttcttgacgcatctgtttatttaaaaccaaaggggtatgttgaggcatgggcaccctggcagcagaccccaaaccaaccctcttgacttgtgcctgcctttcaggatatgttcccttcctgaatttgtctaagaaggctgagttggggggtggttgctgatttttataacatatagccagttgttcataggcctgtgttttaaagaagggcaagcctgaactcaccgtcctgcctcagggcctgggctccatacctggggagtagacagtcttctactttctaaaaagctggacttgaaatttggagtaaatctcctggttgagtgacaggtgtttcgcagctgagcccttgaggagattctccagttgggcagagacatcccttcctcagacgccttgtgggctggactcctttggcccagttcaaagtgaggggagggctcccaacaggccgggaagacagttgacttcaccctccttgggtttgtctgtctgtccgtctctgggaatggtcgcttcctgttttcccttttccttttaagcctcgccttgttcccctcttctctctcttcatgaactactccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctgcgctccaggtcgcccagctcttcttggtgcttcccccaagttgagccgcccgcccgattctataacgcagactcgccatgcttgaagagttctctcagcctggacccctctctgtctcccgaaggacccctgctcggaggagctctccctggtcccctctccggatccactagccgggtcaggcagagagaaggaggccatagattcaggaccaccttctgcagctactcttggcctgggaatcttagagaaaggggtgcaacgtgaacagtttcttccgtcctggctgctgttctaggacccaggaagcgagccccaggatcagacacaagaaaagaacaggttcccccacctccagtcccctacacacatgcacttcgcgcccctagctccggtgcccgtggtgctgcggggccagtgggggctctgagccccggtaaatcagcagaaccagtggcctttttttttttttccggagagcaggcttcatctgggaggatggcagcggggcttagccgcccaggacagctagcttttcattttcgttctctcccggctgggtgtcctaccccgggcccagccctgttatcttgggcacgaacaatgcaccggtaggctggtgatcggtggcgggaagactactcccgggacattgggtactaagtggtggccgctgccgccttctctgctgcccgctcccgccttcctctgctggccctggctccctctgctcccgtttccactctgggcactcaactctccctctggcgtggatcccttcccccgttctcactttctgctccccttagggttccctggatcctagaccacgatccttccgtccgggctgggaagcagccacaaattgagcccaggttagccagccgatcttagagagaggaggcaggaggcactggctgctgctggcagagatggggcctcctgggggtcccccggttcaagggcccaacagtggaaggggggtttacataactacttgggagaagctgctgagagctagatactgggccaggagattccaaagcacccctggcttcctgcttctgttccaggcagcagcacagccagggaaactgcttctgcagcttcttaccagactctggggccacggcagaagtggtgtggaggctggtgtccagaggaagaacagttgcttgggtctaggcctcaggaagggccctccctagaggggtcccagtgcccccaacctaagttttctctggcctggggcagcagggcctggtgcccatcccattccccacccaggccaggccagtcttgaagggccctgctggaaacccagccgggagtccactaatcctgggcctctggtgaaaggtactcggtttagggcctaccgcggggccctaatactgtgtcaggcatgaaggcggtttcagcgagtgtatggctgtggccttgttttgctctgtgtcctgtgtgcttgtcccgtgcctgtgcttgtctggtcctgtttgggtgtatagatctgtgagtttgcccccgttgtacgttgtgttggtgtgtgctgctgtggatggaggctcaggtcgggttccagagtcaggctcggcctcttactctgagcctgaaggcctggggctgactgaggggaggggagcgtgaccattagctcgccttagactgcccctggaggagaggcggcagggaggtggttgggctcgcgggagcccggggccagggaggcctccgtggtagcggcgacggcggcgtcggactggcgggcaggaggaggccgtttcccgccgtgggcttgtcgctgagggctaacgggaggatctcggccctgctcgtgggggttcagctgctgcgctcgctgactcgcggggtgttgggcctgggacgcttcctgacgctctgctgcttgcctctgccgtctgtctgtctcccgctccagtggccctctcacccttcactgtaacacgccgtataggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagccagggctagctcgggggttggggggactccggtttccaaggcctactgagggctgctggcctaggggaggagaggcagcctggcaggcctcccagagagaggggcacagagaaagaaagaggcaggcaaagagagaaactgaaacacaaccagtttcagaggtggagagggatagggaccccgctcaaggaaaaaaaaggagaaaaacaggcagcctgcagaagtcttatttatgtataataaagaaaaagcaatggatgactgaaaccaccattttcttttcaaacaaattcctttaattcagagagaaccaagtgggtggggaggagagaaaacgagagataagacacaaagcctaaaagagaaatattcaggccgtttgaaatgcaggggataagggaaagacgaaagacggaaagatacacagagtcaagaaaaggcggcccagagcaggtcagcagccgctgctggaagaggcccttgcaggcttcgcatggcttcatcgatcgcctacaaattgcttctgaaggccccagggactcccattaggtctgtccaccttagagacagacgtttgatctcagttgacagggtggaggggcggcagtaaatggaataagtgagtcatcgcctccctgaactgcctcagaggaagccagtgggtccagcaggagccccggtagggcacagggctccacacagaaggcccaagtcctagaagacattcgcagagagagggaggaaagagacgtcccgcagagcagatcgtacccgctggtccttgcctctctgccctggacttgtgggtagggtgagggccctctggcttggaatggcacctggtctccctcagggccggggagggggaggcgagatgccatcctaccccggctgccccttgtgaggcctccggggtgtgggcgctgcgcgtggatgcgagtcccagctgtttgggcctcgcagactttcccatcgctcctcctctgggataccttggctccatccgctttggggtttccagtctttgttggagtcaggactctcaaaagaagggaacgcgttataggggcccaaactggatttggggactgcaaaggcgagcagcgctcgttcagtttatctcctgggaacgcaccaggagttgggcacacgcgggagctgggtcggtgctcctggcaggtaacggcttgttcccggtgcagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctccggatccggagtcagggctgcctgctccttgcggaccctagcgtccttcagctacttgggtttggtgtgtgagctgatgcttcaggggcagcccttggtacctgaacttgagagacatgttgcggggcaggaccctaaggctctggagagaggaaaggaagaggacagatggagagaaggcagagttgaggagagcagggagagccaggctctcctgggattaccagtgcctgagaggatgtggatttctttggatgtgagagtcgtgtgtgtgtgtgtgtgtgtgtgtgtgtgtgtgtggtgtgtttgtgataatgtgagcaatcagcaatgcgagcaaatagtgaatatttataatggtatttaagtgtataattgtgtttgcaattcttgcgtgtaaatgcttgtttctgcttaagttgcaaatcgaaactatcattgtatgcacgggcttgtagtggtgtgtgtgtaaccgtatgtgaatgtgactgtttctttttgggtaattgtgtaatcaaccattgtttgtgattatgtatgaatcgtgttgatgtttgggagaatatgtattagtttctctttgtaaatctatttttctgtgaaatgtgtgactgcttctgaagtggatcatcttgaattttatgggtgtaattgtgtgtgagatgtaattatgtgtgagctgtgcattttccctgtatttacttgtgtgtgacagaatgtaattgggggagtaaaggtagtggggagtgtggatcactgtgggagaccatcactgcaagtgggtgggtatggttctgtatgagtgtgtgtaattgtgtgctgatggtgtatgtgttggtgggagtctgttgtgcgatacgcagatacattgtggcgggaccaacatctgctgaagttctggggctctagacgcttacccagcaagctgcagagactggggcacattgaatcagaaattaaggccagaatcctctctggtgctgtaagtgggacctaccagttcccagcactagcctggcctaggagagatctaaagaattgactttctgggaacctccaggagccctccagaccacccttgccagacctgcagccacagtacacatgcacacaggcataacagccagtccccagcctattcgaattatcctagacaagactgacttgggtctgcttttctggaagaagctgtgtggtggagggtctacagaactcatcaccctaggggtgagttgaaatggaggggtaagaggctttttctctgggatgggagagtgagagaacttttcagctgaaagtggaagttcgtggtgtgggggtcactggaagctctgcagaagtgtttgcgggatactgagggtggggagccaccctaactgtcagaaccactgtcccccaaccctgcccctgcccggcagccatgagggctgtgacacaggtcgtgagcacagcaacttcccaccccagcaagcccatggggaagttcggctgagtggagggtgggcttggtcatccaccccctcatctggggtcccctgggatatccgcataagagggggcttctgtcactcactttgtgtagacatgaagaaaagagaaaaagaggggagggttcagggtccgaagacagcagccagcctttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcct

SEQ ID NO: 13860 - DNA, 9695 bp, Human
tgcagttggtggggcaactcttcactgtgcttgcacctgggctggggcaggatcctgaacctctcgggggcgtagcccgcggaacgtggtcggcttgttggtgaaggggtgccactggccctggatgctagggttgtcggtgtggaagggcttgcggatgcggatcacgtccaagcccgactggtcggccagcttctgcaccagcgtcgagatctcctcgaccgacttgcagtggatgctctcctcgcgcacagccccgttaactggcagaagaggggtgagagtgggtggaagctggccggtgcgaccaagcgagaaggaggatagcgggtcgagcccctgatcccgccctccagcccgagcccggccccactcacggtattcggccactactctgggcacgcagcacggacgcgagtttacatatattacgacccctggattccgtcgggcgaagtcgatcacctcccgctccacgaactccctaagcgacccgggacagtgagcagtatgacccctgactgggggcgacctacccggggagtcgttgccacctccacacccaccccgacccgcgcctgcgcacttcccttggctcacctggcgccgcgagacgaggcgccgtcgcggctgacgctgaagctcagacgctgcagctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacaggtaaccctttgagaaatcactacttagagtaaaggggcagaagatcaggtgacaaaagcaagtgggtttgggccatgacaatgttgaaaagaaggttggccctttccccccagttttaaagccctgacctatgtcttggtttcaagggtaggacttcctcctcacccaggtctgttccaccccactgcagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggtgagactcccagattccagccaccttgctttcccagacatatcccagcactcaggaacctttggttccttttccagctccagtaggaactcccccatctccttaggtttggagtttttcaaagaatgagagggcagggctggacacactggctcacgcctgtaatcccagcactttgggaggctgaggtgggaggatcacttgagcccagggatttgagaccaacctgggcaatatagggagaccacccctctctataaaaaaatttttaaaaattaggctgggcatggtgatggcatatgcctgtggtcccagctactcaagaagctaaagtaagaggatcgcttgagcctagtaggttggggctgcagtgagctgtgatcacaccactgcactccagcctgggctacagagcaagaccttgtctcaaataatagtaataataatagaagggcagaggaggcagccaagagagttttcaggatgctagttcttctgcctggggtggtctagagacaacttgtcaaattccttgcctttcctcttcccaggactgtaatagatacaatgcaacatgcagtctacgtctatgacatttgtcatgtgatcatcgacaacctgcagttcatgatgggtcacgagcagctgtccacagacaggtgacggtgacatcctctcttgtctagcttgagcccgcttggacatacaacacacacttctcaggcagctggcctctaggcacacatgctgtgctctcctattttctgagatgtgtgcaggcacgtaccacccccatgtgtatcatatggaggtgtggggtatggcagcaggatgtatggacagggatctgagtgtgagtccttgggtagagggaggtagagtgggttgtggtagtttgtggggagatgtgaatggatcaagagtatgtgtatgttcttgtccttctgtgtctgataagctctttgtgttgttgggatggcgtaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggtaggtgtgaccagggacagccctcattcagccttaatcgtcttgactgtccatccgaacaggcaggaggcaatgcctctggggccatgacatgaggaatatatgtgctggaaatacaaaggctgatagttggttcttatgctcttcttgtcccccaggagctcacatcctctcctggggaaacagtaagacagtgattgcaattcagtatgataagagtatgataggcagcacaagtatttggagagcaaagagaaaagatgtctgagtcagcccgggacatctgggagacttccagaggaggtgacaacaaaggttgggttgaggtttggtagacaatgggtattagacaatcagataaatgtgagggccttctgggcatcaggaccagcccaatcctggagcttctagtgttacactgaatgcctattacatacgaggcctgggctgggcctagggaattcagagcaaggagcacaaatcatgtgccatgatggaacaaacatggagctgggaaagagagtaatgcagaagtggaaaaatggcagggtacagtggatcacacctgtaatctcaacactttgggaggctgaggcaggaggattgctggggcccaggagtttggcaatctgagcaatgtagtgagaccctgtctctacaaaaatatttgaaaattggccaggcgtggtggctcacgcttataatcccagcactttgggaggccaaggcgggtggatcacgaggtcaggagatcgagactatcttgctaacatggtgaaaccctgtctctactaaaaatacaaaaaaaaaaaaaaattagccgggcgtggtggcaggcacctgtagtcccagctacttgggaggctgaggcagaatggcgtgaacccgggaggcggagcttgcagtgagcggagatcgcgccactgcactccatcctgggtgacagagtgagactccgtctcaaaaaatatatatatataatatatatatatttaaaaattagctgggcatggtagcatgcacctttggtcccagctactcaggaggctgaggtgggaggattgcttgagcctgggaggttgagactgcagtgagccgtgctcacaccactgcactccactccaacctgggcagcagagtgagaccctatcttttttttttttttttttttttttttgagacggagtctcgctttgtcacccaggctggagtgcagtggcgcgatctcggctcactgcaagctccacctcccaggttcaagtgattctcctgcctcagcctcccaagtagctgggactacaggcatgtgccaccacacccgcctaattttttgtatttttttagtagatacggagtttcaccgtgttagccaggatggtctcaatctcctgacctcatgatccgtccgcctcggcctcccaaagtgctgggattacaggcgtgagccaccgtgcccagctgagaccctgtctttaaaaaaaaaaaaaaaaaaaaaaaaagaatggtctccttcatgagatgtgacatttagactgagacctaaaagagaagaagctgaggttgagtggggtggcccgctgtggagaaggagagggaacagcacaggcagcgtctgaaacagtagcaagcttgtcagggaactgaaagatttgagtggccccagcatcgtggtcagtagttcaaagagctttggtcatggggggaagtacttttccctctcccattctttctctttttttttttcttttttgagacggagtctcgctctgttgcccaggctggagtgcagtggcacaatcttggctcactgcaacctccgcctcccggattcaagcgattctcctgcctcagcctcccaagaagctgggactataggtgcatgccaccatgcccagctaattttttgtatttttagtagagatggggtttcaccgtgttagccaggatggtcttgatttcctgacatcgtgatccactcgactcggcctcccaaagttctgggattacaggcgtgagccattgtacccagcccctctccccattcttatcactcctccctgccctgtcagcccccctttctgctttgctcatgtcctcttactcctgctttcctccttctgccccctgttccccaggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcctttgtttctgtgctttttcttattcatccaccaggtgtctccccagtccgtagctgaatttccctttcgggattgggaatggacgggtcccctcccactgcttgcagcctttgagcggtgggcttccaaggaagcagggacattaaagggccttcacaccccaccttccatttacatctcttcttggcctagggaagacaagatgatctgtcctcatacctaacttccctgaggatctcgagtgattcctggcacaggtactcatcactgggccacatgagcccagtgccctgcctgactggccattcctctgtgatgtgagccactcacctctcaagtggacttagactcaacatattctgtccacccccatccatctccctcctgtaccctctccgtgtttctcatatgctaatgcgtgccagaactcctggggacttgtgaaaaatgcagaaactaggccccattctccccccatcctccaccacgtacatttctcattctggatttgaggacgggtacagtaatcctcatttttaacaagccgtggaggagactgtaaaataggtgacccagagggactgtcagaagtattcctaaatgatgacaccttctcatctctcgtcctctgatatcccaaagtcccagtttccctttggatttgcctgaaagagtcgtgagaatgcaatatgttctgagggggctggggagaatccttttgtaagggttgggggaaggtttcctgctccgtttggaagcagggctgccttgtcaggctcttcctttcaacctatgaaggggcttctggggccgatggaggggtctgtggtctctggagtgtgagaactctggtcacaaatgtctcctgaaacatccggagcaaggctgctggaaagctgctctctgtgaggaagaacctgggggggtggggagagctcctccagggcctcccttcttgggggtctctcccagactggctggagccaggcctccctaatcccgcagtaatcattcccagccgttggctggtctaggcctcatccagagtctgtaacgctgaacggcagccatgccttccagaggcacaataccatatcagtcatacctgtaaggatgtgggttccacattcctgtctccctagaatgcctggtgggttctcaggagatcttttaggggtttccagtaggggacctttgtgaggtctctgtgaactggggatagagggatagatacagacttggctgtttgtcttgccccacccttctagcagacacccccacacagcacaaaccagaatgatgagggggaggggaagctaatactccccccagccctacccgctgcacaaacacgttctattccatacctgccttaaataccccatatcatgattccacccagtctgttcagatccctggattctagaaagcagtggggggtccctagggcctgtgcggattccctgggataggactggtctgtctacacccaactggatgttaagaatctccctgactcacaggttcggtggattgggaggaaaaaaaaaaaatttccctgagatctcaggaaaggcctggctaagccaggtccagttggatctacagccttgtcctctaattgataatgtatgtcacacttggccatgaggggacagctttggtcctctggcagcttcctctctgctgtggatgggtttaagaagaaacaactcggccgggtgcggtggcttacgcctgtaatcccagcacttttggaggccgaggcgggtggatcacgaggtcaggagtttgagaccagcctggccaatatggtgaaaccccgtctctactaaaaatacaaaaattagccgggcgtggtggtgcgcgcctctagtcccagctgctctggaggctgaggcaggagaatcgcttgaacctgggaagcggaagttgcaatgagccaagatcgtgccgctgcattctgggcgacagagcgagactccgtctcaaaaaacaactcac

SEQ ID NO: 13861 - DNA, 33379 bp, Human
  misc_feature (1)...(33379): n = A,T,C or G
cttgctcctagtggtgtagaatacatacttgcccccaagaagctatactctgccacaaaatcacaagaacaggcaaggatgttgattctcatcaacacgcacatggtgtaagatgcttggtaccttatcattgttatagctctgggcccatgatgagtcattatggttgtgcattcacagacatgcctttgtagctgaacaagttaaaagcaggtggctcatgcctgtaatctcagcactttgggaggccaaggtgggtggatcacttgaggtcagggtttgagaccagcctggctaatatggtaaaaccctgtctctactaaaaatacaaaatattagccgggagtggtggcaggtgcctgtaatcccagctacttgggaggctgaggcaggagaatggcttgaaccctggaggcggaggttgcagtgagctgagatggcgccactgcgctccagcctgcgcgacagagtgagattccgtctcaaaaaaaaaaaaaaattaaagaaaggatgtttgcccatctgaagcaaagtattgactggacttatctaaataccggattacaagaaaaagaggaactggctatatcagagtgagagaaagtgggagaggttgaggaaacatacaagaacctaaaagaaagggcaataagtatgagcatagctttgctaatctcggaaatggtggccagaactgtcctgtggtttagcaaatgatcatagccagcaaatcctaattaccctagaagcttcctttagaagtgccacaaagatgtaggaggtatgcttatccgccttgtgacacaaaaatggaagcatagttaatagatgagaaaagcatgacccagaatgattttcaatattggaatgctgggaatttatgagaggtattttcgcgtaagaataataggacttgtttaaaaggattggagagtggggggcatcccagatgcgtgagaagcagtatagctaatggttagaagcaggtttgctggagccaggctgcctgggttcaaagcccacctctgctgcctgttagcttgtcagctgcacaaccacggggtgctttcgagccttgtgtgcctttgtttccccatgcacttcatgaggctgttgcagaaattaaacgagttaatatatagtcagcagctctgaacactgcttgactgagtcagccctacctaacgtttaatttaagggatgtggccctgggttcccaaagggagcggccactctattcacaaacataaaagcagtaaaggctccatcctcatcaaccttctcctcagttggaccccacaggactgtctctcgcaactgttccctgggctctcctaaggcactgcgcggaaccagctgcacctcttttgccttagatcaggctttcccttctccgcccgttttgggatttaacaagcacgagaaagcagggctgcagggaagccgcgagggcctcctcaccacggcccgggatcaagtcccacgcgcgaggccggggtaggggcgtcatctgctccacacccagaggctgggcacgccccgcacgcgcggcttcctcctcctttgcggggctcgccgcgacccaggacccccagactcccggatcccctagaccctctggactcctaagccccgcaactcccaaatcccaagaccccggaccctcgaaccctggcccagggcgcgtggctgggggcctgaacccgctccagaaacccgcagggcagtctgtcggaaacccccgctttactcagcaggaatttagtctccgcgctccccctaaaacccgggcgtcctctcctctgtaccctcgctcctggggccctcacacgccctccgtggctgacctccaagccgggcgggtgcgctgtgcgacgcggaaagcgccgtagagcacgcagaacacgattggctgagctcccggaagtgacgtacctcaaccgcccgacagtggaagtcccacctgcgcccgacggcggaagttccgggagtgccaagtacccgcgtgcatacggctgccggcatggcacattacaacttcaagaaaattacggtggtgccgtccgccaaggtaggcggccccgggagggccactgcaactttcgcgttctcctcagctgggtccccggggagggtccgggcctgtagccgtgggagagcggtcgccttccgctcgcccatcccccgctcctgggcctgaccgtctggccgcgtactcgggatcatttcccctcccccagcagaatccggggtccaccagagatcggatcccccagagaccggggtccacctaagaccgtggtccacccaaagactgagggcccccagagatcggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggttcgttgttctcgtgatttaacgtttcataatttttaagtcattctctttcactgttagatttgggaatacctgttccttttcagaccatagtaggcccagactaaatttttacagcgttggttggtgtggcaagaatgagtcaacaagtgttgagtattaggacttttttttttttttttttttttgagacatagtttttcgctcttgtttcccaggctggagcgcagtctcggctcactgcaacctccacctcccgcgttcaagcgattctcctgcttcagcctcccgagtaacagggattacagtcgtgcaccaccacacccagctaattttcgtatttttagtagagacggggtttcaccacgttggccaagctggcctcgaactcctgatcccgggtgatcctcccgccccggcctcccaaagtgctggaattacaggcgtgagccactgcgcccggccctagtattaggacttttaagaagtcacgtttttatgtagtgaacattcgatttgggtcgcaattacacagacattgacgggcaactggagcctcccagggactcctgcacgagagggagttactgaagtccctgcagagtgactgttttcccctcgtcagtgcctccttttcttcaggtctcaaggacgggatgagcttgccttggaaagctttgtgggagtctcgtattttaccttcatagcaaaagttgtttccccacttctctccaccatttcttatttcttcctgacagttgttctggcacatctcttgatcgattgtagtattttctttctttctttttgagatggagtctcgctctgttggccaggttggagcgcagtggtgtgatcctgactgcagccaccgcctcccaggttcaagtgattttcctgcctcagcctcccgagtagctgggactacaggcatgcgccaccaggcctggctaatttttgtattttcagtagaagtggagtttcaccatgttggccagactggtcttgaactcctaatctcaagtgattcacttgcctcagcctcccaaagtgttaggattacaggcatgagctactgtgcccagccagattgtagtattttcgagtgcaggagtcatgtcttatttgtatttttggtcaaccatctctcaggtttgttgaaggaatttgctctttggattatatgaactttgttcatgttattgacttatgtggagaactttagaatatattatacaccatccgtcttctgttctgtggagtgagatttatatttttagagaacagatgacttatctaaaaaatgggtgatggtaattgtttggtgattggaagtaaaaaaaaaaaatcacatcgggaaagtgtggtattcagttcattctagaagatgttgagtgagtgcctgtcctgtgcatcgggtactgtgttacaaaaatgcattagataaaatacctgcctctttggaagtcattttcaagagaggtaagtcgaggccgggtgcggtggctctcgcctgtaatcccagcactttgggaggctgaggcgggcaaatcacgaggtcaggagatcgagaccatcctggctaacacggtgaaaccccgtctctactaaaaatacagaaaaattagccaggcgtggtggcgggcgcctgtagtcccagctgctggggaggctgaggcaggagaatggtgtgaactgaacccaggaggcagagcttgcagtgaaccgagatcgcgccactgcactccagcctgggcaacagagcaagactccatctcaaaaaaaaaaaaaaaaaaaagtggggtaagtcatatctcgtatgaccatactagaaataaaacattgttatcatggaggacacacatggattgggagaggagaagagtgtggttagctgtggtaagttggagagtcagggggaaccttatgaagtaggtaacctttgacttggtcccccttcaggatgtgcgaacggcattaggtgcagaagaacgtagagaagatcttgtgtgggcccagaggggagaccgtgtgtgcccctcatagtacttggcagactgttgtgaccacccgtttacttgtctcacttgtaggcccagaggggagacagtgtgtgccccttatagtacttggcagactgttgtgaccacccatttacttgtctcacttgtaggcccagaggggagactgggcgtgcccctcatagtacaatacttggcagactgtgttgtgcccacctgtttacttctgtcactggaccctgaattccgtgaaggaagggacagtatcttgttcattatcttcagcacccaagtatccctaacaacctttgtatgaaataatattgagttaatcaaattgttgaattaatcaaagtgttcaagaaaaaaggtcaagtaatattgtgtggctagatacattggatttaggaatcctggggatcggatccttattaaagagaagtgctgactctttgcactgggtaactcatgcaaaaatccttcatctcctcaaatagttcccttccatctctttggaaattataaacagtggattttagttttacctgttattttatgtactttcaaagtcaagggtatgcataaacaaatgggaggattgtttctttttctcaactattctaatttatggtttgaattctctgattatttaagtttcaaaggttcttaggtgtttggaaattaagatagcatcaagaaagtatggtgtaaaatttatctttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggtgcccgctaccacgcccggctaattttttgtatttttagtagagacggggtttcaccgtgttagccaggatggtctcgatctcctgacctcgtgatccgcccgcctcagcctcccaaagtgctgggattacaggtgtgagccaccgcgcccggccggtgtaaaatttatcttagccatgtgtttcaagatgaacaaggttgtacatgaaacgtttagtaaatttttgtaatttaaaatatgtagtactgtaagatattagtgttttaagaaggtttcagggccgggcgtggtggctcacgcctgtaatcccagcactttgggaggccgaggcaggtggatcacgaggtcaggatatcaagaccatcctggctaacatggtgaaaccccatctctactaaaaatgcaaaaaattagccgggtgtggtggcacgcgcctataatcccagctactctggaggttgaggcaggataatggcatgaacctgggaggcggagcttgcagtgagccgagatcgtgccactgcactccagcctgggcgacagagcgagactctgtctcaaaaaaaaaaaaaaaaaggaaggtttcaaataaatggctcaaaagtagacccttttgatgtaattatgttttattttctttaattgcaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgtaagtgacttaggggacttctgtggttatgtaaatacgggctttcagagaaccagtgtttaaccagtttggtgtactcatttgacagaaaaggaaacaaaataattgacttaggttactcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggtgtaagatccaccactgtttgtgatcttgttgcttcatcagctgatgacagtcagttcagcactgactgttttcttctttggcaaggagagatcacatgggagctatgacttttgaatgaagccagaaaccttgagctcctttctctgctgcacattgcagtttgcctgtttctttttttctcttttttttggagactgagtctcactctgttgcccaggctggagtgcagtggcgtgatctcagcccgctgaaatctctacctcctggattcaagcaattcttgtgcttcagcctcccgcgtagctgggattacaggtgcataaccacgcctaatttttgtatttttagtagaaatggggtttcaccatgttggccaggctggtcttgaactcctgacctcaaatgatctacctgcctcagcctcccaaagtgctgggattacaggcgtgagccaccacgcctggcctgcctgtttctttagctgtagaaaagcaagagcagaaactgcctggcaaactaacaaagccttatgacaccatgtgtggggtaatgtggttgcaaggttaattgaggttgtgaagggcgtggggatcagcagtatagtctcaaagcctaaatctgccgttgccccagaatagtccctgaaggcaggtgtaggcagagagaaatgtttggcttctgtgacagtacttcatatttaaacaagttataatggctttttttttttaagccagagtatcacaatctcagctccctgcaacctccacctcccaggttcaagcgattctcctgcctcagcctcccaagtagctgggattacaggtgcccgccaccacgcccggctagttttgtatttttagtagagacagggtttcaccatgttggccaggcttgtctcgaactcctgacctcaggtgatccgcctgccttggcctcccaaagtgctgggattacaggtgtgagccactgcacctgtccaataatggcttatttttaaaatacagaagtgcttaaaatacaaaaattcttgctagaggacggacacttaggttgtgtctagctaggatttgacacagttgctcagtagatgtttgttgaatgagtgaatggtttcttgggaaaggtcaggtactagagagtacctgggggtgaagaaagtgatttaagaatgagatttttgtttgtttgtttgtttgtttgttttgagacagtcttgctctgttgcccaggctggagtaaaatggcgtgatctcagctcactgtaacctcttcctcccaggttcaagcgattctcccacctcagcctcccgagtagctgggattacaggcatgtgcgactatacccggctaatttttgtgtttttttagtagagacgaggtttctccatgttggccaggctggtctcgaactcctgacctcaggtgatccgcctgccttggcctcccaaagtgctgggattacagacataagccacagtgcctggccaagaatgagattattcttaactgatttgatattaggaaatatttgattttagccaacaacatactttgatctacttagtatcagatttttgtggttctttttaagaagttttgtctttttcatcctcagtgttatagccatcagaggtaggagagttcaaatgtattaacattctattactctttttaaagccaggactagttatctgagaacagcttcagagtggagggttagatattaagttgtcattcactgaatgcttattgtctgtcaggtactgttctgagtcctaggaatccagaagtggtaaaggttcctgctctcattctggtggagaaaagatagtaaatagcatgtcagatgaatgcagtgaagccatggaagggagtagggagtatctgtgcggggagagggtgtcaggcctgtagtcaaagaagcagcaggtgcaggagacccaggaggtggggcaggctagggaggtgaacactgggacatgggattggaggtggtagtcaagggtcgagtttatatgcactggtgagatatctcaggagatgctggcctggtgatttaaaatgcattagtaaaatgtagacgacatttaaatctatctgagatcaccttggaagggaatgtaggaagaagggtgctgtggggagcatgaatgtttggggtagagctgtgagcactagccagcacaggacttagaggggtcagactctccacctagaagctgtgaggaaaataccgcaggcaggatgcatggccagcccgcagcgtttcaagaggtctgtgagataaaaactgagaattggtcattgggaggtccttggtgagcttgtaggctgtttagatggagtggtggacacagaattctggagagagtgggttcaagagagggaggagaggagagacacagtgtgtcttgggagcaaagagagggaattggaaggattttggggctatgggaatttttgattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggagagggaaagaaattgttcttcaagtggtagggatgaaaaactgctggccccaagtgaccgtggtgtgcttttgtttgttacaggatattcatccgttctatgctgatttgatgaatattctctacgacaaggatcattacaagttggctctggggcaaataaatattgccaaaaatttagtggacaagtaaggtacttttttctgtagtgtcttttaagttatcgaaagtggaaaaaaaactaatattttttattttttacagtgttgctaaagattatgtgcgactgatgaagtatggcgactctctctaccgctgcaaacagctgaagcgtgcggccctgggacggatgtgcacagtgatcaagaggcagaagcagagtttggagtatttggagcaaggtgcttgtcacgcatccgcgggaaccgtgctagcatcctgctgagaggatgcgtccttgttgaggacttgagatgtctgtttttcttgtattttggagatgacagggtcagttattcttcctagctttacctatgagaaacagtaataggctggtttttattgaaaataaatacttacaaatcaatagcactgataagaaaatttatatatttcatatttaataggtaaggcatacacaaaaaagtcacgagaaaatactgaaaagtataaaaactaaggtggctcatagtttattattgacttttttatttttaaaaatacttgtatttaataggactttctgaattaatgtactaggattctgttgaaacaattacttgcttattgtgtgtattcttacatgacaaattattttgactcattcggttttgttttctctcctgcatcttagaaataatttttaacaaaatttgtgatacttggatgccttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttccctaatgtcatcttgctaatgagaattgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccacaggcctggactgtaactaagttgaaaagaaaatttaaagcaaatcttaaactttgaatttcttaatttttcaatttgaacttttcctagtgcgtcagcatttatcccgtttgccaaccattgatccgaataccaggaccctgcttttgtgtgggtacccaaatgttgggaagtccagcttcatcaacaaggttggtctggtttttatcgtaaagcaaatcatctgactattttacgtcagtgttactgtattctggcggcgtgggattcaggatggccttgtaggtcagtgttaactgtattctgactgcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatggtcaaattttatggcttactcagtgccaagatcactttatttttaattaaaaaaatttttttctttctttttgttgaaactttttctttttgagacagggtctcgctctgttgcccaggctgaagtgcagtggtgcagacatggctcgctgcagcctcaaccttccgggcccaaacagtcctcccacctcagccacccaagtagctgggaccacaggtgcacgccaccgcacctgtttaatttttttattttttgtggagatggagtctcactgtgttccccaggctgatctcaaactcccgagctcaagccatcctcctgcctcagcctcctgaagtgctgggattacaggcgtgaatcactccaccctaccttaagatcacttttgctttgaaatagatttgtgagttttattttgtctacaggttgctgtgacatggtgaccagcaaagctctgcagggtccttgctgatttttcaaatgcttgtcagctctgaacctgccctgagctctgagccagtgctctgtggccgatttggtggccactgcactgggtggctttttaaattgcagtttaattcagcaaaatgaaaatttcaactcctcagtcacatgagccacatactgaaagttcattagcagtgcatgactggtggcccggtttggacagtgcagacagaacatgcctgtcatcataaagagctctgcgggcattgcaggcggtggggcaggacttgggagggtgaggggaggtggtggctgtcctccaaatgccagccctcacgctgtcctagtaccccagtccttggcctggtggtgcaaagggagaggtaccaggctcctattcgatgcagttttatcgtgtgaggtttcttctatggttatttcctacccaaaatcagtcttgttaaaacacacagatcccacgtgtacacagaggaaatgaggtgattctgaaagttctcacttgttccaggtgacgagagcagacgtggatgtccagccctatgcgttcacaaccaagtctctgtttgttgggcacatggattataagtatctacgttggcaggtgagagtcttgtctttatttttattcatttatttattttgagttggagtttcactcttgttgcccaggctggagtgcagtggcatgatctcagtccactgcaaccttcacctcccaggttcaagtgattctcctgcctcagcctttcgagtagcagggattacaggtgcacaccaccacgaccggccaatttttgtgtttttttagtagagagggggtttcaccatgttggccaggctggtcttgaactcctgacttcaggtgatctgcccgccttggcctcccaaagtgctaggattacaggtgtgagtcacactgcacctggcaagagtcttgtctttaaacagaacaaatatcttggtttatcaagaacttgaaatttctccatcatcataaagaaaactcatctgagctcttgggatgcataagaacaggtcgcatgtctctgatataattcaggggaggcagccagctgccagtgtggatttctgcattttcttaacataaaatgaaattatctttgtgtcatttctaactctgttatcagaaatggcatatatacagtttaaaagcgtgaagcaggctgggcacagtgattcacgcctgtaatcccaacactttgggaggccaaggcaggcagctaacctgaggtcagaagttcgagattggcctggccaacatggcgaaaccccatctctactaaaaatacaaaaattagctggacgtggtggtgggtgcctgtaatcccagctacttggaaggctgaggctggagaatcgcttgaacccagaagacaggggttgcagtgagccgagattgtgccattgcactccagcctgggcgacaggagcgaaactctgtctcaaaaaaaataaataaatacaaagcaagaagcaatgtttccacactctaattttgtaaattgtgaagaaagtaattcctaagacatgggagggttctcagttatcccagtttttgtgttttatgatgtcgctggtaaaaagaggagtcatttctctcaacatcatggctagcatttctttgagctctacagggttcctcctcccttttttgatgtttaaatagtatgtacttttctgtcactggtttattttgtggtattcagtttgggagacctactttttttttttttttttttttttgagatggagtctctgtcacccaggctggagtgcagtgtcgctatcttggctcactgcaagctccgcctccctggttcacgccattctcctacctcagcctcccgagtagctgggactacaggtgcccgccaccacgcccagctaattttttgtacttttagtagagatggggttttgccgtgtgagccaggatggtctcgatctcctgacctcgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacttaggagagaactgttggagaagggtgctcacaggtgttacttcataaaacaggttctgtgattaaatgagtttggagactaatgattgagtgaaggagaaggaggatcttggaatttgggctttctggatctggatctatgagtgagacgtgcctgctagctttctccaagaggcaggcagtattgttggacataatttttcaaactgattgaatcctacaacctttttaataggcatccttcatgataaatgcttttagaagcgtgcactggtggagtggctttcaaattgtggtcctggcccagcaatgtcagcatcaccttcttaatttcttccttaatttcctcattgatccattggtcattctgggacatgtttataattctcatgggtggtttttttttttttttacagttttgaaagtatctcttggtattgatttctagttttattccactgtggtctgaaaagatacttggcaatttttaaaaattgatgagatttgttttgtggcctaacatatggtctatcctggagaatgtttcatggactgaggagaggaatgtgttttatgcagcggttggatgacatgttctgtagatgtttggtctacagtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccgagctaattttttgtatttttagtagagagggttttaccataccggccaggctggtcttgaatttatgacctcaagtgatccgcccaccttggcctcccagagtgttgggattataggcgtgagccactgcgcctggcctacagtgcactttaaatccagtatttgttgattcttttttgcctaggatctgtctaatgttgcgagtctgatgttgatgtccccaaatattattgaccccttttattattatataatgaccttcttgtctctttttattgtttttgacttaaaatctgctttatctgatagaagtatagctattcctacttgcttttagtttccatctgcgtagaatatctttttgcatctcttcattttcagtctatgtgtgtcttaatgtctttacaggttaagtgaatttcttggatactttttcatgttttcatgatagtgattattgtcttcgcttccagatgtaggactttcttaagtatatcttgtaaggctggtctagtagtgacgaattctctgtttttgcttttctcggaaagaatttatttctcccttatttctgaaggatagctttgctggatgtaatatagttggctggcagtcttcttttttttcttcaacactttgaatatatatcatcccattgtctcctggcgtgcaaggtttctgcaaagaaatctgctgttagtctaatggggattttcttatatgtgacttcaagcttttctctagctgtttttagaatttcctttatatttgacttttgacagtttgactataatgtgccttggggaagacctttctgggctgactctatttgggaattcttgaacttcctggttttagatgtctatacctctccccagtcttggaaagttttcagctatctcattaaataggttactaagccttttcccttctcttctccttcttgaactcccataatgccagcatgtattcacttaatgttgtcccataaatcttataggcttccttcattctttttcgttcttcctgctttttttctctctgactaggtagtttcaaatgacagagattttttttctgcttcatccagtgtgctgttaaaactgtctattgtattatctcatccattgaattcttcagctacaggatttctgtttgactcttttttacaatttctgtctcagtttaagttcttgttcatatcatgaaattgttttcttgattttgttgaattatctatctgtattttgtttctcattgagtttccttcaaaaaaattattattttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttctgtgcagcttcctcacctccatgaaatgttggcaataactgggtggctcagtggcctcagctctggaagtttgtgccagcggtggtgtatgtttttaaggtccttggtgtcaggggcttttggggtcctgctattcttgtttttcccgcaatgggggacttatctgaggggatctttcttggtgtcaggtctgacatggtctgcaagcagctgccacagtgctgggtttcagctacaggtactcagggtagctgtgggactggggtcctagccttagggtcttgtgtgcctatcatggcctggccttggggtgcaggtttactctctgtggtggatctctgatcctgaagcacccctagcagcttaagcccacagggcaaggctgtggctgtggctccacccgtggggtcagggcacagtcctggcctgactccagggaagacgcactctggaggtttgagcctgggaagcagggtagagctgtacttcagaaacctgagccagtagggagggcttagtgtcagctcaaggggaactctggaccctgggatggtggggcccagcagtatcccagactctctgatgctaggtgaggtggcagcaaggaccccagaatggactagtccagctgtcatttgggccctagaggacagggaggaggacagcagtgactccatttcctggaaagagtggtgactctgcagctcagaatatagggttagtccagctccagggagcaggtgctggagctgtttgcgtggtggggcaggtgcctcggctcagcccctgccctgtttccctggggtgtggagtacaatgtcagctcctccccatggtatgtggctggtcagcctgggcctgagggttgtgactcttctgggcgccccaggcaccgttgccctgggatacaaggtacctcttcagcatagacgctgggatatgtgaccattctgggcatttcccaggaagcagggcactgcttcagctcaggcagcagggagacaacgttccctgagaggccacggtgctatttaccaggaggcagggtaccgttgggtgctagagcaagggctagtagaggggctccacctccaccaagccctgctgggaaggggtagcagctgctcacagctggcttggggatgttgggccaccaggtttgggtagtttggaggcagtttagcctcagggatgaaggggagctgtggccacttcccctgagcaagacatactccagccgcagttccagtcccaagatgacggagtatagccgccccatgggcccaacagacagggcccagtgtcagctccttctgtgtgggagcacagctgtgaggatgccagggggctccggtggtgagggctgtgggtgtccagagtggtggcagggctgctgccatcctcttgcttaccccctcaccgtagggagaacctcctcctgggtcccgttgcatcccagctgtagggtgggttgctggcggcccagtgtgttttttttggtttgtttgtttgtttgtttgttttaagacggagtctcgctctgtcccccaggctggagtgcagtggcgtgatctctgctcaatgcaagctccacctcccaggttcacaccattctcctgcctcagcctcccgagtagctgggactacaggcggccgccaccacgcctggcttattttttatatttttagcagagacagggtttcaccatgttagccagggtgaccttgacctcctgacctcatgatccacccgcctcggcctcccaaaggctgggattacaggcatgagccaccgcgcctggcccctggtgttttctttgggctgtatttcatcgtcttgcgtttttctgctccccagggtgcctgttactcctgtgatgccctctggagctccccctcagttattaacatgtagttgttcgttattctgattgcctttgttgtgggggacagatgtgaggggctactagtcggccatctttttgatgtcatttgtgttttcttgatcatagaagaatatgaagaaaataactgtttttaggatatgtctgttttttaagactttgaaacaaccacagatgttcacatttgcagcctccatttgcagaactgtacagtttgttccatagggaactggaaatgaataatacatctctcgttttttctttgcattcccagaaaatatttacagatttgcagtctgaaggattccctgtaatagagaccagcaccctgactgaggaaggtgttattaaagttaaaacagaggtcagtgctgccttaagtcaggtattagtctttttactgtctcttgtttgattcaagtcagttgtggggagaaaatagttttctttctagacattgttaacacttggagccctcgcagtagcgaggcgggtggcgtgcgagagtggggcgtgaagacagacccttctaagacccactttgccccccgtggacagtgggttgtgaggggatgctttgctcttctcaccccaaacaactttaccctaaagcagctgttgtctctggccttttaatatttcggtagcaagtacagtgaaaattatttttatggaacctgttcgaagtagaagggagaaaagtctgaaaagcagaacagcttttgcaggaggcagtccgctgctggatttcacatgctgtcctaattactttgtatttcatgttgtttttatctcaaataaaaggacatttctggccaggcgcagtggctcacgcctgtaatcccagcactttgggaggctgaggcgggtagatcacccaaggtcgggagttcgagaccagcctggccaacgtggtgaaactccgtctctcctaaaaatacaaaattagccgggcgtggtagcgcatgcttgtaatcccagctactcgggaggctgaggcaggagaatcgtttgaacctgggaggcggaggttgctgtgagctgagatcgtgccactgcactacagcctgggcagcaagagcgagataccatctcaaaaaaaaagatggcactcctgatgccatggtcgcactcaggatttaaaaagatggcactcctgatgccatggtcgcactcaggaatttgttgctcggttagagtcctgaggggcaacattgcctccggttcgtgaagggcagttggagggcaccgtctgtgcagagggtcactgtggtgggagagaggcccaggcactggagatgcaccttccctcagggccgcttccacctgggcctcagagaatgtggccccctacgtgttagttaccttgagggaaaaggctcagtggctctgatctgtggctcctcctggaacctgtagctggaggctgctggaggatgcgtttgtgactgtgccttcttttttacgttattaggcttgcgataggcttttggctcatcgagtggaaaccaaaatgaagggaaataaagtgaatgaggtgctgaatagactgcacctggctatcccaaccaggagggacgataaggtaagacggcccctgggacagccgtgggctcacagtactgtcagcaggtgctgtctgcgtgccttttccagaagcctcccatccagcttcacacactcgcaggtggatattgtgggtgggcctcagtttcaccttcttgcttacataaaggatcgagaaggtgaagaaagtgcagaacgccacatggcacccgtttcccactgcatgacgtggtcactgttagtttatccttccagaaatgtttctgatatagaagattaatttctaaaaagttctttaaacacagatggaaatctgtttcattctttaaattttcatttttttggctgggggaagtagctcacgcctgtaatcccagcactttgggaggccaaggtgggaagattgcttaagcccaggagttcttgaccagcctgggcaacatagtgggaccctgtctctataaaaaataaataaaataaattttcattgttttgtccattgtgaatgggcacacatcgttacgctgtgtcttcatgttttactgcaaatgtgtctgcacttcaccatgtggtgttgacaacgttcctgtcccacagacgccttcctggtgtgtgctgcactgacgctggaggctgtgtccttccctctgtctttccttgtgtcctcggcgtggtcgggcactgactgtcagtcttgtgtaaagatgattttattgttgtgtgtttatgtaatgctgggtgcggttgagcatgtttgtctgcttattggccttttcaaagttctttaggctgtttatctttttctcgctgatttgttacttttgtattacaaaggttggattcttgtcagatacattgcaaatttttttctctttttgtcacttgcctttttaacttcaaatgtgctgtacatttttgaactattaacatatattaatttttttttctgggtgttcaggtttgcattgtacatagaaaggcttaccattcattccaaagtcattttaaaagtatcttttcttgctgggtgcagtggctcacgtctgtaatcccagcactctgggaggccgaggcgggtggatcacctgaggtcaagagtctgagaccagcctggcaatcatggtgaaaccccatctctgctaaaactacgaaaattagtcgggcgcgcacctataattctacctattcaggaggctgaggcaggagaatcgtttgaacctgggaggcggaggttgcagtgagccgagatcactccactgtactccagcctgggtgacaagagtgagactctgtcaaaaaaaaaaaattatcttttatactagcattaaaaattagcttttttggatagtcttcaccgtgtcttgagttggttatgttgtgagggtggaggttgcactccgtttcaagtggtcggcatttctgacctgagtattggaaattttatgtttccattgaattcttatatgcacttgagtttatgtctaaatttctttcatctgttgatccagtgttatttcttaccactttcttcttccataatttttcatgataatcatgatttctgtttttcctggataaactttggaatcactttgtggagtcctcctggtctctgtgctcaaagtgaccctgaacccactcctctcccctaaaataatctgttggttgttaattggtctcggtatgaacccactcctctcccctaaaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatcgaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaaccccactgatactgagaggattggagaaaagattgtttcaagtgacaaggggcagagcatttctggatctgaaaggcaaaatgaagctgatgataatttctctttctattgcaggaacgagatcttgagctggaaatgggagatgattatattttggatcttcagagtaagggccagagtgtgatcattattataaaatgccaattggacgtgaagtatttcagaaaatgggggaaagactttaataagtaataaaagtgtttcagcctatttgtcaacttttaatttcttgaagattaaaagttgcatcctgagggccaggtgcagtggctcacgcctgtaatcacagcactttggatcccttatgcccaggagtttgagaccaacctgggcaacatggcagaaccccgtctctacaaaaaatacaaagattagccgggtgtggtggcatgtgcctgtagttccagtgacacgggaggctgaggtgggaggatcacttgaccctaggaggacaaggctgcagtgggcagaaattgtacctctgccctccagcctggacgacagagtgagactctgtctcaaagaaaggtgcatgctgatagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttccctgttgttttgggatggtggggtgatttttgtagctttctccacgtgtgggtgttgaatgaggctgatgtgttgatgctgctgcatgtggaattgcacgtcgtgctctcttctgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctgcacccctccatcctgactctgccccctgtaccacttccccaccctgagactctggtggagatactggccctggctgggctctgctatgctggcctgcccccttcccgccgcctccccccacccaccccggacactctggtggagatgctgggccccttcgttatcctgcacccctccatcctgactctgcctcctgcacctcttccctgtcccgacactctggtggagatgctgggccccttcattctcctgcatccctccatcctgactctgccccctacaccaccttccccaccccgagactctggtggagatgctgggcctcttcattctcctgcacccctccatcctgactgtgcctcctgcaccaccttcccccccaccctgtgtctccgccaggccctggatgggctctgctgtgctgggcccttcattctcctgcatccctccatcctgactgtgcctcctgcacctcttccccccaccccgagactctggtggagatgctgggccccttcattctcctgcatccctccatcctgactgtgccccctgcaccaccttccccaccctgtatctccgccaggcccttaatggactctgctgtgctggaccctcttccttgggggctccgctgtgtcacatctttttcctgcctcaatcccctccctacttgctttttcttagcatataaaagtccacaagttttactcatctttttaaaaaacgaaaacatccttagaccgtgtcctccattagttgctatcctgccttcttctctcagctgagctgtctgaaacatgctaacatgcttatacaatacttgctgtcctgccttctgctctcagctgagctctctggaacatgctttttatacaatacttgctgtcctgccttcttctctcagctgagctctctggaacattctttttatacaatacttgccatctgcatgtcccatgttgccactccttggttcccacaggccctccgtcattgagttcacattttcagtctcgtggtctctgtgctccctgtgcctccatagcagattctgggatagcagattctgggggcaacaatctcaatttcgttggtgctggaggagtggcctcagggcatctgctgtcacctctgctggggccccagtccagcccgtgccctcactgtccccgcggtggccgcctgccttcccagcctcttcccctctgcagtgcgcgctcttgggcgcaagaagccttgagacttccctcctccgcacagctgtgcccgtgccatccccttccacgaggcctggcccccgtctcaccctctgcactgctggccagcatctcgtacaggcacatctgcctgctgggctcctggccgggttgcctcattggggggtgataaacgtgtgtgttttagttttcatttttgtcttatttgtagccagtgaggttgtatttggggtgacattagaacggacacgtgggatgtggcacgaaatcagtgtctcaggactgagttccttgtgtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttagtggggagatggagtcttgctgtgtctcccaggctggagtgcaatggcgccatcttggctcactgcagcctccacctcgcgggttcaagcaattctcctgcctcagcctcccgagtagctgggattacaggcacctgccactacgcctggctaacttttgtatttttagtggagatggggtttcaccatgttggccaggctggtctcaaactccttacctcaagtgatctgcctgccttggcctcccaaagtcttcaccacggggcggaaggatccgcgctggagatnnnnnnnnnnnnnnnnnnnncggctcttcgcccgtggtgaagagctggttttcttgttctttaatttctgcattaaatctggactctttaggccgggcgcagtggctcacgcctgtaatctcagcactttgggaggctgaggtgggtggatcacgaggtcaggagattgagaccatcctggctaaaacagtgaaaccccgtctctactaaaaatgcagaaaaattagctgggcgtggtggcgggcgcctgtagtcccagctactcgggaggctggggcaggaaaatggtgtgaacccgggaggcagagcttgcagtgagccgagattgtgccagtgcactccagcctgggcaacagagcaagactccatctcaaaaaataaaaaatttaaaaaaaaatctggactctttagcaatttacagaaacctgacgcagtctacaaaaggcaatttattggctctgtggcagggtgggactgggggaagaaagcccacatgcagggcagttaacatgtaaccagagaagtcacttgacattcaggatgcctctcagtgggtcttcctgtttgaatacactgttttcacatggtggcaagtgactggttatggcggacttggacatttttgtacttctccaggtggggctcagccatctctgggaggagagaggttggcgcactgcctttgtctgaggccacctcactaacctcagctttagtgtctcacctctgatggagacggtcactctctcccctgtgttgcggtgaagaatggacagacgtggaggatacgctgattcttcccacagcaactgctctgttaatgttagttttcgtgggatttaattgagctatccaaaaacatgaaagcggggcccaataaaaattacaacttctaaaataagtatattataattgttgcaaaatatgtatacatatatattgccttgaagtttttttcaacatttcatcaaactaatttaaagctaatatttctttttatccttctcaggttcagaggacagttttggagaaggagatgcgtagtcttggtgttgacatggacgataaagacgatgtgagtgtgggggcggttcatgtgtttatgtggctggatacacctttttaataaagaaaactggccgggcgtggtggctcatgcctgtaatcccagcactttgggaggccaaggcgggcagatcatgatgtcaggggttcgagaccagcctggccaacatggtgaaacccagtctgtactaaaaaaaatacaaaaaattagccgggcgtggtggcgtgtgcctgtaatcccagttactcaggatgctgaggcaggagaattgcttgaacttgggaggcagagattgcagtgagctgagatcgtgcccctgtactccagcctgggcgacagagtgagactccatctcaaaaaaaagaaagaaagaaaccagggttttggaaagccgtgggaacgtgggaaattacagcaaaaagaaatgagagcttccagtttttctcttttgagatttgctggccctgggactgacttgaagtgatgggttgaggattccctgaccctgggtctgggttgaagtggtggattgaggctgcactccagcctgggcaacagagcaagactgtgtctcaaaaaaaaaaaagctccacagccagcacgagacagcaccatgacgtgcccagggtgtggctgcagaccctgtcctctagatgtgcagtctgcagtttccgtctgatggtttctgtctgatggttgtccctttgtgttcatatcagtaacccccaaaatggggcagtgagggagagagcattgtttatatctgaaatataaattgtgatgctatactataataatcacttttaaatgagagttctaagtttctttaagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagcggggctggggtcctgagctctgagcctgggagtggacctggggtcctgagctctgagcctgggagcggggctggggtcctgagctctgagcctgggagtggacctggggtcctgagctctgagcctgggagcggggctggggtcctgagctctgagcctgggagtggacctggggtcctgagctctgagcctgggagtggacctggggtcctgagcgctgagcctgggagcggggctggggtcctgagcgctgagcctgggagtggacctggggtcctgagcgctgagcactgagcctgggagtggacctggggtcctgagcgctgagcctgggagcggggctggggtcctgagctctgagcactgagcctgggagtggacctggggtcctgagcgctgagcctgggagcagggctggggtcctgagcgctgagcattgcttcccctgctttgcaggcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaaggtcagtctctgtgttgtgtaatgtaataaaatgacagtctctgttgtttattgcacagggttcagggcaaacaccagcagttgccatttgcaggaactatggcaggggttgtgtgtactgcatgccctcgttttgtggcatcctttagaggagagcacgggtcagggtgcaggtggatgcccctgacagctgccctggatggacccctccttggcactttgcttttgcggagggtggccagagcatggtctgacagcactagcagtctgggcttagaccctgctgtctgaagagggccaggaagtggccacagctgagcaccaggaggcctcaagtccagcaagccccccatgggaggaacagcagagggaactcctgggttgattggcgggtgatcctgctcatccttaggttgcaggattgttccccccaggtggagagcttgagtcacatttagtttatttgtagcgtcttttggcaaagacacttaagatggacacagtctgtcttgctgaaacgtccttttattaaacacaacaacttttagtttcagcgttgtggtaatggagatgcaggagagtctgtgtataaactgcagtctccttcatggaagcctgagcttcactcctctgtgccatggccatcttgaaacctggctgttaatattggcattgccacttgtcagtcagacctgaggaaaacaggttcatgggcctgagtccttagcttgtgtaagagggagttaaaacagatgtgtgctaaccttctaggtctaaagtgtatctagtcctgggtataaagcttgtcctgggtatgattttcatccagtctttatacaaaaatactcattgagttcctgcagataactgtgctgggcttaagagaaaagagatgtaacagggataactgtgctgggcttaagagaaaagagatgtaacaggggtaactgtgctgggcttaagagaaaagagatgtaacaggggtaactgtgctgggcttaagagaaaagagatgtaacagggataactgtgctgggcttaagagaaaagagatgtaacagggtctcttcgctgagcagacctgagccattaaacagattgttacccagtagttgaaattcagaatggaaaattggttttaagtaatgaacatactttatttttttctcctccttttagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcctgtagttccagcactttgggaggccgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgagtgacagagagagactccgtgtgaaaaaaaaaaaaaaaataccaggtctggtttttgaaattctttctccgtattaaacaccaaaacttaacatatagtttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtagtcccaactacttgggaggctgaggcaggagaatggcttgaacccgggaggcggagcttgcagtgagccaagatcgcaccactgcactccagcctggtcgacagcgagactccatctcaaaaaaaaaaaaaaaataccaggtctggtttttgaaattctttctctgtattaaacaccaaaacttaacatatagtttactttgtgttaaacaacaacagtatgttttaaagcaagtatgtctttatttgtaagcatattactgaaacgatcaaatgaacagaagtggataaacgtcgagtcacttggctgagatcatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtctgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgct

SEQ ID NO: 13862 - DNA, 36387 bp, Human; identical to SEQ ID NO: 12370
  misc_feature (1)...(36387): n = A,T,C or G

SEQ ID NO: 13863 - DNA, 132871 bp, Human
  misc_feature (1)...(132871): n = A,T,C or G
aagtgattctcttgcctcaacctcccgggtagctgggattacaggcacactccaccacgcccggctgatttttgtgtttttagtagagacgtggtttcaccatgttggccaggctggtctcgaactcctgacctcaggtgacttgcctgcccgcggcctcccaaagtgctgcaattacaggtgtgagccaccatgcccggtccatgtcctgcttcttttaaaacaaccaaaaatagtccagcctaggaaagggagtctttcctgattttggcaaagttaaaccaggccataggtaacacacagcataaggcaggcgttgggagtgggccccagtcgacagggtgccaggactgtgggctaagcagggctggggacatgggaggcctcagtgcctgggctatgggaagtggttgggaccctgagcctgaggtcagtaacatcccaactcctgacaggcaagaaagggcacctgaggctcccaaggggagtccaccatgggggtgggggagaccgctggagtccataggtccctgtgagggacggcgaaggcgggcctgtcacctctaaaagagctgtgcctgtggcgcagacgggggtgccactgtggcctggtgagtgtggctgtagaacaagcatctgttgggctaatggagccagagacatggtccaatgtctctgatgtccagatagacttccagcagccaggtcggactatctggggttctggaacgttccatgggtgaagctgtaggaggagatgctggacttcctgcctccactcacatgagtcactggagcaatacaagaaggcagactggccttggctactcacactggtctcagctctggggtagggctctttataagccttcttgagaagtgaaaaatgcaaagtcctttctgtcccctcaccactgacttgcaaactccagcgaaggcctcacccctcagctggcccagagcctcccagaagccctcccttcgcttcccacctcgccaggcccagccaggctgggtgctgccttggtgggcctaggtgaatcactgacacaccactgatgcctttggggcagaaggcagaggcctcgggagaaatgcgcaggccccagcggcctggtggagggtgcagggggcgcaggggcagccaggaccgccgaggacgctgggggcacgtggcaaactggctaccctgtccacccgtgagcaagacaccactccgggggcgtgggagggtccaagggagggagaaaggaaagtgccaccaaactaatgtggagccctgccctctgcatgcgaaaagggctccacggcctgagtcaccctcagccccacctgcgtgtgcgcgagggtgcgtggcctggtacgcgtgcgcacggtgttggtgagcgtgtgtgtgcgtgtccgcttgaggggaatgtgaccgtcgtgtatgcgtccgcgacagtgcggggggccgcatatcggacccgtgcgtgtgcgtaggggtcgcgtgtggccatgggcacacgggcgtgcacgcacgggggctgcgtatgctatgctggcgtggggggtgcgggcgaggtggccgcggggaggagcggcgccggcacctatcggcccccacgcggcctgcgtggctttttgacccggaaaggcggggacgcggggacgcggggacgcgcggcggcgggggcgcggcggcggcggcgcagagcgaggaggcccgcggggcgcgcggcggggacaggagggaggcggggggcgcccggggccgtccccgccccgcgccgcggcgccgccgttgctaaggccgggcgggcggccgccgggcgctagggcccttagcaacgggtcgcgggcgcgcgcggggggccggcgggcgcgtggggccggcggcgcttgcgggctcctgccgctcccacgcgcgcgggcggcgggggcggggcggcgggcgcgccggggatttccagcgcgcgagaggaagtgcctgcgcggggctgcgtgagggagcgagggagcgagggagcgcggcgcggccgccgcgtgcgcgagccggggttgcagcccagccgggactttccagccggcggcagccgcggcggccgccggctcttccccgccccccgtcatggggcagcccggggagcagaacgctgcggaccgcggcggaggacgcgcccggcgcccctgagccggccgagcggcgacggaccgcgaggtaaggggccgcggcgggcgggcgggcatccggcgcgcggccgggcgcctccatcccggtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcacctttttcaggaaacggggcgcgcaggcttcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagccgttgacgggaccagttgtatttcacgtttttcgaattaagctcagaatcagttttcagaatgacatgtgatgcgtggtgcgtggtgtgtgtgcctgtgtgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagcttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaggcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacaggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaaaagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattcttaagatctgaaaaattgggggccctacatttcatttcacaatttacttttttactacgatttgttccatgctgatttcgagcattaaaaaaaaaaaaaattaaatggaggctatttggtggtaacttctcatgaggccattctaccaagaaagatatggcgacctgctgcttcgacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagtttcatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggcctttttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgttttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttgttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttttttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccctcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagcttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaacgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcgggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggccgaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctttttctgtcgcccaggctggaggtgcagtggcgtgatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttaccttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccagtcccatcatgggggagtttggaggccaggagattcactggatgcttcttttctagtgtgtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttgtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatgggtgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagacttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggtttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacgcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaaacctcccacctccaaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccatgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcgtggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggttttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcggctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatataatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccatttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttgcttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttgtttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagcctcagcctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctgcagatagtagggttgccctttagcattttaagtgtctaaatgagacctattgggatgtttccatagtttgcatcaaattcatgtaaatgcgcgttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaggcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaatattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagcccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatagagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaaaaaggaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcagggtctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgcccttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggagtattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaccacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagcctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcacaaaaaaaaaaaaaaaaaaaaaaaattacagccatcccagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtctgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctcagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgcgcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatacgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtcataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaatgcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgcgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcaggttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttccgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaatagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttccgaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcccttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaatagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaactgaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcaatgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcagattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccagcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaaatgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattctgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctcccgctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcaca

SEQ ID NO: 13864 - DNA, 9338 bp, Human
ggaggctaaggcaggagaatcgcttgaacccaggaggtagaggttgcagtgagcaggttgcagtgagcagagattgtgccattgccctcgagcctgggggaccaagagtgagactttgtctaaaaaaaaaaaaaaaagaaaagaaaaaaaagaacgtcagagttagggccctggatggctcctctatatctcaaaccccctgggcaatggcagaaactgcggtaggaaaagttcctacaagtgaggagagcggggacagtggctggtggtgacaggaaggaaacaggcaaaggcggcagtcgccagggaagaccttgcgccccttcagcgacccgctcaccgctcttcctgcttccggattcctccccgccagtccaggctgcagctgtaggaaagcctgggccgggggcgcgcccccaggctgcgcaacagctaccacaggaccaggcacacacccggtcaccaccgctggggcccgcgccacgtggctgctagtttccttccacttcccccgctttgtaatgccaggcaagacgctttatgttgatttcacacgctcttaagggggtcccaggccgcagtctgaaaacccctgctcctgagcaagttgcgtttccctaaagaccaggaagcggaggtagttccatcgtttctttacacggcaaggagctttcagattattccgagggcctggctatgagtctaggcaggaggcggcccaatcatgggaggcgccagagacaaagaggaagaggacatggactaggcagggaagccaggtcgaaggaaccccaatgcctccaaggttcccacagctggccttggccaaaatatccgaaaattcccatgtagaaactggcttttccagcctgggcaacatggtgaaaccccgactctacaaataaatacaaaaactagacaggtgtggtgtccgcgcctgtggtcctctgcccacgctcgtcccagctactgggaaagctgaggcgggaggatcacctgagcccgggagggtcgaggctgcagtgagccgagattccgccgcggcaccccagcctgggcgacaaagcgagagcctgtccaaaaaaaaaaaaaaaaagaaaaaaaaaaaaaaaaaccttttagggcaagttaatcaccaaagtgttagatacttaatttggagaccgcaaatcggtcggcaaaacgatgggcttttcaaaatcatgccgggtgtagctgggtaagcatgaatttgttcaccaagtccccgattcccaagctaagggacccttaagtatgaagcacatggctttcggggaacccaaaagtagggagcgctcccgagccagcggtgggtctggagaatccccgagcgcgcaggccgcgggacagcctccccagtgcgcagcagcctgaggctaacagcccccagagggcagagccccgcgatcccggcgccgcttgcggctggattctttggcagcgggcgcggcgccagtcaggacgacggctccggaagtctcccgggcgcgtgagacccgggccgctctccgtccacgcacgaccctccctccaggcgcgcctcccaccccggccccgcgttccgctcagcccgggtgaccaactacacctcacttcaaaggcccccacgcccgggcgtgccctccgcccgcccgcggcaggtgggggtgcagggcggagggcgcgggcggccccagaaggcgcccggaccttcccgagaattccgggccgcgcaggcgcattgaggccggcgcgggggcgtgcgagaggcgcgcggcggcgattgagggaaggttgcccgggccgggccacgagcagggcctgcgcgcgcccgcaggaaggcgcgggggcggggtgccgcggcaacggcgcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaaggtgacgggtggttgtgggggcctgtggaggtggactggggaccgggactgggggcggctggcgcggggcggaggctgtgggggccggaccagatccctgaagcagccagggccgcgctcccgggcggccgcgctttctattccggaggcctcgggaccgctgcggtttccgcaccccgcttcaggaatgggccgggcggccgcgggctccccgaggctctgcagcagcgccagagctggcgccgcacgcgaacagagcggccccgccgcgggggtcccccgcccggccccgctgggggcgcaggcggaggaggccgccgtggcggagccgcagcccgcgcgggagggcacccggggtgttcgttggggaccgcggcgggggactgggcccgggcctgcggcggcctcccggaagcgcgcacacgctcgtggtagttgccgcgctccgaaatgaggtcatcctttgtcagccgcccttctattttcggtttacttaaacttcgcaaatctccaattcggctttaaaaatatttggagaacgcgatggaatttcgtgttgcctctgtagacgtcctgcaaggttttaaaccggcgcggtgtcgttccagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgtaagtcacttattaacccagaatcggattttggtttcagtgtgaacttcttgggggtgctgtatgcttaaattaatattttttgttaacaggcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtaggcacctgaacattcactggttaagtgagcggtggaagggtggggtgctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattattaagtcaatttttctttcttctcttgcaggtgaacctatgggtcgtggaacaaaagttatcctacacctgaaagaagaccaaactgagtacttggaggaacgaagaataaaggagattgtgaagaaacattctcagtttattggatatcccattactctttttgtaagtttttatgtaattgcagagtgaatttctgtctgtaggtgattggggtgactgtactacatccttagtccctagatctgttcaactagtctgaagcctggggaacctaagctctactacctaactctgtaaaagttcctcgggctattaagtggatgtatcaaatattgatgaaaagctgggtgcttctcaagttggctaatttagacttgggccttaggttgaaaatagtggtgcagcgctgtcgcttagttctggagtgcagcagtgatgtgatttcgtgttttcttttgaaggtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaaggtgagtgactgatgggtgcttcaagcttgtccttagattatcatctttctccaccaccccaaatatcttctataatgcattgttcattggtacttagtgtatctgttttattacagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgagtaagtatagataggaaaaataatcactgtcactgattaaagaagtactttctgggtgggcatggtggctcacacctataatcctagcactttgggaggccggggtgggcagatcacttgaggtcaggagttcaagaccagcctgggcaacatggtgaaaccccatctctactaaattacaaaaattagccccatgtagtggcaggctgaggcatgaaaacagcttgaacccccccgggaggcagaggttgcagtgagtggagattgcgccactgccctccagcctgggcaacagagtgagactgtctcaaaaatacgtcccatcatcttcaggttatctttgattttgggagtttacatagtaccagttttgtccttggaatgactcagtgcatttggtttatatttttttcagacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaaggttggtgtaaataaccattagttttccaattggcctctttagttttttttttttttttttaattcagaaagtctttgtaaagaacatactttgtttcagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtaagagaacactatgttacagtcatacacgtcgttcttacaaccttgtaggctctgtgggtgtgttttctactcaggtagcactgttacaactggtattgatctaggcaagataattaacatgaactaggtcattttctgtcttaggttctgcctaggtatctggctagcaagaaaagtcagagctagatgaaaccattcttaactgttaaaaggtctaaaagtaactttgtaatacctcaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtatgtgaatacagcatttcctgatcattgatacttctaaggtgctttcaagcttagtcatacatagcccattttcgcatgttttcaacttaaaacagaaaactatgtcgtgtgtggctgggcgcggtggctcacgcctgcaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgcaccactgcactccagcctgggtgatggagcgagactctatctcaaaaaaaaaattgtgcatgtaaaacatgaaattataacctgtgctctttggatacctaatgcgacatttaagttgtatttgacagtagatagtattttggatctattgaaatttgggttctacagatttcatttcacaatgaaagtttaggaattaatctttctaggttcctagtcatcactttttgattacaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtaagccttatactatgtaatgttaaaaagaaaataaacacacgtgacattgaagaaaatggtaaactttcagttatccaaacttggagcaccttgtcctgcttgctgcttggaggtattaaagtatgttttttttagggataagtaaggtcttacaagagcaaagaaatgaaattgagactcatatgtcctgtaatactgtcttgaaagcagatagaaaccaagagtattaccctaatagctggctttaagaaatctttgtaatatgaggattttattttggaaacaggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttggccttacagtgtctcaaagttctttacaaatctacttaaagccatcctggctgaggcaggagaatcgcttgaacctgggaggcggaggttgcggtgggctgggattgcaccattgcactgcagcctgagcagcaagagcgaaactccatctcaaaaaaaagatgaaaaaatcagcccaataggtaagagtccctctggggactgggggtggtaatggctaaataaaagtcttcacttctgaaatttggtggttctagagacaaaacttggttagatagcatataggatttgcattctgagcctaacgccatatataaaaatgataggaaatgcctgggacttggatatgtgacagtgtctaagggggcagtgcacaggcagggagagaccttgtctcagtctcgtgctaagcaggtattgaatgcttggtaaatggcaatcacgtttagtcctttaaattctctgaaaagttcttaatccccttcgataatatacaggaggaattacgtaaattgaggtcttagtagtggctgaatttaaatttaactccaaagccccattttattctgctaagttttgttgcgtactgaaaggtgttagaagaaaggtttacggtgttaaactaggaagtgaatggcaaaaagggtaaaaagtcaattttgttttttcccaggtctagcaagagaatattaaatcttaagatttctttcaattaaaaacataaggcacttgagggaatcaagtcaatatagaacctctataaatgatctcccaaatgaactcatcctcctggagttactgggaaagcatttatggcaaataggtccagatgcacaggtaagtacccatctcccagcaacccccatgctggagactgtaccaccaagaagatggatccccagcccagtgagtgagaagatgagctagatgacacatgaatgtcatgctgaaaatgcccttgcactgctccaggaccacaattcttaccctattgcttcaaaattcactgttgtttcaaaccttccataatc

SEQ ID NO: 13865 - DNA, 12526 bp, Human
tgctaccatccaccattcatccatccacccattcacccatccaccatccatccatccaccatccacttatccacaatctgccatccaccattcgccattcatccatccattcatccaccacccatcaccattcacatccaccatcggccattcaccatccaccatccaccatccacctattcaccatccaccattcactcattcaccacccatccttccatccacccaccatccaccacccaccatccaccaaccactattcatcttaccatccaccatccaccatctatcatccactatctaccatctgccgcccatccatccacttaatattcaccatctactcatcaccattcacttgtccattatccaccacccaccaaccatcatccacctaccatccatcatccaccatttatccattatctacttatctaccatccattacccatccatttatcatcctatccaccatctactatccacccattatccactatccactgtctattcactatccaccatctattcactatccaccgtccatctccatccacaattcaccatttatgcaaccatcatccaccatctatccatttaccatctatctattcaccatccaccatccatccattcagcattcatcactcaccaaacatccaccatttaacacccacttttttttttttgagatggggtttcactcttgttgcccaggctggagcacagtggcgtgatctccgatcaccacaacctccgccttccaggttcaaacgattctcctgccttagcctcccaagtagctgggattacaggcatgtgccaccatgcctatctaattttgtatttttagtagagatggggtttctccatgttggtcaggctggtctcgaactcccgacctcaggtgatctgcccgccttggcctcccaaagtgctgcggttacaggcgtgagccaccgtgccccgccaacacccactctttatgatctacctgtcggccatgtatccatttatgccattatccatccaccactccctgattaccatccattccttttcctttttttttttttttttttgagacggagtctcgctctgtcgctcaggctggagtgcagcgcacgatcgtggctcactgcaagctccacctcctgggttcacgccgttctgcctcagccccccaagtagctgggactacaggcgccttctaccatgcccggttaatttttttgtatatttttagtatagacggggtttcaccgcgttagccaggatggtcttgatctcctgacctcgcgatccgcctgcctcaccctcccaaagtgctgggattacaggcatgagccaccacgcccggccattcattcatttttcactcaccatcctcatccatccattcatcacccatccaccctctatcactcaccatccaccccgtcaaccatttaccattcatctgccatgcgtccatatgccgtacaccatgcaccatcaatgttgctgtccatcagctgtcccctactcaccatccactactctccaccatcatccacaatccaccctcctataccatccacataccatgttccatccaggatcttccttctatcatccaaccaccacccacagcccatgggacaggggcactgcgtggagaagtggacacccagttccaatggtgagcagactagctcagccctagcagcacacaggacagagaaaggggtgaattcaaaggtcgtttattccccctcccggcaagacacccatttttcagggtaggtcagtctcgccaagcccttcttctttgcccttcttcctgagaacctaaggtgttcaggccctgcaggggcgggtaaggggaggctgagaaggtgcctcccaggggcctgaagagtcggccctgggcgggtctggaggtaaatgtgtaaccgaccctggtgcccccacccgacctgcctggtcacgtgggtccagtggggcaaagtctcctggtggggtgcaaggagccgaggcgagatgggcgtcctgggccgggtcctgctgtggctgcagctctgcggtgagccgggaccacaccggtgcgggcccggacggtagcggtctgtcaggacccagggccgaggtcgctctaggcctggagggtgaagatcttccgaggagtgggcagggagggctttggagggttgggggcgtgaaactcggccctgcctccctcgtctggcgagtgcgcagcccggaagtgcgcggccagtgcatcgggcggtgcgggagaggagaggaggggctccgggaacctcggccagccccggcctccggcggctcctgccctcgcggtttttccgtctgcgaaatgggcgcggtccccagaacctgccgagagcagcgagtgtgcgcctgcggggctcggcagaccgcctcagcttcccggtccccaagggagcactgagccctcctccgccttcacaccaggccggcgcgtgtccctggcgcccccttccctaaacccctcgcggctccctcaggacaaccccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccagggtctgggtccgggcccccggggatggggttcctatgcgtcccgggtgatccgcgcggaccttccgcacttctctgggtgggtggccttccctgagaagggagcatcccggagagcatcccgggcactcagtcgcctcctccccagcactgacccaggcggtctccaaactctgggtccccaacacggacttcgacgtcgcagccaactggagccagaaccggaccccgtgcgccggcggcgccgttgagttcccggcggacaaggtgcctgggagcgccggcggggtcggtgatgggcctggacccctgagaccgtgtggccccggtgggggttgctcccggctcggctgaggcagcttcttcctgcagatggtgtcagtcctggtgcaagaaggtcacgccgtctcagacatggtaaggccgggctgctactgccactgggctgggggttcacagagtctctgaagcgccttcagggactgctgtgccttgagggcggaccccaccggcatggaggcactgcaggactgggactttggcctctggagaatattctaggaggcagggagtgggggggaacctaggggagcttggtcccatggtcccagccaggctgtgtcctgggagggatgggaggcacccctgtccccacagcccttgtgatgcccagcagtgggtggtcttcccaggaagcgcctgctccatgcccttcccccaaagccttgccttgtcctggtgcctaaagctccatctttagaacactagggaaagtgtccccaacacccccccctctacccaccatccgggtccctggcctgttaggaagtggccgcccaggaagaggcgagcccactcctgcctggctctgcctcccttcagatcagatcagattctcctagggacccctattgtcactgcgccagcgaggggcctgggtgggtgtgcactccttaagtggctgacatctgagatgggacagcttaatcctgaaaccttccccactcccatcagtccatggaagaactgtcttccacaaaactggtccctggtgccaaaaaggttggggactgctgccctaggggacctttttctcaaactgcttcacacaacactccaagaacatgatgggaactgggaggaaagcgggttccatgagtaggtaagtttgggaaatgctgcagcctgcactttcctggagcttcatcacgtattaaaggctctgataaggccccagagaaagaagctaatttccttgtttaaggtggagttccgcaagctacaggccaaatgcagcccctacgggtggagcaaggaacggtttttacactttgtaatcgttggggaaaaaaagaacaatcttttgtggcacttgaaaaatatatgacattcacacctcagcgacagtaaatacagcttcactggcacacagcctgcccgcttggttgagtatcctcggtggccactgtcccattgcatcggcagcccaccagcttccagggtgactgtggggcctgcaggccaagcctctgggcaaaagcttccttccagccccttcacagccactcctgggctgcgtcctcatcctgtcacctgcacacctgccagctcagtcactcctgagtgagggtcactggtgagctgggtcggggtgtcggctccagatgtggggtccaggcctggggcccccgcgtgtgcgggtggggaggatggctcaatgggcttggcctggcccattcctgccccatgcggggtcagggaccctgggcctcatttccaccccagggccgcttggttcattccttcaggttttccaaagctgccttaacccaaaagctgccacgcactggggagggcacccacagcaagatggcgacgctcccacccgggaaacaggaggagggcagggagagggaggcggttgccccttgtggcccggcccccagaacccacgcataaccttggcaaccaggcagcccgagtgaggggggcactgggagctgatgggggacctgtgggcagaggagtcaggctgggctgggggttccagggcatggatttccccctactcccctcccctgccggcctccttactttcatgatctcctttggaagcacttgggctctgaaaggaggcaatactccattcattcatctattcaataattcattcattgatcatccattggccggtgggaacagcgcaggggcaggggacagtggccccagggtcccagcctgcagaggccgaattcacccagagccgcccaagcacccccatcccctgcccgcgtcggctatgttgccctccacacccctggctcccagcttcatccatctgcctagatgaggcccgagtaacaggccgtgcacatcagtgccttactttgtaattctgtggttgggagcgtccctccctgcgattttccttttccttgcccttcctcccatttctaccttttgcctgctttcttgttgggggagtctcctgtctttcacccatccccctgccttggctggaggctttgcaagtctgctcactgtggacttgcctgcagtgtcctgtgctgaacagaaaccttcattttaatcgacctaatgcaaaacgccttaccttagaactgtgttttttctgtttcgtttgagaatcgcgtctgctcctcagtcacaatggtaatggactgtgtacctatggggcacgtgcaccagcgagggctcctgctgtgtttctctccttagagtgaacccagcttccagcatcctccgccttgcccttttgttctagcactgctggaatccgtcgtgtgcctgggtgttgtgggtctctctgagccttgtcttcaagtccacaggccgctttgccgaccctacactatccacacagtggctctgcaggatggcttaatatccatccccttcactcctgctccaaggttctttgtggatctcattgttgcagataaattgtagaataggtttgccaggtaacaactaccaccaccaccaccaaaaaaaccctggattttttttttttttttttttgagatggagtcttgctctgccacccaggctggagtgcagtggtgtgatctcggctcagtgcaacctctgcctcccgggctcaagcgattctcctgcctgagcctcccaagtagctgagactacaggaattttgattgggataaataacagccttatgctgtcaagccatccattcaagagcatggacggactctctctaaatatttcaggtcatccatggcctctttagcatcttaaagttttccctgtagaggtcttatattgtattggttaattcatcaatactttgttaagtttgtttttttgagacagggtctcactctgttgcccaggctggagtgcaatggcgtgatcacggctcactgcagccttgacctccctgggcgcaaacaatcctcccacctcagcctcccgagtagctgggactacaggcttgtgccaccacgcccggctaatttttgtagtttttgtagagatgggggtctcactatgttggccaggctggtcttgaactcctgggctcgagtgatatgcccgcttcggccttccaaagtgttgggattacaggcatgagccaccgctcctggccttaagtttggtttctattataaatgttgccctatatttaaaaattatatcctctttttattttgaaattttttgtagagatggagtctcactatgtttctcaccaggctgatctcaaactcctggccttacctactgtgctcgtctgttcaactattatgttacgtttctatttttccccttcgttctttaaaaaacggtgttcttggtatgcttcctcctgggaacccctccctgttcctgaggcgctttgagctatgacacattccgtccccacggctccacctctgcacctgtggggggacttgccctgctggcagtgccacaccctcaggtgtgcacggaactgaagtgtgacctcacgtcgctgggggtgttggcctcttgctcaggtgcagtgctcctggaagggccgaagagtgggtcctgcctcgggtgggcgcgccctgctgtgctgagcccctcacaacctggcagcaagggttgccctggcccagcgctcaccctcagcccctgagggagaagtgcagaagcaagaaggcaggaggctgaggtcctggcacttggaggagagggggagtgaggggcggccagtcagaccccccgtatttctgctgacacccgagacttgggctgtggccccacttctgtggtgcgggagctgcacggcccagcccaagcctataggaaacagcaggggcaactccacctccccgctacactccctgcctcctcctgcacccctggccgccagatgcagcctctccctccctccctcacacaccaagagcgcggcctcagactccccaggagccgggcaactttcgaaactttagttcctggaacctgggagccctgggcctgtgcacgttctcaaggggctacggggggaggcgacaggccctggccagagtcacctccgccccagactccccacggctccgtctcgctccccggctccggctctgcccctggcctgtgagacctccagctcagggacaggacactgggctgtgcccgcttcggggccttgcccacgcggccccatctttcccaggccagatccgcttcctctgccagcctcagccaggccgaggaccccgggcctgagctcgcccgggctccttccgtgcacagggtctcggcttctcgtcccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggtgagcgaggccgcagtggagtcgcgggggccgcgcgagggtcgggactgtgcccgggacagggccgctgcgctcccacggtctctcgccggcttgcttctcggaggcatcgcccttctcgctgcggtccgctctggccctccgcgctgaccaccgcccctcgcaccaggcgcagccgtggatctgcgcggccctgctccagcccctgggcggccgctgcccccaggccgcctgccacagcgccctccggccccaggggcagtgctgtgacctctgtggtaagcgcccccgccgggccctgcttgctgggaaggcctggaggaccaggttcgtcccccgcctcagtttcctgccgggcccggatccacggcgctgacccctgccctcccgccgcaggagccgttgtgttgctgacccacggccccgcatttgacctggagcggtaccgggcgcggatactggacaccttcctgggtctggtaatggggccgcgcgggcagctgaggggagtcccgaccccagccctaccgcctccgcctaggacgccccttctgcagggtccctgcggctgctcacttgcccactatctgcctctgcccttagcgtccccataggctcggggagggcggggggctgagtcaaaccaaccccgtccccctccccagcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggtaaccgcgcccgccccatcccgccccgccgcgcctcgccccgccgcggggaagactgagccggcccctccgtcgcaggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtacgcggggcgggggcgcggaggtggggctgggggttgctccgaggggctcacgctgcgtccccgctacgccctcaggtggaggaggcacgaggcggcggccccggctggagcgcccctcggcttccgcaacccggtgttcgacgtgacggcctccgaggagctggtgagggggctggaggggggaccggggcctcctcggggccgggactcggcgccgaccgccgcctgaccctgtcaccccgcagcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatggggtcacccatgtgcaagcgtgcgccactgcaccgacacagacaagggtccagccctgtgtgtgcagctgcaactgtggcagtgaccacttctgtgaaaccagcatctggggctggagatgtcaccggcatccccagtcatggcctggcccccatttggaatcttctgcccaggggcccagcttagccaccaggacacgtgctgtaacccagatcagggccccgtgcttcgaggtgcggctgtgttgtggttggaatgagtcactctcagtgctgtgcagtgtcccgttgagtgaccgccacagttcacgtgtgtgctccaacagctaccatctcgcatttttaaaagaagtggccgatactcccacacgcactttttagccacaattttctttagtgtcaggtgcaaactggagagcaagcctgagctgaccagacaccacctgccacccactgctcacccgtcacagatggactgtgctggcagggacctgcctctggtgtggactgtggaaggagagatgctctgggcttccaggggagccgcctgctgcagcagcagcccaggccatgctgcctggcacagagctcaaggtcccaagtgcccccgctgggtgctgggctgcctgccctggcttgcagtcttctcccaggtccgcactcttctgcaggggccatcactgcccttgtcctaccaaggacaactaggtctcagtgagtggcaaatagaagccaactccctgcataactcaggaaactgactccgagcattccctcaaccagggaccactcaccctggcccagacctccccgagaactcctgcctcttcctggggcctctggcctaccccatcctgtcccttggggctgctggcagggttggcgtgtatgggtgtggacaggcagaccctcgcgggcagcctgctcctggggccctggcactgcctggctggggctcacaggcacgctgccctcctcccttcactcctgccccaaggatgccctctgttcaggctgaacaccccaacagcagccttttgggtgacctccgagtgagttacccagaatagcttctgctggcgaatagcatcttctgcaaggtggctccttcactgccttttggagctcaggcacttctggggcccagacacacgggtgacatgttaccacatccaaacggaccactgggaactttaaaactgccgtcttctgctttattgacaggtaaattgttcaaaaatgttctcacaattcaataattaattacaaagactgagacttacattaaaaaagtaaaaaccagaaccccccaggtgcccatccagcagaaggcccaggagggcagtggggtggcagggctaggcggtgctgggccactcagtgccgacttggggaagtgcacgtcctgaacagccttgccaagcagccgaccggtgggaggacaggggaagcctggcccaagctgtggacaagctgtgtctgccgccacagttaatcacaagcctctgacgacacagggccacagagctggtcactcaacatctggtacaaagggtgaggtgaaatccacgcgcaggggattgctgtgccgtgggccggggccagtgtgcaggagtgtgttgggtgggtctacgtgatcatacgggctactaatcacgggggctccatgcgggggcaggactggtgggggggggggcgggcagggcggggcggggtggggtatcccagtggctgcttcgtggcgccctggggctctgacttccctcagcccagcaggccacagggcctgcctgcaccacgacactcgctggttttatggcaggaggcagaagccgtggaagcgaatggaaaacagcacagctgacttcacagtagtagatactggtgacacttcatggctgcgacccagaatgaacttaatgcacacagggacgcagggtgtcactggtcctgggcctttgtccatgactaggtggtcagcaggacttctgcagctgactgt

SEQ ID NO: 13866 - DNA, 12847 bp, Human
  misc_feature (1)...(12847): n = A,T,C or G
gcaggagaatcgcttgaaccgggaggcagaggttgcagtgagcagagattgtgccattgcactccagcctgggcaacaagagcgaaactccgtctcaaaacaaaaaaaacgaaaacaaaaattggcgtggtggcgggggcctgtagtcccagctagtctggaggctgaggcaggagaatcgcttgaacctgggaggcggagattactttaagctgaggtcgcgccgctacactccaacctgtgacagagcaagacttcgtctcaaaaaaaaaaaaaattgataatgtaaactcggggtttttagtatgctgtttcttcagccagtgggtatagattaatatttactcaaatttaaaatgtcaggctcggtgcaatggctcacacctgtaatcccagcactttgggaggctgaggcaagcagatcacctgaggtccgaagttcaagaccaccctagccaacatggtgaaaccccgtctctactaaaaattcaaaaattagccaggcgtggtggttcgcgcctgtagtctcagttatttgggaggctgaggcaggagaattgcttgaaccgggaggtggagattgcagtaagctgagatcgtgccactgctctctggcctggcagcagagcgagacaccgtctcaaaaaaaattttttaaatgtcatttaatttatctccccaggctggacatggtggctcacatctgtaatcccagctactcgggaggctgaggcaggagaatcacttgaacccgggaggcagaggttgcagagaggggagattgcgccactgcactccagcctaggtgacagaatgagactccgtctcaaaaaaaaaaaattatctccccttctcttctaaataacctaaggttgaggttatttggggggtttttttgttgttgtttgtttgtttgttttttgagacagtctcactctgtcgcccaggctggagtgcagtggcacgatcttggctcactgcaacctccgcctcccaggttcaagcaattctctgcctcagcctcatgagtagctgggattacaggtgcctgccaccacgcctggctaatttttgtatttttatttatttatttttatttgtttatttattttttagacgaagtctcgcccttgtcgcccaggctggagtgcagtggcacgatcttggctcactgcaacctccgcctcttgggttcaagcgattctcctgcctcagcctcccaagtagctgggattacaggcacctgccaccacgcccggctaattttttctttatttttagtatagacggcgtttcaccatcttggccaggctggtcttgaactcctgaccttgtgatccacctgcctcagactcccaaagtgctgggattacaagtgtgagccaccgcgcccagccagttatgtttttttaagtaagccaaacttttggtttctttttcttttttgaaattagagatggaggctctcgctctgttgcccaggcatattgcagtggctattcataggcacactgcagcctcaaactcctggactcaagtcgtccttcctcctcagcctcctgagttgctggaacttacaggcatacacaccactgtacctggttttctgttttattacaaaagttgtgtatttgttgttgaatgtttaggaaagataaaagttaaatcttcatcaggatatacaagttgctgatatttaaagtcaaagtgaagtagaattatttttgttttgataaaccttttgagagggagagattgtaatccggaaatgctacaaaaaacaaacttggaaatcactgaatttgcaccagaaaagcacctcagacactaaacttaagcctttattctgtcctctagagcaaacatcacttcttgccaagttttcagtgtcttattcttcttagagtcttctttttgcttctcatttctagatgtaggaggtagtgtttttaaagaagtgctaagtgaagatttctaaaaggtttctgctcgttttatttagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtaaacttcgattgcatcaaacagtttttctttaccagtgaatgagtatctagcatttatttattggtataaatagagatggggtatcactatgttccctaggttctggcgtcaaactcctgggcccatactgtcctcctgcctcgaccccaatgtgctgagccaccatgcccagccacaatcttgttacctttcttttttttttttttttttggagaccaagtctcactttgctgcccaggctggagtgcagtggcacgatcttggctcactgcaacctccacctcccgggtttaagtgatttctcctgtctcggcctcctgtatctgggattacaggtgcccgccatcatgcctggctaattttgtatttttagtagagacagggtttcacccgttggccaggctgttcttgaactcctgacctcaagtgatccacctgccttggcctcccaaagtgctgggattacaggtgtgagccaccgcgcccggccacattcttgttattttaatggcactgtcctttctgttacacagatgatacttccaatatttgttatatttatacatatatgttgtaccctatgttattgcctttgatattgtaaaatcctactgttgcatgaaggcttaagggaagtaggtgacaatagcttttctttatatattaaactaatgggaggtttttccatttcatttaaaatttgtaaacattaaatttagtttatctttgaattcattctaagacattctgttaaaatcctgttgtggtggctcatgcctgtaatcccagcattttgggaggctgaggtgggagggttgcttgaggccaggagttcaaggccaccttggcgaacatatccagactcagtttctcttttttctttttttttttgagacggagtcttgctctgtcacccaggctggagtgcagtggcatgatctcggctcactgcaagctccgcttcccgggttcatgccattctcctgcctcagcctcccaagtagctgggactacaggtgcctgccaccacgcctggctaattttttgtatttttagtagagatggggtttcaccgtgttaggcaggatggtctcgatctcctgacctcatgatctgcccgcctccgcctcccaaagtgctgggattacaggcgtgagccactgtgcctggcctctctttttttcttttctttttggagacagggtctggctctgtcagtcaggctctagagtgcagtggtgcaatctaggctcgctgcaacctccacctcctgggttcaagctattcttgtgcctcagcctcccaagtagctgggactacaggtgcatgctaatctttgctacaggtgcacctggctaatctttgtattttttgtagagacagggttttgctgtgttgcccaggctggtcctgaactcctgtgctcaagcgatccaccctcctcagcatcccaaagcactgggaatacaggtgtgagccaccgcgcctggccccatctctcttttttaaaaaactcaaaaacatttctgttgtataagtgagttttgctctgttgttaacacagtatggattcaatattaacctccttgtttttactgttaagactaacttggtttaagttttaagccactgcatccagttgaaaccattcaaattgttttctaaggaactatgatttgggaatggagtgtgtgagtatgtgcacttttagagtaaacttgtatcatcctttctaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaaggtacttgcgtctgtgctttgggaatttttgccaacaaacttccttagaggattgtaagataaaatgttaaacacacttagaaaagatagcggcagggtgtgttcatgaaatccttttgtcttgttgaagtctttggcccttagtgcgtgctgaatattttatgcttgtttgaaatatttagtttattacttctccaaactaaacctttgttcattttgttcttccttttcgctatggatggaaaagagaaaaggttatttgtcaagttaatagtttcttacatagttatatgttaaaacataaagagaatcagaatacatacattaattgttataaagacctaactttttccaagcaaacaaataacattggcttatttggaacatcatcatctttgccaagagattgcttatttattaattttctcaaatccaaacacagtcatgtatcacatggcaaagttgatcagtcagcagcagaccacgtgtacagcagtggtcccataggattataacactgtttttactgtaccctttctatgtttagatacacaaatacttaccatcatgttatagtcgcctacagtgttgagtacagtaacttgaaagtttgtggcctgggagcaataggctataccatctagcctagatgtggggtaggctatgctatctgggtttatatgatgtttgcacaacgactttttttttttgagagagagagtctcactctgtcatccgggctggagtgcagtggtgcaatctcagctcactgcaagctctgcctcccgggttcacgtcgttctcctgcctcagcctgccgagtagctgggactacaggtgcccgccaacacgcctggctaattttttgtatttttagtagagatggggtttcaccgtgttagccaggatggtcttgatctcctgacttcatgatccgcccatctcgggctcccaaagtgctgggattacaggtgtgagccaccgcacctggccctttttttttttttttgagatggagtttcactcttattgctcaggctggagtgcaatggtgcaatcttggctcactgcaacctcctcttccgggttcaagtgattctcctacctcagcctcccaagatgctgggattacaggtgcctgccaccacacccggctgatttttgtattagtagaggtggggtttcaccatgttgaccaggctggtttgaactcctgacctcaagtgatccacccgcctcggcctctcaaagtgctgggattacaggtgtcagccaccacacctggccacgatgatgaaattgtgtaatggctcatgatgtatttatatccatcattatgtgatgcatgactgtgtacttttgtaacttaaaacgttactcttcactgaagccttacaagaaaaagaaatgctgatggaaaaaattaagggtacgtctactttttaatggttcactgctatccaaggcgaatgattttgttatatcccttaccttaatgtttttttcattgttcataacatatttctgagtttttttcttccttttgatttgatcagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcaggtatttttctccttaacgatatgtcccggccgggcgtggtggctcatgcttacaatcccagcactttgggaggccgaggcgggtggatcacgaggtcaggagatcaagaccatcctggccaacatggtgaaaccccgtctctattaaaatacaaaaaaaaaaaaaaatagctcggtgtggtggtgcacgcctgtggtcccagctactctggagcctgaggcaggggaatcgcttgaacccaggaggcggaggtggcagtgaactgagatcacaccactgcattccagcccagtgacagagtgagactctgtctcaaaaaaaaaaatatgtcccaggtaattaggtaatttctcttgaacattgcccatgcagctaattgctattcttagctaagttttctgaccttgtaagacgtagggtgtatgggcctagatgtttgtgatacctgtatctgatatcacaaatacaacattttaagaaatctaaaagtaaatatgcctttagataattttcagtatgtggcatttgggaatgttatatacttttttttttttattgagacagagttttgctcttgttgcccgggctggagtgtgatggcgcgatcttggctcgctgcatcctccacctcatgggttcaagcgattgtcttggctcagcctcctgagtagctgggattacaggtgcctgccaccacgcctggctgatttttttgtgcttttagtagagacagggtttcaccatgttggccaggctggtctcgaactcctgacctcaggtgatctgcccatctcagcctcccaaagtgctgggattacaggcatgagccaccacgcctggccagttttttgtatctttagtagataacggggtttcactgttttgatctggctggtcttgaactcctgacctcaggtgatccacccccctcagcctcccaaagtgctgggattacaggcgtgagccactgctcctgctcccggcccattttttaaattattattttgagacagggtctcactctgttgcccaggctggtggaacacagtggtgtaatcatagctcactacaccctagaactcctgggctcagcctccagggggaggatcctccagcttcagcctcccaagtagctaggacagatgcatgccactacgcccagctaatgtggcttttttgtggttttttttgatagaggtggggtctccctgtgttgtctaggctgccaggctagtcttgaactattggcctcacacagtcctcccaccttggcctcccaaagcgctaggattacaggcatgagccaccatgcccagcctatgtcttttgaaaatcgactgaaatatcactgctgctgttaataaaactaaaagctgtattgggggtttaaatgaaatgagtgttcattgcttatttttcctctggctttagataaattaatgcttgtaatctaagttttgttgctactttaaatatatgaatcagtggtttaatcttctttgtttacatcccttatttcttatagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttatacgttttgttacgtaaaggattgaaatattgtggttgaaagtgaactgctgtttgcctgattggtaaaccaacacactacagttgatatcaaaaggcttctgtaatattttatccctggacttgtcaagtgaattctttgcatgttcaaaatggaaaccattgattagaactacattctttactccttgttttaatttgaaccccaccatatggatttttttccttaagaaaatcctcctttgggagatcatggtgtcacagcattnnnnnnnnnnnnnnnnnnnnctggcgcttgggtccgtcgctgcctcggtgtccctgtcgggcttcccagcagcggcctagtggaaaagtaaaagatgtctgaatatattcgggtaaccgaagatgagaacgatgagcccattgaaataccatcggaagacgatgggacggtgctgctgtccacggttacagcccagtttccaggggcgtgtgggcttcgctgcaggaatccggtgtctcaatgtatgagaggtgtccggctggtagaaggaattctgcatgcccccgatgctggctggagaaatccggtgtatgttgtcaactatccgaaagataacaaaagaaaaatgggtgagacagaagcttcatcagcagtgaaagtgaaaagaccagtccgatttaatagtgttgggtctcccatggaaaacaactgaacaggacctgaaagagtactgtagtacctttggagacgttcttatggtgcggcaaagccaagatgagcctttgagaagcagaaaagtgtttgtggggcgccgtacggaggacatgactgaggatgagctgtgggagttcttctctcagtatggggatgtgatggatgtcttcgtccccaagccgttcagggcctttgcctttgttccatttgcagatgatcagattgcgcggtctctttgtggagaggactcgatgaaaggaatcagcgttcacatatccaatgccgaaccccaagcgcaatagcaatagacagcaagaagtggaagatttggtggtaatcccaggtggctttgggaatcagggtggatttggtaagagtagagggggtggagctggtttgggaaacaatcaaggtagtaatatgggtggtgggataaactttggtgcgttcagcattaatccagccatgatggctgcccccccaggcagtgctgcagagcagttggtgtacgatgggtgtgttagccagccagcgaagcagccaggcccatcggatgataaccaaagccaaggcaacatgcagagggagccaaaccaggccttcggttctggaaataactcttgtagtggttctaattttggtgcagcaattggttggggatcagcatccaatgcagggtcgggcagtggttttaatggcggctttggctcaagcatggattctaagtcttctggctgggaacgtagacagtggggttgtggttggttggtatagaatggttggaattcaaatttttctaaactcatggtaagtatattgtaaaatacatatgtactaagaattttcaaaattggtttcttcagtgtggagtatattcagtagtatttttgacatttttctttagaaaaaggaacagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttgattgaaagtagtgctgtaaatattctgccataggaaacttctgtctacatgccttctcattcaagaattcgtcatcacgcatcacaggccgcgtctttgacggtgggtgtcccatttttatctgctactctttatttcatagagtcgtatcaacgctgtgaacgcaaggctgtgatatggaactagaaggctgtttgaacttttgaaaccttgtgtgggattgacggtggtgctgaggcatgaaaggctagtatgagtgagaaaaggagagagcacgtgcagagacttggtggtgcataacggatattttttaacttggcgagatgtgtttctcaatcctgcggctttggtgacagtgtgcagacagcaatgatagcaaataatgtacgaatgttttttgcattcaaaggacatccacatctgttggaagactttgagtttttgttcttagataacccactttatttgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacatgttttaaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaagatttgtttttaaaaatctatttggtcaatctaaatgcattcattctaaaaaattttttgaaccagataaataaaatttttttttgacaccacagtttagtgtctggagtcttactggaaaaacacgatttctttttatatgtgatatacagatgctggaaagttacctttaaaaattgagtctctaaagaaaaaagaaaataataaaaattgagtctcaagaagttgtacttcatatgcacaagagaaatgaggccaagactcacagtaagcttttacatggaatggtaacttttagttagactgaaaaacttgaatgttagctattaaaaccttttaggaaggaatagccagctaaaaccaaatgagatttttaaagttaaatcagcacttaagttgtgtccttagtaggaaaaagtaggaagttaactactccgtaatccaagagataatgtgtaacagtaagaatgattttgttgttgttgagtatgagcaaagtagcccctaagtgtgtattagggttctgtacttaactgttgtgtgatgtgtgcttttgttaggcatcactgtgcccaagtatttcatgttcattgtaaagaggaaaaatacagatttctctataatgtcaccacttatttctaat

SEQ ID NO: 13867 - DNA, 9408 bp, Human
gccactgtctatggtcagtccttcaccacctaaaagcaagctgatccacaaggcacctggctgcatccaggcctgtcatctacggccaccatcctcagcttcagagcttatgatctggctcagggaacacagacaagtactgccatctacagccaccatcctcagcttcagagcttatgatctggcttagggaacacagacaagtacacgggcagttacaacccagaggcagaaatgtcttggaggaagtacaggcaatgtaggcaaacaccttgacccaagtacaggattgaacccaatcaagcctgtagcactggacacactgattgactctgtcttatccactacgtggacatttcaagaataatcttcgttcctggaacaagtccatggaagctgttgcctagcaatgttttttattttttagagacagtcttgctatgttgcccaggctggtctcgaactcctgggctcaagcggtcctcctgcctcggcctcccaaaattctagtattatcagcctgagcccctgtgcccagctgcctagcaattttttttttttttttttgagacggagtttcactatcgttgcccaggctagagtgcagtggcgcaatctcagctcactgcaacctccaactcccgggttcaagcgattctcctgcctcagcctcccgagtagctgggactgcaggcgcgcactaccatgcccagctaatttttgtatttttagtacagacggggtttcaccatgttggccaggatcgtcttgatctcttgacctcgtgatccgcccgcctccgcctccgcctcccacagtgctgggattaccggggtgaaccatcacgcccaggcacctagcaattctttagcggtcttggtttacctcccctttagaaggagcttaaaagcaagcaaggcacattgttgcctaggcttgaggcttgctctcacccataaacaacgctgttactctgctctggggacgacacaggaaacgttccccacctccaggtggaggctgcaaaacgtgtcaaaaccatccctgacataatgtcaagagtagcttatactagtttcatcttccttccttggcattcgaactgcgtgtggaacaattagcatttaatatttggtaattagcatgcttaatgtgattctgagaagttctttgacattctcataaaaacagcacattcccacccacccttcaaagagcaagacccagtttgtcaagaaaaattgcgtgccagtcttttctggtgctgaatatgtatgttctgggcctcttcctggacactgctggtaaatttagaaactcgtttagaaaagcacttctctcgtattcaacagcctataggctcatggcgcagaatctaagggaaaatggctaaatccagcttgtgaattcgcgggctgtgatgattctttccaagtaaataaaaaccctcggttcgccccgacgagccacataatctgttcaaatccaacaaggaaccagattttggacgcaaagaaggatacgttctactcgccccgtgcaacaacgtaaaccactgtagccgcccgctcccgtgtctccagcccaaaggctgactctccagtccgcacgtcgcagcgctcttgccctccacaccaagcccgagtcccgcagcccctcgaggccctcggtgcctcccaaccccgagaaggaagcgggggccggtggtgcaccgccccggctgcttggggcggaggaaggacccggaccccttccgccggcccagcccgccccggaacccgacccggccgcccggccccggccgggccccacgtggcccctggagcgggccgcactaccctgctgccgccgacggacggcgcgccacagccactctgcgccgctctgcgagccggtggccaatgagcgccaggcgaggccgctttgccattggcgagcgcgggctccgcccccgccggcaggccccgccccgcgcccgggttaggttgcggcgcgggcggcgggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcactgcaggtgaagcagctgctccaccaccggcgctcgcgctaccaggacatcctcgtcttccgcaggtaccgccgctgcccgcaggcgcctgccccctaggctcagcccgggccgcctgctgcccgcctcacgggcctctccacgccgggacccaagcgggctggacctcgtcctgccctggccccctcgccacccctcacaccgcctccctgggctggggctgggactgcgggctggcctcttgggtgggggagtcggagtctgcgccccgctccacgtgtcagccctcaggacacgtcagagcccgaggagaccccgggtcccaccccggcctccacccggcggcccgcctgccgttcctcgccacgtgtcaccatcgctcctcatccctgggacccctaggcgggatggggagaccctcctcacccagggcggcttggggtacgttttccccaccccagagaacccaggtccccgactgtcactccgcccgcagtaagacctatggcaacgtgctggtgttggacggtgtcatccagtgcacggagagagacgagttctcctaccaggagatgatcgccaacctgcctctctgcagccaccccaacccgcgaaaggtaccccagtgtcccctggaacagtgccggacgaggggcggccccaggtgtgctccgggctcttcccagatgctgcctgcatggttgtcagagaaagtgctagcgaggccaggggcgtcccgcggaggggtgggggccgacactgacgcggcctcggaatcctagggcagccctggaaggaacttccaggaaaggggacaccggcacgaaagcgtttccgagggtagaaaaagatgaggcccgtgggtccgaggggtcagggggtctgcttcaggggcctgggggctcccagtcctgccagggcccctgccttgactgccccctcctcccaggtgctgatcatcgggggcggagatggaggtgtcctgcgggaggtggtgaagcacccctccgtggagtccgtggtccagtgtgagatcgacgaggtgagtgccggcgtagagccaggtttgagtcctggttctcccagcggccagctgtgccctgaaatggctgcacacccccgagcaaggcaggtagggcctgtttctccatctggaaaacacctggtcggggagggttcagtaggaaaaccagatggcagagggcctggcaggtggtgagggcacctgcgtggcgagctcttactaaaactgagctgattttttttttttttttttttttgagacagagtttcgctcttgttgcccaggctggagtgtgatggtgcgatctcggctcactgcaacctccacctcctgggctcaagtagttcttctgcctcagcctccggagtagctgggattacagacatgcgctaccatgcccggctaattttgtatttttagtagagacagggtttctccatgttggtcaggctggtctcggacctggcgaccacaggtgatccgccagcctcgtcctcccaaagtactgggattacaggcgtgagccaccacgcccagccgactaagctgatttttaatctgagccccaggcagggccccaagacagctcaactatttgtacgttaccccttacactcagtagctgctcactaaaatcatgctacgtgccaggtgttgcccgggtatggggacagtggtagacgacagatcagtccctgccctctaggagctgatgtcgtagttaaaggagacatcagatggccagacgtggtggctcacacctgtaatcccagcactttgggacgccaaggcgggcagatcacctgaggtcaggagttcaagagcagcctggccaacctggtgaaaccccatttctactaaaaatacaaaaattagccgggcatggtagtgcatgtctgtaaacccagctactagggaggctgaggtggaagaattacttgagcccgggaggcggaagttgcaatgaaccgagatctcgccactgcactccagcctgggtgacagaggaagaatctgtctcaaaaaaaacaaacaacaaaaatagagacatcaaaggatggtctgatgaaggcaagacaggggctgggggacaggagaaggcagggttcctgtgaatgcatggggggtggtcagggcaggcctccaggaggtggcgtttgagctgagacctcagtgaaaagcaggtggccgtgtgcagggagggggaggttctcctggccagaggttggaattgcatccttctaaaataggaaacaggccaagcgctggtggctcacacctgtaatctcagcactctgggaggctgaggcgggcagatcacaaggtctctactaaaaaaaaaaaaaaaaaaaaaaaaatggcccagcttggtggcgtgcgcctgtaatcccaactactcgggaggctgaggcaggagggtgcagtgagctgagatcgtgccactgcactccagcctgggcagcagagcaagactgtctcgaaaaataaataaaataggaagcgacaagaaagccactcagatggggcgatttggtctggaaggagggggtagggatgggagagaggagcccaagccgccggcaggagccagctctcaaggagaaatggaggtaccagagttctccccgctttacacattataaactgaggttcccaaaaggggccaggtgtggtggctcacagctgtaatcctagcacttttggaggccgaggtgggaggatcgaggagttcgaggcaacatagggagactctatctctaccaaaaatttaaaaagtagccaagtatgattgaacacacttgtcccagctactcaggaggctgatgggggaggatcacctgagccccggaggccgagggtgtagtgagccatgatcgatgccactgcactccagcctgggccacaaagtgagaccctgtctcaaaaaaaaataataaaaaaaagggaaggggttggccaaggcggcttgcctgtgaggcacttggagagtcccacgtggctgtgctggctccaggtcccccagccccttggcccagactggtccctcccatcccctccaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggtaagcagtggatgggccccagggttttctggcagctgcaggtctggaggtcagcctcccccaggccttcagagtaaaggatagagcggcctcccaccccccgaactagagctgtacttttcccttctcatttgttacctgccctctgaaacatggctcaggacagtaggcaggagccaggcgactgcccagattcacaagctggtgaccaaggagagtggggatctggcattgggacactgaggaccctgtgtcctcttcagcctcccctctgctctgaagtggtcagcactggagtgggggcaggttctagtcttgaacgaaggcctaggttagaggttcctctgctgtggtgccaatgagactcccccaagaatgggattcaggtgtggatcccccacagacctgggttcagatcctggctctggccacctggtagctgtgtgggtgacagtggccctggaggtcacagccagactgttcagtgtgtctccctctgtcttccccaggccccgccgaaagtctcttcaaggagtcctattaccagctcatgaagacagccctcaaggaagatggtgtcctctgctgccagggtgagccacaggcctggagcactggggcggggcggggtggggcagggcaggccctgccggatgctgatgcttaggggcccccaggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccggtgagatgggggtgtctgggggtgggggttggggggaaggtgggcataaatagagatccctgcccctgccgggcgcggtggctcacacctgtaatcccagcactttgggaggctgaggcgggcagatcacaaggtcaggagatcgagaccatcttggctaacacggtgaaaccccgtctctactaaaaatacaaaaaaattagccaggcatggcagcgcgcgcctgtagtcccagctgctggggaggctgaggcaggagaatggcgtgaacccgggaggcggagcttgcagtgagccgagattgcgccactacattccagcctgggtaacagaggaagattccgactcaaaaaaaaaaaaaaaaccctccccaggccaggtgcggtgtctcatgcctgtaattccagcattttgggagaccaaggtgggcggatcacttgaggtcaggagtacaagaccagcctgaccaacatggagaaaccccatcactactcaaaatacaaaaaaaaaaaaaattagccgggcgtggtggcgcgtacctgaggctgaggcaggagaatcacttgaacctgggagacagaggttgcagtgagctgagatgacgccactgcactccagcgtggcaacagtgagactccgtctcaaaaaaaaaaaaaaaaaagtgccccccctgatgtgcccctggcccggtccccagagcacgaacttccaggagccggtgcagccgctgacacagcagcaggtggcgcagatgcagctgaagtactacaactccgacgtgcaccgcgccgcctttgtgctgcccgagtttgcccgcaaggtgggtggcctgcggggctgggtggtgggacccagggacccagagcgccctcctgactggcctcatgtccctccaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaagattggagtcctgtgtctcctgaccttggctgggcccaggcagggccacattcaccattgggtgcctctggggtgagggtctgcagaggccttgctggctgacccccaagtgtctgctgcagggctgaggctgcaggcgggccatcgtggatagcctggggcacagagggtcaccgcagtcgtcacgtgggacccagagctgtcctgggaagctgacttagctgtccttttaccaagcccttcacaaggccactggtgacagccccccagggcagtggggtgggtgagatcagggtggggctgcccgggagcattctcagaaaaattggggacactcacaggtgtaagtcaggtcccatccaggtactccagggcaaatacaggaaggggtggcggggctggttaccttcggcctttttaagcacatcaggagcttaacactggcccagtgactgtgccctgactccacccggcattcagacttgggttcaaattcccaccatgccccgccccctatgtggacaaattgagaaagcaagtgtgggcaccccaccagggactgcgaggaccagggctgtcccctctccaaggtgctgaactcccgccttccaggacccaacggtggtgggaggacaggaaaggaaccctctttgcatgggcctgagttgccaacccctttccccaccctgggcaggggctgggctagcggacgcatcagggagggaggccccactcccagccgaggcagccaccttggagccctaactcacccgggtatgttttctgggacaccagagtaagggggattcagtttcgccatcaactctggcttcaggccagtcatagccctccagtctccacctgccccccactccccacccctgtgaattcaccagactgagcaccttcagacctttggcccatcagcagatctgacctcaggctaacttctccaggccaccctgacctttcaaatcagtctggggagctggcgtctgcccccgggccttcatagtctcagggaaggcccgagaggagcagctggcgttcaggtgggttggcaggggctatttctggagcctgacaggccaggctgcagctgggtgggccaggcactttcatttaaccttcacaaccacctgcccgccaggcattgttcctgctgcacagaggcaaggcgatgtgcctaaggacacacagccaatcagcagccaccgtccgacgccactccaccctgctcaccccagggtctcctgcatctcaggccaggcactctggaggtcccggcatggatggtctctctgacatctactccctggccaagatccaggcagggaatgctgcccccttagagggacgatcccgtgaccccctaagtgtgagggcctttccccaagggctctggaatcggtccagatctcaatctcaactctgcctccctcagctctgtgacctgcagccacgcaggccctctgccggttaccccgatgtcagagggggagcacaccgtccctgttaggaagctttggtgagaagcacgtgcgacgcagccctcaaccagtgccggcccgagagaagggagggtggaccaggttgtggaaacagccggggccatctgggaggcaggagatctgggaagcagctgcaggaagatgaagttgccggcagcgtagatcctgcgcctccccagcctatagtctatacacacacctggccgccgcgaagaggcatgcaccagggatgggggcaagcctgagccccacgactgggtgggtgcgatgcagcccaggatgatctgctgaaacagaagcagccttgatgaggacacaacctgggtcccccagcgtcccagaaatctttgggccacaaacaggcccagtgtggcatggggaataacatcaatcctatctagacttttcaaaatttgatttatgataattagccaggcccctggcttaaggattcatgg

SEQ ID NO: 13868 - DNA, 10655 bp, Human
gctctcagtttccccaccccaggccccagtctgaagggctcctttgcaaggagttgccccctatgactgccactgcctgtcaccaatgcaaaagctgcttaagcagcctccagagagggaaaggaaagacccttgcttttcccaagttctgcaatgagtcagtctcaaggagccacggaactctgtgtataagccagtgagttgcttggccagctctgtgtggaaatggcatgatgtgtgcaggatccccatatcttgagaatggttgctgtgcccagaatgtgctgccaagtgcaccagttcctaaaacaaaatcatccatccctttggatggatgattttacatcacaattttacaaaatgcatcgcatttttacaaaatgaagatattctctgggaacagtccaaacctctgtggtgattcccacactttgctgggcatccgggcccctggggagcttgttaaagggccagtgccctgctgtgcaccccacctcgatcaggttgctctaggcagcagggcagctgtgattaatgggctcctgggggattctgatgcagatttcctaggactgcatttgaagaaatgttttgctgacattcctagcttaatgggttacttacaggttactttttctctccccattagaagtctggaaatgcaggtttgaaggcatcagggggcggggggagggatccaggtcttctataatgagctgtaaacgataaacaagtctggctagatctgtgtccaaacagacggatgggactaacaagctcttacgtccctggaggtcacagacaaagtcctcttggcttctggtcctgacttgttgcccactaactccgtagctgcttctcagatcttagttttctcacttgtaaaataagggggctgtaaataagtggaagccctggtgtcagaagaggcatcagagctgggtttgtattcccactgtgtgattttggcgaattagagaacgtttctgggcctgtttaaccatctgtaaagtggggctataaaatggagacttagctgctagggttaatgagagaattaacggaatcagtgtttgacacataagaagtgctcgatgttagtcattattttttattattttaataatatcatctctgagggcccttacaggacttccagaccgagtccacgcccctgggggacttgggagcagtaaaatgtagtggcaggaggcacctcggccatcgcccaccccaccagctgggagactcgggcaggttattcacccttctgcacctcgcttgacttatctgtataaagagaacagtcacagtaactgcctcatggagttactcccaggactgagataatccacggacacacttagcccagtgcccagcactcggctggagctccaaaaaggtcagctattgttatgaagcgtagggcggggagggttcatcctcttgggcggtcaggccaggctgcatttaggtacccggtgggggcggagcaggggcgacgccggtgcacgccctcttttttttatttttaaaatttcacccgggccttgacaaccggtacaatcctgtcctcccctgttcccgcccccgagccagaggattcgcttttgcgtgggcagctgcagggatggtgactcgggctagctcagatgtggctgccgttagtccccagctgcgcgctcccccgtccctccccagccctcttccggcgcctgctaaagcgagagaaatgccctcgggggaagatatgtagcgatccaatggaacgtggagatcaacgttgtgttttcttcgcgcccacccgaagttgaagggaggtggcgcggcgggtctcagcccctcccggacgccgaggcccggcccccgcccctcggagacccgcccccgcatgcggaaccgccctctgcgaggcccggtttgggccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtactgggggaggggagagggggcgggattcccgccgggagggatccggcgtagcagggggcggagtcttattccaaccccgcttcgctttccgcatgtcccgctttgcgctcccggccctgggcatcccgctgtttccctctgcgtccgcggccctgcccttttcgggggcacagctgtggtctttccaccccgcgagacagcggggcgagggggcgcgggcggccagtggatagaggctgatgcccccaagcacggacgccagcgtgggggtggaggttcttccagctgccctgagcctgtgcgaagcgggaggtccttccccagttcccacagactgtggggagggaagagacggtggaagcgagcgggttctgggctcctgggtctctggaactaccctctgcccttgccccaacactcaggtagcgggaaggatgaccacgctcacacgacaagacctcaactttggccaaggtagggaggctggacctgcgggcccgggggcgggggcgtctgggccggcgggcttcctcgagcgcgccaccggcttgtgcccccctgcagtggtggccgatgtgctctgcgagttcctggaggtggctgtgcatctcatcctctacgtgcgcgaggtctaccccgtgggcatcttccagaaacgcaagaagtacaacgtgccggtccaggtgaggcacgtcccagaaccacagagtgggtacagggtggacttttaaaaactctttggtcgggcgccgtggctcacgcctgtaatcctagcactttgggaggccgaggcgggcggatcacctgaggtcaggagttcgagaccagcctgacaaacatggtgaaaccccgtctctactaaaaatacaaaaattagccgggcgtggtggccaaggcctgtaatcccagctactcaggaggctgaggcaggagaatcccttgaacccaggaggcggaggttgcagtgagccgaaattgtgccactgcattccagcctgggtgacaagagcgaaactccgtctcaaaaaaaaaaaaaaaaaaaaaaaaaaacctcttccacttcgggccaagccacctcattccgcagggccctgcccatgccttccaatgccttccagttccaaagtggtgatgcctacccacccctcagaagagagttccccttgccagaagttagggaccaggcctgataagagttaccccgggggtggccgggcatggtggctcacacctgtaatcccagcactttgggaggctgaggcgggcgaatcacaaggtcaggagttcaagaaaccagcctgaccaacatgatgagatcctgtctctactaaaaatacaaaaattagcctggtgtggtggtacgcgcctgtaatcccagttactagggaggctgaggcaggagactcgcttgaacccgggatgcagaggttgaagtaagcccagatcgtgccactgcactccagcctgggcgacagagcaagactatgtctccaaaaaaaaaagttaccctgggggcatggtggcactttgaaggagctcgtgaagctggtgaaccttggtgtgaggagggtatttccaaaaacctccaaatcttctccctaccatttatcctaaactcaatgggttaaggctaaaaggcagacaaagcagtgtgcatcgcactgtagctccagtccctagaagtgcctgtctctggaaggcactcaggaaacatgagaataagtggtagaagcttaaaggacatccaggtggtccccgcttcaagtccccacaccaccattgttttctcacttccagtatggtattcaagacattacttgaggtagtcagcactttattttttattttatattttattttattttattttttgagactgagtctcgctctgtcgccctggctggagtgcagtggcgtgatcttggctcactgcaacctccgcctcctgggttcaagtgattctcctgcctcagcctcccgagtagctgggattacaggcgtgtgccaccacatctggctaatttttgtatttttagtagagacaaggtttcgccgtgttggccaggctggtctcgatctcctgacctctggtgatccacctgccttggcctcccaaagtgctgggattacaggcgtgagcactttattatgaaacaggttttgtgttagataatgttgcccaactgtgggctaatgtgttttgagtgtgtttaggtaggcctggctaagctatgatgttctgtatgttatgtgtattaactgcattttccgctggcgatatttgattggtttatccaaacataaacccatagtaagttgaaggtcacctttagaggggaaaggaaaaaacaattgacatttactcacttcttctttatgatgaagtgattgaagcccagagaagttaaggaatttgcctgaggccacacagttccttagttcttaacttttgacatctgattacattttcctggatcctttttctggaaaaatgcccaagtgcacaaagatacaactttagggatttttcagactctggaggagtccatggaccccacattaagaacccctaatggtatattaaatgctcatattgggattgagttcttatctttcttttcctttgagatggagtcttgctttgttgcccaagctggagtgcagtggcttgatctcagctcactgcaacctccgcctcccaggttcaagtgattctcctgcctcagcctcccaagtagctgggattacaggtgccacctcacctggccaatttttgtatttttagtagagatggggttttgccattttggccaggctggtctcaaactcctgacctcaggtgatccacccacctcatcctctcaaagtgctgggattagaggagtgagccactgtgcccagcctgagttcttatcttctaacttctttctctatggataagttcacagttcttagcctctggttttttttttttttttttgagatggagtctcgctctgttgcccatgttgcagtgcagtggcgtgatctcggctcactgcaacctccgcctcccgggttcaagcgattcttttgccttagcctgccaagtagctgggactaaggtgcctgccaccatgcccggctaatttttgtatttttagtagagatggggtttcaccatattggccaggctggtctcgaatacctgaccttgtgatccacctgcctcggcctcccaaagtgctgagattataggcgtgagccaccatgcccggccagttcttagcctcttgagggaaagtggggtctcctgggtagggagccctggagagctgctgggcctcggaccgaaggcagatggggccttaggctcctggttgtgttgggtggtttccccatctgtgctttgggcctcacgagccgcatggtattgtgtgcagatgtcctgccacccggagctgaatcagtatatccaggacacgctgcactgcgtcaagccactcctggagaaggtgagggtgcactgggctccccagccatctcaccccatgctcacccccgtccctgtgtgctcacagtccaactctgggatggggtgaagctaggactctgtggggtcttcatggctccaatacccagaagcctgttccctgcactctggagaccatcccaacccaggggcaggccccaaggcatgcgggccatgttcagggtgccttgggcctgggagcccgggttggagctggctctaagtaggggctgccccagagggttcggggttcttctcacatccgtcccctgttctccacgctaaacgttctgtctgagctgagcccctcagggtttcttccccatctagtcctgatctcagacttcctgggaccttccctatggggcccgggcattctctcagcctacaccactcatgctggagggtgccggcttctcaaactcgctatctggcctcttggggacccccagcctagcagctgagcagggctgtgagtgggccgtttctcctccttccttgggcaagggggtggaggcagggtggtgtagtgggggtggggtgcctggctctgcagtgggggttcctctctttgcagaatgatgtggagaaagtggtggtggtgattttggataaagagcaccgcccagtggagaaattcgtctttgagatcacccagcctccactgctgtccatcaggtgggctgcccctgcccctcgcccactagctggcatcaggtgtgtctctggcaacacacccacccctttaaggcggcccttgaataccttggtaaaggcctgggaggagaaagggcaagaagcaccagcatgacaaggggacagcctgtgagcagctgagatgggtccagagagatgacatgagctacccagggtcacctgggtgggggcagagcccaggacacagaagcagttttctgactccccaggcaagtgtccagtcaactcgaagttgacctctggcacatgcgttagttggtcaactgcatgcttccaatggtgaggtcagggcactggaatctggcaccaacctgtccccacggcctgtgtggccttaggcaagccctttcccctcctggcttggtgtcctggttctgggtcctggctgcacattaaaaccacctagggaggcctcctcaggctgcccctacctcccctgtcccctaccccccgccaaattctgactttatctggggtggggctgggcatttcttttaaactcccttgctggtttaattgtgtggaccggatagggagctgggtcctaggcatgcagcactctcacaggcactggagggggtcttgtaccccaggtctgcatccaggcttgatgcctgtggtggaggggagggcgccagtgtgatgggaagacctcctctcactcccagctcagactcgctgttgtctcatgtggagcagctgctccgggccttcatcctgaagatcagcgtgtgcgatgccgtcctggaccacaaccccccaggtgtgtccactccccaccctctcttcccttggcatttccatggttatctcgggttggtctgtgttcccaggtccatgtttggctgttctgagactcatctcttcctaaccctgagagtccacctcctctgggaagcttccctgattgattctacctggcttccatctccctattgactggggcttttcttagcacttgctttgccatctgctctgggggtgctgctgagccagcaagggaagtgggaagaggctgggcccagtggctggcaccagggcggtgggggagcctccaccaacctcttgcctctccaggctgtaccttcacagtcctggtgcacacgagagaagccgccactcgcaacatggagaagatccaggtcatcaaggtgagatgagatgggtctgggtctgggcgcaggctctagaaacgtgatgtcgcagttccaggcgggcaggggcactgcctgtggccagccacccattacattggtgtggcagcgcctggcacccagcaggtcctcaggcctgtccactgctccatctgggcacttggggcagtgaggagcccaggtggagccacctactggggcccccagctcatcctggctcttctgaagtgggggctctccagggaggggtcctagcccaccaggttcagcgttggtgcctggagcctgttcgtcacttgggttctatggacttggcctctgtgggggatggggggggtcctggggtctgcatcaccaacagcttcctagtgattctgaggctcaggttggaggcccctggtctggagtgggagggacagcaaagtgagggcaggccagggcccagccccgtcacccccctgacctttgtctcctccctaggatttcccctggatcctggcggatgagcaggatgtccacatgcatgacccccggctgataccactaaaaaccatgacgtcggacattttaaaggtgagcttcgtggggacccgggaagctttatttaggggctgcttaacgaagtgaggcccggtgctgaggccttactagagggcttgcgggagagaacgggggagtgcctggtggagggctcctcccatctctactcttctccaccatggctatggccacgaggccccacctgtggtggaggtctgcccaccaggggcttctgtgtcctccagcagggatgccctggctgtcttgctgactgtggctgtttgcttgtgtccgtcagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatcattaactggagtgggagggacaggtatggccagggtaacctgggagaggggctgcttctccaccaaaatgccagggaccccctctccccactcctaaaaccaaccccaggctggttttactgaaaacatttattttttatttatttattattattattattttatgagccagagtctcgctctgtcacccaggctggagtgcagtggcgtgatctcggctcactgcaagctctgccttccgggttcacgccattcttctgcatcagcctcccgagtagctgggactacaggcgcccgccaccacgcccggctaattttttgtatttttagtagagacagggtttcaccgtgttggccaggatggtctctatctcctgacctcgtgatccacctgcctcggtctcccaaagtgctgggattacaggcgtgagccacagtgcccggcctgaaaacatttattacaacaaaacgtcagagctatgtgacagtaagttaccacaagctggtagggttgaaccggggcaggagtcgctggtacagggacctcactgcccaccccatgctcagctcctgcctggaggaacctctggctgacccagacacaggatggacagctgtcagaaaatctggacaacagctcggtagggcgattgggcagcctcctcctgtccatgcttctgcccaggctgagcctcggaggaggcctggttcctggtcatcttggggctgacgacaatgctgctgttggtgactcggggcccataccagcctgcccagtactgggtgtccctgcccccatgctggaagaggatgtagcggacaccccgggggtagtctgagaaggtgtaggagacctgttgggaggaagggagaggaagtgaccaccgggacgggggaggggaaggcaggagccaggtcctctaagagagctgcccaggctggaaggcaacagctccaggccagcaggggcaccctgggccctgaggctgccctttgcttcctgccatcctggccctgggaggagtgggtagagagagcaagtgggtgaggcctcacctctgtccatgtggcattgttccactgttggatggtcacaggtgggggctcgaaggaggccaacacgaagtagtcagccgaggccagctgcactttgagttggtaggtgcagccacagtcggctctggcagcaaacctggtggaggggttgagagccctgtgtccaagccaccgagggctggccccaggggtgggggcaggtgggacctatacattggagctcggagcttcatctcccatcagctgacactgctctgcctgcaaggcccagctggcttcagcgctccctatgccccactgtggcccggggataagctgtctgtccatgctggcctctgttaccccatctgagaagagggacccttttgggcatcctactaaagatatgacctcaaaaatcaaaagacccctccagagaggcctggtctgtccaagccatgtcacctgtacttacaatggaccaggctgtggattcagtgggagagtcaagggggtggcctgtgtaatggggctggcacaaagctcaccctctgctcagcccagccacctctcccccctgcagctctgcatacccctccatcctcaccgctttatcctcagagtggcagccctggggcctgcctagaactggggtcctgcttctgccaccggccaagccagagcctggcacagttctgtgcacagagtaggagctccaaaaagagtcatgggatgaatagggaaaggggcaggggaggcaggtaggtcaggggacctgggggttcccacccagtccagagagggctgaggtcctctgttgcccaagtgcctgtcagtgcacagtggctgggcacagtggctcacacctgtaatcccagcactttgggaggccgaggtgggtggatcacttgaggtcaggagtttgaaaccagcctgaccagcatggta

SEQ ID NO: 13869 - DNA, 14241 bp, Human
ctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatcacccagtctcgggtatttctttatagcagtgtgaacatggactataatccagtgctcaataagtactcctcacatttagctatctcagtcaagggtgagctagataagggctttggccagggcaggatcaccacccaccagcccatggcaaactgcaaaaggacggccttccacggagaacatgtagccctgactgcaattaatgtgtcctgggccagtccccttgtgcagtacacagcctgcacaacccttggtggttgcctgaacaaggtgcttgctaaatatttgttgactgatggaagaaattcatgaacttaatcctgataaaaaacctcagaggttttttattttttgagacaaggtctggctctgtcgcccaggctgcagtgcagtggtacagtctccactcactgcagcctcccaggttcaagcgattctcccacctcagcctccggaggagctgggattatagacctgtgccaccacgcccggctaatttttgtatatttagtagagacagggtttttgccatgttggccaggctggtctcgaactcctgacctcaagcgatcctccccacctcggcctcccaaagtgctgggatcacaggcgttagccacctcctagcacctcaggttttttacctttgagtctatgaagcctgcggaggtcacgccctagggaaagaaggagcccactgggtgtcagctcctgcctctagggaggggaccgcgggtcaagggtggagccctgggccgcataaggaaggaactagtgcggaggtccggggagcggccgcgcgttcgggagcttcggccctgcgtaggaggcgggtgcaggtgtgggtgctgagccgcccgccgcctggagggggagacagcttcaggacacgcaggccgcagcgagggcccgggccctggggatcccaggttcgtcttcccgcggcgagggttaggggccgggccgagagggacggcagcggggtccggggcgggggtggggaccgagcgcagcgcgtgacgcggcggcggggcccagcgacaacgaagccgaggccgtaggctcgggccgacctggagctccgccgctgcgcccaggtcgcgtccccggggggacgggcggcgggcgagtggggagccggggtctccggcgcctgggcgttcacggagcctgcgggcgctggtccgggcggccaggggtggggggcgcgggcggctgggcccggacttcgactgggggcctggccccggggccacccaggcggaggctctgcggccgcctccaccccggccacatcccgaggccggcgccgggttcggagaactgtcaagggacctccaggcccccacacgcctgcgagatccggcgcttgccttgccccagccacagtttctgtttccgagaaaccggtgaagtaacaatgccactagagcttgctgggagggtgggtgcggagaaggcgagcacgagacgccgggccgggcagttggggaccccgatcggtgtgagagggcttcctagggctggcatggacttccccaccacaaaatgcccagggccgggggggggaaggggcgcaagaaaatgcggactgggccagagaccagacttcggtcaccacggtgggaagctattggtgcctagatgcctctagcttggagcccagtgacttttatttcgtctagagtctagacagtgcctttagaagctgccagcatttatttatttatttatttatggcagagtcttgctctgtcacccaggctggagtgcagtggcatgatcacggctcactgcagcctcgacttcctgggctcaagcgttcctcctgcctcagcctcctgcatagctgggactacaggcacgggccaccaggcctagctaatttctttttttttttttttttttttttttttgagacggagtgtcgctctgtcgcccaggctggagtgcagtggcgcgatctcagctcactgcaagctccgcctcccgggttcaggccgtcctcctgcctcagcctcccgagtagctgggactacaggcacctgcttctcgagtagctgggactacaggcacctgcaaccaagcccggctaattttttgtatttttagtagagatggagtttcactgtgttagccaggacggtctcgatctcctaacctcgtgatccgcccacctcggcctcccaaagtgctgggattacaggcgtgagccaccgcgcccggccttttttttttttttttttttttttgagacagattctcactctgttgcccaggctggagtgcagtggcacgatctcggctcactgcaacctccgcttcccgggttcaggtgattctcctgcctcaccctcccgagtagctgggactacaggcgtccgccaccacgcccagctaatttttgtatttttagtagagacggggtttcgccatattggccaggctggtctcgaactcctgatcttgtgatccgcccgcctcggcctaccgaagtgctgggaatacaggcctgagtctgtgcacccgacctaatttctttttttctagagacagagtctcactatgttgcctagactacaagcatttttaattgacaacttttacattttttttcaaatgcttacagttgcttctcagaacttagaagacttggccacattgggtttttttgttatttttttttttccatcaaagcatttttcttttctctttttttttttttttttttgagacagttttgctctgttgcccaggctggagtgccatggagcaatcatggctcactctgctccagcaggctccttctttccctagagtgtgacctcggcaggcctcatggactgtaaggtagaaaaatctgaggggctgggttcggtggctcacacctgtgagctactgcagccttgacctcctgggctcagaagatcctgacgccatagcctcccaagtagctaggaccataggcactcgccactatgcccggcgaattttttcactatttatagagacggggcctccctgtgttgccaaggttgcaaagccttttttcttttctttttttttttttttgagacggtgccttgtactgtcacccaggctggagtgcagtggtgcaatctcggctcaccacaacctccgcctcccaggttcacacgattctcctgcctcagcctcctgagtagctgagattacaggtgcacaccaccacgcctggctaatttttttgtatttttagtagagatggggtttcactgtgttggccaggctggtctcgaacttctgaccttgtgatccgcacccctcggcctcccaaagggctggggttacaggcttgagccaccgcacccggcctgcaaagcatttttcacgaggcacaagtacctcacctgttttctctgccatgtaaagtgttcctccctgggcagaagtgagcatgcacccaccctcctgttttctgagatgggagccttcagaagaccatgaactgctgctttggccaagcctctatggaaaatcagaagaggccacagcaaaaggctgggtacagtggctcacacctgtaatcccagacttcaggaggctgaggcgggtggatcacctgaggtcaggagttcaaaaccagcctggccaacatggtgaaaccctgtctctactaaaaatacaaaaattagctgggtgtggtggcgggcacctgtaatcacagttacttgagaggctgaggctggagaattgcttgaacccaggaggtggagattgcagtgagccgagatcacgccattgcactccagcctgggcaacaagagtgaaactgtctcggggtgggggggaagaaaaaaaaaaagaggccagcaaggttctgtttccctgcttgtaggtggagaacattctctcctcatgtgtaagcagatgaggcccacctgagtgacagtgcagagccctggctgccggccaacccccacctacctggggcaagtacctgggatccccttaagaggactaaccaggtgcccccaggtaacagattcaggccagggctgtggcactgcttgaagttttccagaacccgtgcgcagtgcagaggtacaaggaggacagtgttgagagccggtttgtgctgacagcaatgctgactgaagctctgtgcttcacttggtcctcctggcccttccagggtcgggacagttaccccctccttttcacagcttcccaactggtcactgcagaccaggattcaaacccaggcagtcttctcagccaccctccatctgattttttttttccggccatctccaagtggattctggcctgacaccaaagacagctcagccgggtgccgtgggggattcccatggggttgttttatcacatgtgacttccaggccaaagtaagcttctggagataggaaggtggtttctcagcgctagctcaccactaaatgaacattaatgagtctgggatgtaaaactgattttatattctggccgggtacggtggctcacgcctgtaatcccagcactttgggaggccgaggtgggcggatcatggggtcaggagattgagaccatcctggctaacacgatgaaaccccgtctctactaaaaatacagaaaattagctgggtatggtggcatgcgcctatagtcccaactactcgggaggctgaggcaggagaatcgcttgaacccaggaggcggaggttgcagtgagccgagattgcaccactgcactccagcctgggtgacagagcaagactctgtctcaaaaaaaaaaaaaaaaagattttatattctaacagtgaatccagagcattaaaataacaatcaccaaaaccctcacagaactttgcagacaagtgtggcctccacaaaatcttacagtccacacaacccactggctttaaaattaagcaattttttttaaattggggaggggccttttaaaaaatgtgtctctaaagactttactatttgtattgcactcttctgaatgtgtgtcccatgactactctttccactgaggggctactgtttactggaaggaccctcagcctcagaaatgctcttttgtgggtttttttttttttttagccagagtcttgcttggttgcccgggcaggggtgcagtggcgcgatcataggtcactgtagccttgaattcccaggctcaagggatcctctgcctcagcctcccaagtacctgggactccaggcatgtgccaccacacctggctaatgcagggttggagaggagtccctggcctggttccctggggacctgagggcccacctccctggtcaggctcataactgctgttgcccccacaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaaggtggcatgggggcagggtggaggctgccaccaggctcgttccttctcatccttgggccttggcacttgcaattcccacactacctggaatattctctaaccctaaacacccacctcacttccttggttccttctcattcttcaggtctcagttcagagacctgccctgtgctcccaatctaaaaacagccctctccacctctagcatagcacccccatttcatgccctgtaacacttttcacaaggcgcggtggctcacgcctgtaatcccggcactttgggaggccgagatgggcggatcacctgagctcaggagttagagaccagcctggtcaaaatggcaaagccctgtctctactaaaaacacacaaagttgggcatgctggcccacgcctacaattcccagctacttgggaggctgaggcaggagaatcacttgaacctgggaggcagaggttgcggtgagccgagatggctccattgcactccagcctgggtgacaagagtgaaacttttagtctcaaaaaaaaaaaaaaaatttttttttcagaatttccttatttttttctgctacaaacttcaagctccaggggccaaatggaccttgtttgccacactatagcatccacagtgacaccttcacatatacacacacacacatatgtatacatatacgtatatacacatgtatacatatatacacgtgtatacatatacacatgtatatatgtatatatgtacacatatatacgtatatatacatatgtatacatatatgtgtatacatatatacatatacatacacacacacacacacacacacacacaagtagttgggattacaggcgcccaccaccatgcccagctaatttttgtacttttagtagagatgaggttttgccatgttggccaggctggtctcgaattcctgacctcggtgatctgcctgcctcggcctcccaaagtgctgggattacaggcgtgagccaccacaccgccgggggcggtggctcacgcctgtaatcccaacactttgggaggctgaggcgggcggatgacgaggtcaggagatcgagaccatcctggccaacaaggtgaaaccccatctctactaaaaatgtaaaaaaattagctgggcgtggtggcaggcacctgtagtcccagctacttgggaggctgaggcaggagaatagcgtgaacctgggaggcggagcttgcagtgagccaagattgcgccactgcactccagcctgggcaacagagcaagactccgtctcaaaaaaaaaaaaaaaagtgccctggtgattgcctgggcagcgccagtagagaagcgccattgtcttctaaggtcctctaagttcagtgtgaagagggtgattgctcccctgcacccaccaggcccacctaatggaggcccacccatgaatgttaccacagcgcccagcccaaagggtacctgttcttccacttggcactcttgccctgggcagaggccatctgagccctatgggaatcttggttcccatgacccaccgacaaacccacaaacccatcctctagggcctccaacctgggttatgtagttaaccaagggcctctccctcctggacatctgggatgccatctgggtcaagtaagcagtctgtgttgggatgaacacgttagccttttttaaaaaattattttacttattaaaaaaaaaagggggggggggtgtcgctatgttccccaggctggtcttgaactcctgggttcaagcaatccacctgccttggcctcccaaagtgctgggattacaggcgcaagccaccgtgcccggcttcacattagtctttgaggacagtactctcacaggcctctcgtaattttttgagaactgatacttgggtatttcccagagttccaccgcaacatggaagtgaggaaggggttggtttagaatttctggtaacacgcattcttttctccagctgcgtgttaggagtgaggccagtttgggactgagtgggagggacagagtcagatcagagctgatatggtgaggacagttgggaatgtgttggaggggtgctttgtaggggtgctccaaggtgcagttggggtacacttgggctggtggggtaccttggccacacaatgcccttgagaaggaacaagctggttaaccctttggtgtccacagccgcagagacctgagcatgagcaagtcctgcctcccaagaaggtcactaacgccaaccaccctccctcccgccctcctgggactaagtggggagggctggactttggatttacacagggggtctcaccttggcttctgttcttcctagaggatatgtttgcatggcaaattgatttcaatggtggggaccgctggaaggtggagagcctccctggagcccacgggacagattttcctgaccccaaagtcaagaagtattttgtcacatcctacgagtaaggcaaactgaacctaccaggcttgcgtggaggggacagagggtcaggacacctttgccaagtctcaggcaaagtcttcctaagggaagtcctctctgcgaagctcgagggaggtggccccaaaacttgcccagagtcactgcttcctgaaatcactcagtgctgtgttaatggacagtgggggtggggatcactgaagcaggccaggagtccattgggcagttaagataagccagggctatctacaggcatctgtccgtaagctaggaacttgagtttacaaaagtgccctggaacaatgggcctttggactgggatcaaatgccgcccaggcacaagtgggtcaaactccctcctgcactggaggaaaagccagagtcagccccagccagtgcctgtcccgcagcggccaaggggtaccctaggtccccaaaccacctccctgggctcacaggggctgccaaggcctgggtgagggggggggccatgcagagcacacccaggtatgcaagcccccaactctgctccccagaatgtgcctcaagtcccagctggtggaccttgtagccgagggctactgggaggagctactagacacattccggccggacatcgtggttaaggactggtgagtagggtccatggcctgtgtccccacactctacatgctcctcttactgcgctgcatgtacgtgagacaacccatagcaagtgcccactctgcacagcagtgccctggagccaggtagccccggcctccgcccctgctctgcacccacaccctgcggcacctcctggcctccccaccaccctgtgacgtagtcaacaggacacagtagccccagtgtgcaggtgaggaggctgaggcccccaggtgcactgtcatggacaggcactttttttttttttgagacggagtctcgctctgtcacccaggctggagtgcagtggcgtgatcttggctcactgcaacctccgcctcccatgttcaagcgattctcctgcctcagcatcctgagtagctgggattacaggtgcccaccactacacccggctatttttttttatatttttaatacagacagcgtcttaccatgctggtcaggctggtttcaaactcctgacctcaagtgatccacccacctcggcctcccaaagtgctgggattacaggtgtgagccactgtgcccagccactgtgcactgacaggcacttgggcaacagaggacctcagccctctctggactgggtgggaacccccaggtcccctgacctacctgcctcccctgcccctttccctattcatcccatgactctttttggagctcctactctgtgcacagaactgtgccaggctctggcttggccggtggcagaagcaggaccccagttctaggcaggccccagggctgccactctgaggataaagcggtgaggatggaggggtatgcagagctgcaggggggagaggtggctgggctgagcagagggtgagctttgtgccagccccattacacaggccacccccttgactctcccactgaatccacagcctggtccattgtaagtacaggtgacatggcttggacagaccaggcctctctggaggggtcttttgatttttgaggtcatatctttagtaggatgcccaaaagggtccctcttctcagatggggtaacagaggccagcatggacagacagcttatccccgggccacagtggggcatagggagcgctgaagccagctgggccttgcaggcagagcagtgtcagctgatgggagatgaagctccgagctccaatgtataggtcccacctgcccccacccctggggccagccctcggtggcttggacacagggctctcaacccctccaccaggtttgctgccagagccgactgtggctgcacctaccaactcaaagtgcagctggcctcggctgactacttcgtgttggcctccttcgagcccccacctgtgaccatccaacagtggaacaatgccacatggacagaggtgaggcctcacccacttgctctctctacccactcctcccagggccaggatggcaggaagcaaagggcagcctcagggcccagggtgcccctgctggcctggagctgttgccttccagcctgggcagctctcttagaggacctggctcctgccttcccctcccccgtcccggtggtcacttcctctcccttcctcccaacaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggcactgtggctcacgcctgtaatcccagcactttgggagaccgaggcaggtggatcacgaggtcaggagatagagaccatcctggccaacacggtgaaaccctgtctctactaaaaatacaaaaaattagccgggcgtggtggcgggcgcctgtagtcccagctactcgggaggctgatgcagaagaatggcgtgaacccggaaggcagagcttgcagtgagccgagatcacgccactgcactccagcctgggtgacagagcgagactctggctcataaaataataataataataaataaataaaaaataaatgttttcagtaaaaccagcctggggttggttttaggagtggggagagggggtccctggcattttggtggagaagcagcccctctcccaggttaccctggccatacctgtccctcccactccagttaatgatggctcagctcagcccagcccttggggcccctttattgaaacaactcacagcacagtatttgagacagacagtgttggccggcggaaccccaggaggctgagaagtcgaggttgcggcatccctcactgccctcctgggggaggcatcctccaagcagacctgagcggccccgggctggggcgggcgatccacacacagaggcgataagagcacttggaatcagggcagccatgcagcactgccctaggcggggatcccccaaagtctgacagtttgggcatcagtggggtggcaggtgccccctcagctgcctttatgagcgcgctcttccacgtaaagctgcatctgacggacacaagcaaacagccacagtcagcaagacagccagggcatccctgctggaggacacagaagcccctggtgggcagacctccaccacaggtggggcctcgtggccatagccatggtggagaagagtagagatgggaggagccctccaccaggcactcccccgttctctcccgcaagccctctagtaaggcctcagcaccgggcctcacttcgttaagcagcccctaaataaagcttcccgggtccccacgaagctcacctttaaaatgtccgacgtcatggtttttagtggtatcagccgggggtcatgcatgtggacatcctgctcatccgccaggatccaggggaaatcctagggaggagacaaaggtcaggggggtgacggggctgggccctggcctgccctcactttgctgtccctcccactccagaccaggggcctccaacctgagcctcagaatcactaggaagctgttggtgatgcagaccccaggaccccccccatcccccacagaggccaagtccatagaacccaagtgacgaacaggctccaggcaccaacgctgaacctggtgggctaggacccctccctggagagcccccacttcagaagagccaggatgagctgggggccccagtaggtggctccacctgggctcctcactgccccaagtgcccagatggagcagtggacaggcctgaggacctgctgggtgccaggcgctgccacaccaatgtaatgggtggctggccacaggcagtgcccctgcccgcctggaactgcgacatcacgtttctagagcctgcgcccagacccagacccatctcatctcaccttgatgacctggatcttctccatgttgcgagtggcggcttctctcgtgtgcaccaggactgtgaaggtacagcctggagaggcaagaggttggtggaggctcccccaccgccctggtgccagccactgggcccagcctcttcccacttcccttgctggctcagcagcacccccagagcagatggcaaagcaagtgctaagaaaagccccagtcaatagggagatggaagccaggtagaatcaatcagggaagcttcccagaggaggtggactctcagggttaggaagagatgagtctcagaacagccaaacatggacctgggaacacagaccaacccgagataaccatggaaatgccaagggaagagagggtggggagtggacacacctggggggttgtggtccaggacggcatcgcacacgctgatcttcaggatgaaggcccggagcagctgctccacatgagacaacagcgagtctgagctgggagtgagaggaggtcttcccatcacactggcgccctcccctccaccacaggcatcaagcctggatgcagacctggggtacaagaccccctccagtgcctgtgagagtgctgcatgcctaggacccagctccctatccggtccacacaattaaaccagcaagggagtttaaaagaaatgcccagccccaccccagataaagtcagaat

SEQ ID NO: 13870 - DNA, 155266 bp, Human
agctccgcctcccgggttcccgccattctcctgcctcagcctcccgagtagctgggactacaggcgcccgccaccatacggctaatttttttttttttttgtatttttagtagaggcgggatttcaccgtgttggccaggatggtctcgatttcctgacctcgtgatccgcccgcctcggcctcccaaacccggccaggaactaattactttcttttagcttacatttgaagagctagtcccctgtagaactgcgttgttcagtacaagaaccaccagccacatgtggctgtggagcacttgaaatgtgactagtccaggccgggcatggtggctcacacctgtaatcccagcactttgggaggccaaggcgggcagatcacctgaggtcaggaatttgagaccagcctggccaacataataaaaccccatctctactaaaaacacacaaaaattagccaggcgtggtgctgcacatctgtagtcccagctactcgggaagctgaggcaggagaatcatttgaacccgggaggtggatgttgcagtgagccgagatcatgccactgcactccagcctgggtgacagagcgagactctgtctcaaaaaaaaaaaaaaaaatgactagtccaaattgacattgttgtaagtgtaaaatgcacattagattttgaagactcgctaaaaaaaaagaatggacactatatcaattttttaaatattgataacatgttgaaatgatattttggatatattggtttaggtaattaatttcacctgtttctttttaccttttaaaatatggctacaagcagccttaaaattacatttgtggatcattgtatttcctcttttttttttttttaattgagatggagttttgctcttgttgcccaggctgtagtgcaatggcccaatctcagctcactgcaacctctgcctcctgggttcaagtgattctcctgcctcaacctcccaagtagctggggttacaggcacgcactgccacgcctggctaattttgtatttttagtagagacggggtttcaccatattgcccaggctggtctcaaactcctgacctcaggtgatctgcccaccttgggctcccaaagtgccgggattacaggcgtgagccactgtgcccggcctaaatttccattagatagtgctgctgtagaataataatctctctttttagactgaacttgaggaaaggggcagtcttagtcatttttaattctttccctacctcctgacatttgttacctggcattttgccatgtacatagtagtagtagtagtaataataatagctaacaattattaagaacttagtatatgccctgcactgttttaaacactttttgacacgtattaagtcatttagttctcacatcaacccatgaactaggtactattatcttcctattgtagttgaagaaacacattttgagtgtctttcttgaggtatataaccttgtttttgttttcgtttgtttttgttttgagacagtgcagtggcaggatctcggctcactgcagcctctacctcccaggttcaagggattctcctgcctcagcctcctgggtgacacatgccaccacgcccagctaatttttgtatttttcatagagatgggttttcaccatgttgggcaggctggtctcaaattcctgacctcaggtggtcctccaggctcagcctcccaaactgctcaaggtatataacccaaggattcaaacccaagtaggctaggccgatagcccacaatttaacctccctactacactgcctcttttaaacatcagtcattgtttaatgaatctaggctttctaaatgttcctcaatcagatctctcaacctttttagaatcccccgcctgacaagggctagggggagatctgtgttgggtgaccagggccataagtaaatttatcatcatactttcttatccagaatattaaaggaaacttctctctaaagaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagaggtgcttctgggatctggggccagtcattgtgggatgtgtgggctaaatgtaccatcactggtttacatttttttttgtacagctaagtgaggatttggaaaacagagattattttataaaggcacccaacctgtcacatccataaaacatgcaggttcttttgcagcagttgcacatttttgtagcatttttcttgtttgtggtcacattttaggggccagaatagacttagctgtttcttttaactttttattttttccttaccacataccacaccctcaaatgctttctgtctgataacagtgattgggatgggtttggagagttgagagctaggggctttctaaatagagaccagacttgaggtcagagacagtatcttgtttctccttttatccctggtactagaaagaacctaggacaggacattttctgccacagagtagatacctaataaatatttgttaaataatcagatgattgcaagttcaggtactctacagtgtaatcctatagaaatgggcagtaacttgtcttctttggtttgaactatacctcctgcctctcaggatctaatctttagatgccagcccactcccaccaccacagttagagaattattagaaattgttctgattatatcttcttttgcagatgagtcaagaggagtctactcgcttctatgaccaactgaaccatcacatttttgaattggtttccagctcagatgccaatgagaggaaaggtggcatcttggccataggtaaggacagagtctctggtcacaaaaacaacacactcacctttgtgcccactgcaccctgtgtctgccacttactggatactagttcatatttgcttaatgaaatttaagaagcccgtggcttttaattctagcagcagccctgggccacaggaaaaacgtatttttagatgtggaagtggagtctcggaaccatcgagtgacttttcagacagtttaccagagctgagactagaagccagctttctttccactccttcatattgccttttgtgggctctgcttcctcagtagagcagggtttcacatagtggggctcacgaatggaaaagtggaatcggtatagttaataaaaggcaggtctttttttttttttttgagatggagtctcactcttgccggggctggagttcagtggtgcaatcttggcttgctgcaacctccgcctcctgggttcaagcgattctcgtgcctcagcctcccgagtagctgggattacaggcacctgccaccatgcccagctaatgtttgtattttcagtagagacagggtttcaccatgttgggcaggctggtctcgaactcctgacctcaagtgatctgcccacctcagcctcccagagtgctgggattacaggtgtgagccaccacaactggccaggcaggtcatttttaacttctaaggactggtcatcagtcctgtgaattattatccagtcccagttgttttccctttttggggggtaggggagaaaattatactagcatgagattattttgctttatgtaaatatttctggcacaagtattaaatatctgggttaaaatgaaaattgtatctgtccttgccatctagaaatgtactcaaagtagaatggagggttcactcgccagatttttttttttttttttttttttttctctgagacagagtctcactctgtcgcccaggctggagtgcaatggtgcagtctcggcttactgcaacctctgcctcccaggtccaagcaattctcctgcctcagcctcccaagtagctgggattacaggcgtgtgccaccacgcctggctaatttttttgttttcttttttttttttttttttttgtatcttagtagagacggggtttcaccatgttgcccaggctggtctcaaactcctgagctcaggcaatccgcccgcctcagcctcccaaagtgctaggattacagacttgagccaccatgcctggccggcactcaccagcttttagttgaagtctgcgtactttcctggccagcatacgccccatcatcaccttttgccttcctctcttttgcagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtgagtgtctacagggaggagcacagccaggcttggggaacgatggtgtcatgggggggtcttttgcttccttctgaggctcattccttaaaaaagctggttagaagagctaggattccaggctgtgagatggggtagagtccgtccttaagagggaatctagcatggtgtggtggggatcagaagcatcagctgcgtgctttccagtctgctgcccttcggaggaggcagtactgtgaggagggggcacggtaccaggaaaaggacacacacttggaccctggctcaagtcttggctttgcaacttcctacctaactctgtaacctggggcagcttctgaccttcagtttcttcctctgtcaaataaaaataacaacaggattaaacattaaacaggattatccattcagtaaatatttactacatacctactgtattccaggtagagttctaggctgttagtatagtggtaaagaaaacataaaacacatctgcacttccagaacttatgttcaaacattacaagcattctgtgtttgtaaacaacctaggataatgagcactgagatgtttaatcaattttgctttccttcctctgtcctcagaatttcctagctagaagagtgagcaagccttctctgttcctggtgtgtatggctctaagatgacaagagactgtactcctgagagaacaaaactctggtaccaatgagagttctcggtttgcttttttctccaggtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacagggtaaggagatggctccattcccaccactagcaaagcacatctgcgtagagaatcacctggcctaaagggcagccacaagcccttgccatggagcaagaatcacgttttggtttgctctcaaatgaatttttttttttttttttttgtgatggagtcttgctttgtcgcccaggctggagtgcagtggcgcaatctcggctcactgcaacctccgcctcttgggttcaagcgattttctcccaccttagcctcccgaatagctaggactacaggcgtgtgccaccacgcccagctaatttttgtaatagagacagggttttgccatgttggccaggctggtcttgaattcctgacctcaggtgatccacctgccttggcctctcaaagtgctgggattacagacatgagctaccgcgcctggcctccaatgaattttttatgctcagtatgaatcaatagttactttattgcattttattaaagcaaacatctattgatagccataccattattctatacattattttatgtatgactaagaatgcaaatatgccaattaaactgtgacttggtacctctttctttttttttttttttttttttttttttggagatggagtcttgttctgtcaccaagctggagtttagtggtgtgattttgtctcactgtagcctctgcctcctgggttcaagtgattctcctgcctcagcctcccgagtagctgggactacaggcatgtgccatcacgcccagccaatttttgtgtttttagtagagacagggtttcaccatattggccaggatggtcttgatctcttgacctcatgatccacctgccttgacctcccaaagtgctgggattacaggcatgagccactgtgcccggccaactttgtaccttcttcttattaataattaattataagacatctcagctggatgctcacgcctgtaatcccaacattttgggaggccaaggcaggaggattgcttgagctcaggagtttgagaccagcctgggcagcatgtgggatcccgtctctacaaaaaataaaaaaattagctgggcctggtgttacacgcctgtggtcccagctatttgggaggctgaggcgggagaattgcttgagcccaagagatcaaggctgcagtgagtcatgatcatgccactgcactccagacttgacaacagagtgagactctgtctcaaaaaaaaaaaaaagacatctcttttcagagatgttaaaatacggaaaaataggtgtctcaaaatcagtgagatacaaatgatactaatttagaaagtgccatttctctctgctctagtataatgaggcctgtgctgattactgctgcagagggaacttatcagtgagtcttatattagaaaaagagctctgaacatgggattgggagatgcgggttccagtcttgcctttgctgtgtgatcttggacaagtcacttaaattctttgagcctgtgtttttagctgttaaatagggatgatgatggtatcttcctcaaaggcttattatgagaattgaagctggggctgggcgtggtggcttacacctgtaatcacagcactttgggaggctgagatgggtggatcacttgaggtcaggagtttgagaccagcctggttaacatggtgaagccctgtctctactaaaaatacaaaaattagccaggcgtggtagtgtgtgcctgtaatctcagctactcagggggctgaggcaggagaatcacttgaacccaggaggtggaggttgtggagagccgagattgcgccactgcactccagcctgggcaatagagcaagactccatctcaaaaaaaaaaaattgaagctgaattaaataaaagagattgatcagttagttttgttgatgactggcactaggcactgagcaggcgtggtagcacctcagaacccccagtgtagatgggatgggcctgtattctttctgggtttgtactctgtctctaatgaaggcaccctgtctctctacatagcacacatttgaagaagcagagaagggatttgatgagaccttggccaaagagaagggcatgaatcgggatgatcggatccatggagccttgttgatccttaacgagctggtccgaatcagcagcatggagggagaggtgagaagccacggcagaggggagtccaggctccccgtgtaccattctgtgagcgaggcaaggcgagatccatgtcctcatggagctgacattttgtggcaggaaacataataaataagtaaataagataatttcagatagcagcaagttctatgaagaaagtcaaaccagaatagaatagagagtgatggggagggggtgagtggagggtcaaggaaggccctccctgaggtggtgttatttgacgggggtccacatgacacgaaggagctaccttgcagcaggccgggggactgtgttccaggctgaggctttgaggtggaagagtgtgagacattgatgaaacagaagaaagggaagtatggctggtgtaccgggagcaagggagagggaaggaggggccaaattaataggcccacggttcacagtaaacacgagctttcacaggggtaaacattggaagtatgcacacaggcgaataatgtgatgtcatgcgtttctaacaatcactgactgcttataggaaaaaatgtggggaaaggcaggaatgaaagcagggagaccaattaggagatgtgttggcttgagaaggtggatttaaaagtgcatggattttattagggaaacagccttcaagagaatatggggagggagctgggagaagcatcggaccacaatgcacatctgaccctgagtaagcaagagggtaaaattcggatagaagtgttctagcctactctgcagggccaccgcggggtcctcaagccaaagttggctgtcagagaggtctgtgtctcccaagagcaggatagccttagcatccctactgtgttctgtcattggctgggagcaatgggtgacgttggcacaaacttagtgatgggtttcagagcagcagctggggcccttggttatgcgccttgtagttggaggttgcattctcacggctgccagacgaagctattacggtagtctgggtgagtgacagtggtggctttgactaggagtggtggcacagatactgagaagtagttgattcaggatatatttgggaggtaaagctccatctgtgagactggctgtagaaaatgagctgtgaaattttaccccggggattcctgcttataatagacacagtgcttgttagataatagccatgcccagatgtgggagcagcgcatgcagcagtgtgcagaagcaggaggagtctggcttcagatccccaccgctctgatgactgtgcgactcaggcaagttacctgtttagcctcatttttctccctttggacaggggctcttacctacctcattgggctcttgtgcggtttctatatgatgttggctctctatatccatgagttctacatctggattcaactagtcatggttcacaaatacccagggctgggtgcagtggcccacacctgcaatttcagcactttgggaggctgaagtgggaagatcacttgatcccaggagttcgtgaccagcctgggcaaaagacggtgagaccgtgtctctacaaaaaaatttttttaactttttaaaaagaaaaaaaaaatcaaggaaaaaacaaacaatttaaagataatacaaatttttaaaaatacagtgcaacaaatatttacatagcatttactttgtataaggtgttataactaacatagagatgatttaaagtatgtgggaagctatacataggttatatgcaaatactatgctactttatcggagggacttgagcatctgcagattttggtatcgcagtgggtcatggaaccaacccccatggatactaaggggatgactatgtgtgtgaagtgtccagcacagcacctaatacatagtgggcattctataaatggtaaccttcagattttacctcctgagtttaacataatgttttccactgtaatctaggcacctctgagatctttgtttcctcccattaaaacaggacagtatcacctagctcatagagtggttgtcagatttcattgaaatagttcttgtgcaggtggtttgtaaattataagaaactatccaaggctgggcatggtggctcatgcctgtaatccaatccaagcattctgggagaccgaggtgggagtttgagctcaggagtttgagaccagcctgggcaacataatgagaccttgtcactaaaaaaaaaaaaaaaaaaagaaactatctaaatataaggtattaaaatttcataatttgttcattcattcaacacatattaattgagcacctagtatatgccagctacactgtgtcctaagagctagaataatccagcagtgaacaaaatagattccattcttataagggaagatagataatatacaagtaaaaacctattatatatcatatggttataagagctatggagaaaagtagggcaaggaaggggaatagagtatgctcacctggattaaggattacattttaaaacacggtgctatttgagcacagccatgaaggaggttagaaaaaagccctacaggtatctggggaagagcattctaggcagtggtccctgaggcaggagcgtgctggtgtattagaggagcagcaaatactgcagtagcagctcccctaccatggctgagcagagtgagcaggagaagtgtgtggggatatggggtcagaggaacacctaagggaaggagggggcatatcacatagggcctttgtgtgggaagcgggaagctataagtgggctttgagcagtggagtgacatttaactcatatttcaaaaggatcactcttgccattgtgttgagaatggattgttagagggtcaaggactaaagccaggaatccagttaggagggaattgccatggtcttagtgggggatatttgtggctcagaccacagtgggagctatggagttgcaagaagcaactggattctgaatttgggatttgctgatggtttggaggtagatggagagaaagaagtgtcaaggtgtttggcctgagtattaggaggatgaagttgccattcactgcagtgggaagactgaaatgggagcagcaggcttgcgggagaagactgggaatttggttttgaacctgttaacttagagacctgttgggcacctgagtgaggatactgaatagttctggggagagagctgggcaagggggatggatttgggcattgtcagcgtatagatgttatttcatcatgagactgggtgagaagcacagggaactagtacagttggagaagagatggagtctgcaaacctgaggtcaggagatgaagaggaccaaggcagatggggaaggaacagccagggagggaggaggagagccaggagagtttagagtctgagaagccaggtgaagaaagggcgtcaaggaggtggaagtatcagttggatgaaatgctgcagataagtcaaataagatgaggactaagaattgaccattggatttagcagcttaagactcactggttgaggggcgcctctgcccggccgcccctactgggaagtgaggagcccctctgcccggccagccgccccatctgggagggaggtgggggggtcagccccctgcccggccagccgccccgtccgggagggaggtggggggtcagccccccgcccggccagccgccccgtccgggagggaggtcggggggtcagccccccgcccggccagccgccctgtccgggaggtgaggggcgcctctgcccggccgcccctactgggaagtgaggagcccctctgcccggccagccgccccgtccgggagggaggtgtgggggtcagccccccgcccggccagccaccccgtccgggaggtgaggggcgcctctgcccggccgcccctgctgggaagtgaggagcccctctgcccggccaccaccccgtctgggaggtgtgcccagcggctcattgagaacgggccatgatgacagtggcggttttgtggaatagaaagggggcaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcattaagagtcatcaccactccctaatctcaagtacccagggacacaaacactgcggaaggccgcagggtcctctgcctaggaaaaccagagacctttgttcacttgtttatctgctgaccttccctccactattgtcccatgaccctgccaaatccccctctgcgagaaacacccaagaatgatcaataaaaaataaataaataaataaataaataaagatggagtgttttagtttcaaaaaaaaaaagactcactggtgactttgacgagaggacaagattttctgaaaagtgaaaatatgtgtgtcaagaaaagtttagaagtttggaaaacttgtatctccttctcaatttggagtcttggaggatgagtagtccccaacccccctcccctggcccccaaaaccaaggcttgctctgctgcccaggctggagtacagttggtgtgatctcggctcactgcaacctccgcctcctgggttcaagcaattctcctgcctcagcctcccgagtagctgggagtacaggcatgtgccaccacacccagctaatttttgtatttttagtagaaacgggttttcaccatgttggtcagactggtctcgaactcctgacctcatgatctgcccacctaggcctcccaaagtgctgggattacaggcgtgagcccttgcgcctgactcaggatgagtgattaagcagcccattgtaaaggtaatagacatgagttctcagtcagcttattccatactacctgtggaatcctaggattctgagaaaattatttggttaagtttttgttttttgtttttttgagacagatttccctcttgtcgcccaggctagagtgcagtggtgcaatcttggctcactgcaacctctgcctgctgggttcaagtgattctcctgcctcagcccccgagtagccaggactacaggtgcccaccaccacgcccagctaattttttgtatttttaatagggacggggtttcaccatgttggccaggctgggcttgaactcctgacctcaggtgatctgcccaccttggcctcccaaagtaccggaattacaggcatgagccaccacgcctggcctgcataagtttttacctgggtttctagggagaagaaagagatcagacagtccttaacaggatgctggcaggggagctcccatcacctttgcaagcctcattgcagtggcctaggtcagtagtcacagcagtatgcaagtcagcccttccaaaccaagtgaggagtcctgggaggtgagaacccttggcaaggcagccctctgctgctgctttattgttcaataggtggtgctcttctgcctaacttagaacaaaatcaggtcccttgcaaggttctggggaaattgtaaccctaaacatgaagagtggccacccttcactttggaagtagttgcgtttcgggattaggcaaatgtaattgtctgtagaatccacagtgcccagtttgaatgccagtcataagtaaagatgatttttttcctcctcatatatatagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtaagtggtgagaggccctttccctcttttcctaagctccacacctcacttttcccctgccaaccctttatccttcctctctcaggtgtgccagtgggtgctgaaatgcaggaatagcaagaactcgctgatccaaatgacaatccttaatttgttgccccgcttggctgcattccgaccttctgccttcacaggtgaggatgtccatggaagacatcattacccatctcagggtaaacagggaacaggtgattccagaaaagccaaatatcttttcctttgaagcaacgccaacaaatctctgatttctttgtctcatgtccaatttcaatgctatttagttcaggttttctaatgtcagaggcagcagacacaggaacaatcagaacagagaggcaattctatggccaagcaaattttcatgtatggatgccaacaagttcacaagtagacttaaaagagaccaaaggaagggcagttttgatgtagctactgtgcagcatctacgtcaaagctttgtgagtcagggagggtttggggatcgtcctgcttctgtccctgaggtggtcaccaagctgcctcaccacttgcaggcagcatcaatccttggctcctgaagctggcccaactcagagtccaacttctcaacgaagccttcctagattgctccagctgtaaatgtccttgccttcttccatcatagccctcagctgtggaaaggtttggcatcagacctgagatgaaccccacctccgcccttaaccatgaggttttggacagattatttgacctacctgggcctcagcttcctgacttgtaaaatcagaataacaatctctgcctcccaagatgagcagcattaatgtctcagcatctactatagtgcctggcacagagccctaataagtggaaaccattatatattattacagcctcctcaagctacttcaaatatgttttggaaatagggtagaggtaaaatttataatgctctagttgcctgttcatacttaatgtccttgtcttacctctctacttgctgagtgtaggcacccagtcttgaacatctcttcccactttaccgtggtgctcattgcctgtgcttagtgaagcattcaggacccattgagagccaggaacataagcaaaaggccagcctggccctcagcagaccctattccctagcacacagactcacttcacgccacccagcccagacaaaccacaggagaaatgtagctggtcaggtgttaaacacgctgttcgaaagaagtagaacgtgttgggtgaggacatgacaattcgccacataaaaccactgaaccagagagaaataacagaaggaaaatcacccgtattttgttagtttctattgttctggcctggcacccagcagcttttctcttttttaatgaccagacaggctgctgttcagtagagctttaaatgatcttggattgaaagtctgtggttcaaaaggaactaataactaggccaaatttgatcaaagtctggcacattacccttgtaagttacccttgtaagttcagaaggctgcctagcagcaggatacaaaggctcagagggccctagatttgttcttttgatgtgggtgtttgttattgttgttgctctcttttttaaggttagtcaaggttgttttattaaatatgctaaaatatgccagtgacattcagcctgggcacaccgtataagtatttgcttcattgcataagtactatttgtttaaagcttgcagtttggaagttattgcttaaacttctcaatgttataagctttagaaatataaaaaaatactccaagactgaactagaatctctacagtcagatttctaatctcaggatgctaaatccaggaaagaaaattatactctcttggggttttttttgagacagggtcttgctgtgtcacccaggctgaagtgcagtaatgcgatctcagctcgctgcagccatgacctactgagctcaagcgatcctctcacctcagcctcccaagtaggtaggaccacaggcatgagtctccactcctggctaattttttaaatttattttttgtagagatgatttgggatctcactgtgttgcccaggctggtcttgaactcctgggctcaagcaattctcctgccttggcctcccaaagtgcttgggattacagacatgagctgtggcgccttgccaggaaattatactcttgattttaccccgtttcctgccgaaatgctatccccttagtttttcttgttgacccactctaattttagggttgtatctccttggtcacctgtcttcaagccccagcatgcctcattgtcatttgaccacaagagccatgggagaaaacatttctcagagtaaatgcagtcatagcatgtgctattttagaagtctaattcattgtctaaatgtggttctggtagctttcagtatccctaacttcctaagggatgtgtggttttcccttctctcctattttatgtgtactactggtgcctggacttgggaccaacatcaatggaagagaagaaataaatagacaagaagcaagaatcaggaaattccagccttcagaggagaaataacactttagcttggattgtatgagaatcgcctacccatgcacactggcttatgtgaacctaatgaaaatatacatgtggctttccaaattatagactaaatcttcttctattaaatataactgtcataaaaatctctaggtaatagcaaaatgatttccaggcctatgctgaatggaatggcctgtttattgcaaacagtgctcagtattacagtcatatattgcttaacgatggggatacattctgagaaatgcgtcttaggagaatttgtccttgtgtgaacatcatagaatgtatttacataaacccagatggtatagcctactctacacctagctctgtggtgtagcctattgctcctgggctacaacttgtacagcatgttactgtaatgaatattctaggcaactgtaaaacagtggtaaatgtttgtgtatctaaacatagacatagaaaagatatgtaaaaatatactgtattataatcttatgggaccaccatcatatacatggtccattgttaacccaaacgttgttaagtggcacacgactgtactgtttttttgtttgtttgtttgtttttctgagacagagtcttgctctgttgcccaggctggagtgcagtggcacgatcttggctcactgcaacctctgcctcccgggttcaagtgattctcctgcgtcagccttccgagtagctgggattacaggcgcactaccatgcctggctaattttttgtatttcagtagagacggggtttcatcatgttgtgcaggctggtctcaaactcctgagctcaggcagtccacccgccttggcctcccaaagtgttgggattacaggcgtgagccaccgcgcccgaccctgtactggttttttattagtttgagatggggtcttttttttttttttttttttaaatgagatgtagttttgctcttgttgcccaggctggagtggaatggcgtgatctcggctcaccgcaacctccgcctcccgggttcaagcgattctcctgcctcagtctcctgagtagctaggattacaggcatgcacccttatgtccggctaattttgtatttttagtagagatggggtttctttatgttggttaggctggtttcaaactcctgacctcaggtgatcctcctgccttggtgtcccaaagtgctgggattacaggcatgagccactgcatctgagacagggtcttattctgttgcccaggctggagtgcatggctcttggctcagtgcggcctcaaactcctggactcaagtgatgttcctcagcctcccaaagtgctgggattacatgtgtgagacactgcacccggcccatgactgtacttcaaatttcattataatgtaaaattgtttagatgatcttctgtttttaaacaaggtttgacatatatttcttcagcaagagcatgtaattcttgtgtgaaaatgtaacagtaatggagacaattctgtgatattgttttggcaaccttttacgttttttgggtttttttttttttttgagacaggctctttgtcactcaggcttgagtgcagtgctgcacacgatcacacctttctgcagcctcaaccatctgggctcaagtgatcctcctgcctcagcctcccgagtagctgggattacaggcatgcaccaccacacctggctaatttttatttttgtagagacagggtctcactgtgttgcccaggctgtttcgaactcctggcctcaaacactcctctctccttggcctcccaaagtgttgggattacaggtgtgagccactgtgcctggccactttcttaatttattcttaaactgaattgctttataggacctttgactgttgatatgtagaccctaaccctgacctggagctatctactttgtcttttctgtgctcagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagtaagcacctctgttatgatttcaccttccactccatttggttggagaggaaggacgctctatttcagatccacggagcttacgcccattttttgcatcattaaactccagggtatagcaaatcatatgaagaacagcccttccttagttgaattctaagcttttccaaatgaaataacatatatgaaatatttggggaggttgaataccctgagaacatgtgagatgccaatgctattttcagtgttattatttactgggaatctgctagttttgcttttttctctggcttttaaaagtcttattttgatataagacctaaagagaggaatccttgactggaactgaagggacctaagggtcatctttttcctcatcgctgaagttgaataagttattccacctctttaaacctcctggcgaataaaatatgagaaaacccctcagcatcctgccagatggagagactggggtgtcttcgctaaggcgagggggtcagtgttcatcatcctttgtctcaggttgtctttatacttccctgtttattagcgaagattgctgtggtgaattaatacgccccactcattcttttttttttttttttttttttttttgagatggagtcttactttggttgcccaggccggagtgcagtggcacggtcttgggtcactgcaacctcctcctctcaggttcaagcgattctcctgcctcagcctcctgagtagctgggattacaggcatgtgccactatgccaagctaataattgtatttttttgtagacacaggttttcaccattttggccgggctggtctcgaactcctggcctcaagtgatccacccaccttagcctcccaagtagctgggactacaggcgtgtgccagcacgcccagctaatttttgtatttttagtagaggcggggtttcaccatgttggccaggctggtctcgaactcctgacctcaggtgatccacccacctccgcctcccagagtgctgggattacaggcgtgagtcgctgcgcctggccccattctaaagcccagcattctcatcatagaagaatttctttccatatgatggctgtgtactgccttcttgtctctgatgaacacattgttcagctctcttcctacataattatcttggtgagcaccacaataacccatatggtatagctgtgtgaattcagaaaaaaggccccttccttaagacactttactgccatctgctggattgttgtagaaatgtacaaatctacagtaattgtgatgtgatgggtccctttgaactgtgctctggacaatttgcatacccatctgtggtagccctgcctgagtaacctgctctccttgccccaaggtgattttgaggtgggacattaaagaatgtcattatgtctcaactagccactctccatttctctacaggaggcagaaggcaatgcaggtggacgccacagtcttcacttgcatcagcatgctggctcgagcaatggggccaggcatccagcaggatatcaaggagctgctggagcccatgctggcagtgggactaaggtgggtgtcagaaacctgagcttgccctgtatcagcgtgaggcttggcccccagtgttgggactgttaaaagaatgaggcatggttgtttgcacattcaactggatggacaggatagcttagactaaacacacaggctagtactgaatcctagtttcatcactagctttctatatgatcttgactaagttatttaatttccccgagcctcatttttttttttttttttttttgagaaggggtctcgctctgtcgcccaggctggagtgcagtggcccagtcttggctcactgcaagctccgcctcccgggttcacgccattctcctgcctcagcctcctgagtagctgggactacaggcgcctgccaccacgcctggctaattctttgtatttttagtagagttggggtttcagtgtgttagccaggatggtctcgatctcctgaccttgtgatccgcccacctcggctcccaaagtgctgagattacaggtgtgagccaccgcgcctggcctcattttttttttttaatctgaaaagtgggtgcagtagtaattcttattgcctagggttgctgtgggttcatggtatagtcactcttagcaccatgcctggcatataggaagtactcaataaatatttgcaaatattgtgtatattattattgagcaagttgcttaagcttcctaaactaagttctcttcatctgtaaaataaggacagtgttcttaatctgcttcccagagtgtttgttgagacttggtcttctgtagtggctgaattatagtgagcaagtcttctgtggcaagaaccagaaactcatagattgtttggagacctgagactaagccaagagagtttacacttttattcttattttataatatcctttctactctgaagaacagaggcctgatccccttgctgggagagaaagctgtttcttcccaagaacagactgagtgtcatgtgcccagcccttatgtgacttgtttccttcccctcagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggtaagaaattacaacggctcttgccaagatagtgagagatgctggaaactttgggaaaggaatgaaggtatctaggattcctggatcttgctggggtgctaaagacagggtagctgattctgtagcagctcatccttcctagactctttccacgtattggtaattcctacttttgtttctttgtcccatactgagtttgggggcaaatggtttgagggaaagtatacgttgatccaaggaaataatgcttcagagacagatccccctcacatcctcacttttccacttctttgtagctgagatggtatgtaatgctttaaaatgtataagtaggggcttttgggtgtttccatgtctatggcagtatgatttcttttttctttcttttttttttttttttgagacaaagtctctctgttgcccaggctgatgtgcagtggcacaatctcagctcactgcaacctctgcctcctgggttcaagcgattctcctgccacagcctcccgagtagctgggactataggcgcgtgtcaccacacccggctaatttttgtatttttggtagagatggggtttcaccatgttggccaggttggtctggaactcctgacctcaagtgatctgcctgcctcgacctcccaaagtgctgggattatatccatgagccactgtgcccggctggcggtatgatttctaaaagtaccatactgtgtagttctaaactgcaaataaacccataataataccccacagagatatatttcagggggagaagttgatacttttgaaatttaagatcatataggtagtattggtcaagaatgtggggaaacaagcaagtacagaaagcctgaacatgctgtctggagacagccacccatggtttctctattgcagttcctccacttaacattgattcacacccatgataatttatttctagtgaatagaaagtagctatgtttaaacccagcctacacagactctttgtctggtatttaaatccgggaactaaaagaggcaaggtaaatttgatcaagaattgtattatcctctgagaatgtaaggggttgagttggaataaaacaaaataatttattatttaaagggaatataaaaaggctaggattgggggataccttttatctgtctctttgctccttcaccacccccttttacctttctgctgattgaaatcccccttgttaccctttaaaagttctgggtcaggcctggcgcggtggcttacgcctataatcccagcactttgggaggccgaggcgggcggatcacaaggtcaggagatcgagaccatcctagctaacatggtgaaacgctgtctctaataaaaataccaaaaaaaaaaaaaaaaattagccaggcgtggtggtaggcacctgtagtcccagctactcaggaggctgaggcaggagaatggtgtgaacccgggaggcggagcctgcagtgagtggagattgcgccactgcactccagcctgggcgacagagcaagactccgtctcaaaaaaaaaaaaaaagaagagttccgggtcagtatcgtattgatcaatgtctagttgaaagtagaattagtagcctcaaaatggaaaattcagctagcaagctgcagacctacctgtctacagcagcagtgtttattctgttttctctctgcctttctatccaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctggtaaggcttgccagacagaaggaatctaggggagttaaggagcttaggacaattgggagtagccagtttcattacatggcctctctagagttcttcggctcaaaaagctgatattcagctatttctctgccaaggcgtgttaggcatggctactgtagcctttggtgtaagataatctacctttaattcttttgtcttttactcttgtgagtagagaaaagaatgacagaggttagatgagaaaaagcatctggaatcttcccactacgctgatggcagtggaggtagaagctgggaagggctggagtgatgggatcatgaggaaatgttcaaaggctccattgctcttgcagaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccaggtaaccgaggtgatggccagacccacaggcagggaagacaggactctcgctgtgagaactgcttgaggaagcggagttgaggacaaggatgggggagaaagattgaggtacctggtaaaagccgcatttgtctgcaaaggtccaaatgtttccctggctttataatggcagttccagtgctcatcacctcatgagccctttgtcaatatgactctaaggtggttcagagtcctctcatgcagctctttctttttcctggcaagtcaccagtgatcccatttcttggccctctttgcttgctgggttgatctgctgcagatggtgtcagacttcccagcgcctccctatccttcagctctcctgcttttcttgctggtgccaggtcaagcacggaggccgttgttcttcacaaaaataaccagtgtgagaccgtttccactatttgttctaatagtcattgctccagtctgtgatcctggctttcgttcttaaataatatgagaatgccaagctcagctgcttggtctgtagcgtaaggtagaattgctctggagacatggctcctcagtttttgtcttcacctactgagtaagatctgtggcctcctggtgagcaatacatggagtcctgccaatacaccagtcctgcctggtgaagttatttccacctgcctcttgtgggtctctatgttgctcacccagtcatttcctgtccccattgctcactgtttgcttcctgatcctccttcatggtttgttttgaagtaaacactttttataacatataaggaacttaaacatagaaaatcattaatatatgtaactcactctagagaaatgtttgttcacaatttgttataaagtggctgtaaattatatcatcagtcaacaaattaggaagttgtacttatgttggcacttctatttttagcgtaatgatttatttaactgccggcctgcgttagaagtgcctgccattttaagtcttaaaaacattcctcagttataggaaggaatagaaatcattgttgaaggccgggcgtggtggctcatgcctgtaatcccagcactttgggaggccgaggtggccagatcacctggggtcaggagttcaagaccagcctggccaacatggtgaaaccccatctctactaaaaataaaaaaaaaatagccaggcatgttggcaggcgtctgtaataccagctactctggaggctggtgcagggagaattgcttgaacccaggaggtgaaggttgcagtgagccgagagcgcgccactgcactccagcctggcgacagagcgagactctgtctcaaaaaaaaaaaaaaaaacgtgaaatcactgttgagcctgccagctcaaatcatgctaaattaatttggcgtagaaatatctcctaaacggctgagtgcagtgtctcatgtctgttatcccagcacattgggaggccaaggcaggcggatcacaggagcccaagagtttgacaagaccagcctggggaacatgacaaaccacgtctctacaaaatatacgaaagttagctgggtgtagtggtgcatacctgtagtcctagctactcaggaggctgaggtgggaggatcacttgagcctggtaagttgtggatgcagtgagccgtgattgtgccactgcactccagcctgggtgacagagtgagaccctatctcaaaaaaaaaaaaaaaaaggaaaaaataagaaatacctcctaatgagaatatcaatatgttcattctgtcagcagactttttgaccacatgctatgttccaggtactgctgggcactgggaatatagcagtcaacaagccaggcgtggctgcaatcttctttcttttttttttttgagacacagtctcgctctgtcgccaggctggagtgcagtagtgtgatcttggctcactgcaacctccacctcccaggttcaagcgattctcctgccttggcctcctgagtagctgggactacaggcgcccgccaccacgcccagctaatttttgtatttttagtagagacggagtttctccatgttggccaggctggtctcaatctcttgacctcatggtctgcccgcttcggcctcccaaagtgctgggattacaggtgtgagccacctcgcccggctggctctaatcttcttaaagctgatattaagctatcaggccatttcattttttcaatattgcagagtgtgaagctcctttgaatgaatttatgtactgaatttagcccttgaaatgttaaaattactcttttttgtttttaaactttgatatagatttttccaaattgaggtgtacattttcatgccttggtaaaggctttggtgttttgttttgttttgagacagaatctcactctgtcaccaaggttagagtgcaatggtgggatctcgtctcactgcaacctctgcctcttgggctcgagcagtccacctgcctcagcctcctaaagtgctgggattacaggcatgagccaccgtgcctggccgactttggcctttcttgcggtcttggtcatcagggtgggcattggttattgttattaggatgcagtgaggctctcgggctctaagtgaacctggggttctttggattggccccgcactgctgcagatagttgggctctgctccgtgaggcacatttccttgcagtcagccatgtcttcttggtgctgcaggtctattctcagtatccccttcatttcttttccctgtggtctgctatgactggggaaaacaggctgccaggggaatccagaaaaatcgggttattaagtcagtaacctaagacaaaatgtaatgttaaattgtagactcctctgggtagctgagttaacctgagctctgtgacatctgcttttgtcactgctcatcgatttccttctggcagctttatccagaaatctgtctatattatgctgtctatgtcaccatgagcatgatatgctgatttgctggtgtcctaaggatgtcagctagaaccaatgtgttatctccagtcagtaaggcttcgggggatcctgccagtgtgatccccacctattgaggtttatctagatatgccccaaacagctacagagtatcagcacttctcttggcatcatagctgttctaactgttctttgattcctttgccattatttgtagtcttcagtaatttgctgtctggacaaagatttttctcccaaggggccctaccttctttcctcatttttatagaaccctactcacagctctccctgttggttttctcagtcttctctggctgtgctacatggttaaaagctctgctttagagagggccatgggacattggagtgctgtgataaaaggaaagggagcaggttttcgaatagtttttcttcctgtcacagctgtatctaaggctgttctgcctgttgcagaaatgtctgttgctcattgagtatctagcagctacttcatctgtcgtggaggtctgggtttttcccccagttccctgccactttttctgttggacacagtctctctctagaatgtcttctgccatagagaacatatgagcctttcttccctacagattttgacagagttggagcacagtgggattggaagaatcaaagagcagagtgcccgcatgctggggcacctggtctccaatgccccccgactcatccgcccctacatggagcctattctgaaggtaacacaaaccgagaggctggtgctttctctgtgcgttgtcatcagctcatatggggagatgggagtgtttcagtgttcactagtacactgaacaaagtaggtgatttctttgctctcacgcttggagaccaaagggccatatcaagcactttcagttaaagaataccaagaatcttatcagttgcaggaaagtgctgtccttacaagaggtaagagttaatgcttcaggcacatcatcacagatgtttggaaaggagaagtaggtagatagtagcataaaatagctcgcccaaaatgaggaaaaaatgagcttgaaaatctgaaacaaccttcaaatctcaacacattagagtcacgtgaagtcctttataatgtatgttaatctggatgaacaatcactgagacgcggtttagaggagacatgagaaatactttcacattatggtgcttcccagctctctcacatgtcagacttagacttcatatggagaaaagtttgagaatttacattccagagaaatcttggattcataaagcctagaaggaatttctttatgactgagatggtctcttgggtgaattttacttatataaaagaaaggtttctagtagagtctaatctgcattcattttctcataacttctttctctaggcattaattttgaaactgaaagatccagaccctgatccaaacccaggtgtgatcaataatgtcctggcaacaataggagaattggcacaggtaaaggggcagctactttttccatagcggagatagggtggaaaagaaactaacctctaaggaagtcaaaatactatttttttttttaaatgaaaggtctcacatatttattgcggaacccagccaacaatgcattcataacagattcagagagaaataatatattctcaataaaacatgtccaactctccagatagtggtgacattttcagcttgatatggtaatatcattgtgaccttcagacagcataaatatgtgtgccatctcatgtgcaattccttatagaccctgcttggttcttctccaatgtctttttttggagttgtacctggttttattaccagttttcatccgaatccactggggaatgggacgattttacttttgtttcttggccaggaattgcttaattctgaaagtcttgtgagaagaatggcaagaatcagagtcaggcacacaccatgatggtggagaaaggaagagagggcttttttaaaaaaatttttttattttatttatttgtttttgagacagtttcactttgtccaggctggagtgcagtggtgtgatctcggctcactgcaacctccatctcctgggttcaagtgattctcgtgcctcaccctcccaagtagccgggattacaggtgtgtgccaccacacctggctaattcttgtatttttagtagagatggggtttcaccatgttggctaggctggtctggagctcctgatgccaggtgatctgccctcctcagcctcccaaagtgctgggattacaggcatgtgccaccgtgcccggcctccaaaatactttctaatgccagaatttctaaccctttctgccaccctctttttcattttgcaggttagtggcctggaaatgaggaaatgggttgatgaactttttattatcatcatggacatgctccaggattcctctttgttggccaaaaggcaggtgagtattactgcttcctgattgagcaagacagaccccatgagtccagggactttgcttctctttattcaccttagtgtcctcacccagtgcctagaacagagtgtgacacatagtaggtgctcaaaaatatttgttgaatgagtaaaagttagaaagatttgaaaccagaattacctgttgtcctgacccagagtcagtttcagtaattatcggggctgactagtgccattttgtctatacaaaagaaaatgcaggtcaattgtcagagccgtagctctcagagggaaaaagaaagccttggccactgcctatgaaggaacagaagtttagctcatccttgcccagccctggttctgctttcccaatttgaggctattagatgactagactaaaattaagaacagtcttaatttatttctgggcatggcagctcacacttgtaatcctagcactttgggaggctgaggcaggaagattgcttgagctccagagcgagagcaacctgggcatgatgagactttgtctctactaaaaaaaaaaaatagctgggcatggtggcatgtgcctgtagtcccagctacttggaggctaagatgggaagatcactcgattccaggagattaaggctgcagtgaactgttatcacaccactgcattccagtctccagtgagaccctgtctcaacaacaacaaaaaatcttaatttccttttgaatctcctgttaatcatttgggatatggaagaatgatgtgttttctttgagaaaggtgggaattttctttgtctcttgatccagtgattgttgcagggttgtgtgcttgatcaaccttggttttatgcccttttgggatttctgctcatggttagtgtctttactggaaacctcttttcttcttacagcctctaacacttcattataatcattatacaaagagttcaactatgctttcttttctctcgtactggctcattgaatcgtgttcttgtgcctatccaggtggctctgtggaccctgggacagttggtggccagcactggctatgtagtagagccctacaggaagtaccctactttgcttgaggtgctactgaattttctgaagactgagcagaaccagggtacacgcagagaggtaggggacgtggcaaacttggtctttaaagactttgctgggacgatggcaagagagagatggttgcagcattaacatgctctgacagtgtcagtcagacttcctgtccctctccaattttgttcatgtagctggtcatttggatatgaactggggattatgtaacctgagaggagtatccgtgatacttgttgtaatcatgttgtgatgaatgttttcttttttccctcccctttcccacgcaggccatccgtgtgttagggcttttaggggctttggatccttacaagcacaaagtgaacattggcatgatagaccagtcccgggatgcctctgctgtcagcctgtcagaatccaagtcaagtcaggattcctgtaagttgggggtagccatgaaagacttgccaagttctcactcacagagcccttgctggttgtgtttagaaagtctggagctggattactgagaaattataggatattggctcgtgtagcaacttttgaatgaaaagtcagtagtttcttcttgaatcccggaagggttgctgcttcccattgtggccagagtcctcatgtctgtctagattctttgtcaagggttggcatgccaagtctgtctgctttttgatgccaatgcaagagatacacattatcaccccatcacctctatctatctctcattctttcttagtgcctctttgatggttctcattcccatggtatctacagaagaagaggatagaattgattcttcctgttttaattgatagggaaatcagaggcgaggctcagggccatagggaaaactagcagcaatcagaaatttggggctcttttttccgtgaaatggtctggcccaagagctgcactgcctttttttgtttgtttgtttttgagatggagagtcttactctgttgcccaggctggaatacagcactgcaacctctgcctcccgagttcaagcaattcttctgtctcagcctcccaggtaactgggactacaggtgcacaccaccacacctggctaatttttgcatttttagtagggaggggttttgccatgttggcctggctgttctcaaactcctgacctcaagtgatctgcctgcttcagcttcccaaaatgctgggattacaggcatgagccactgtgcctggacgcctttttttttttttaaaggtttgttttatttttaattgactcagggagggggaatagggagaggttggtgaatgagtgcaaggttccagttagacaggtggaataatttctggtggtctgttgcccattgccttttattgtttttattttaacttaattttatttttttggagacagggtctcactttgtcacccaggctgaagtacagtggcatgatgtagcctcgacctcctgggctcaagtgatcctcctgcttcagcccctcaagtagctgggactacaggcgtgtgccaccacacctcgatactttttgtatagcccgttgccttttgacaagtagcctgagtgaatgggggtggggtatggggttgcaggagggttttctagacttaacccatattccctcagggcaggcctatttctgacattgaaagttaacattgattctcccaactattccaggaaaatattattaccccaaaataaattgtttctgaactttctagatgggatcatattgcttcacatttcttcctcttctggtattagagaggcatgcctgtgatgtcattctgtcagccccatagctgttgagagcagggcctgagccatgctgctcctggtgttcttccttattcatggcaccagtcagcccagctcttcatctgtttagttcttaccctcctcgctgcactcttcatgttagtatacctccctcccttgccgctgcccccgctgccaccgtcagagtccttgaggtccttactgttcaagtcaggtaggtagtatttgcctaccaacttgtctgaattccctaggggaaccaaggagctgctgaacagatgtttgcctaatttaattccctttactttattttgggggagtaattatttttattgatggtttcagttatgaagttgtgaacggtaagaagctaaattaaacagagcaatttagagaaaaccaacccatcatgtactgttttaggcttttgtggtttgagtaatagaaaagccaaaaaccgtttacttcttgatggtgagaggctattcattggttcctaatagaccttgaactcccaacagtgttagaacatactaggaagaaagatatgaatgctaatgtctgttaggaggttgtttgttactaaccatgctctgcctgaagtcacgtcatgccatgtgtagctctaacactctctgttgttttgtcctagctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggggccatccgggaagtaagtacctcaaaccccaatccttctctttctcctctgcaccacacatgcacagatccatctgtgcttcagcttcttaattgtgcattctgtgtgcccctgagcctaatgccttcctcccccttaactcccaacatataaagtgtacaatcagctcactccagtgtcctggctaaaagggccaggtgcagtggctcacacctataatcctagcactttgggaggccgaagtgggcagatcacctgaggtcaggagtttgagaccagcctggccaacatggtgaaaccccgtctctactaaaaatacaaaaattagccatgcgtgatggtgcacgcctataatcccagctactcgggaggctaaggcaggagaatcgcttgaacctgggaggtagaggttgcagtgagctgagatcgagccaccgtgcttcagcttggacgacagagtgagactctgtctcaagaaaaagatggctagaagatgaatagcctgggggaggaaaagcattgtcattctcagtaatctagagttcagtccggttgtagatgccccacaaatagaaaatcagtctggatttctggttgctccttcatgacgagatttaagtcgtaacatttttagtgaaaatactacacaggtgaagttgaatgcttcttactggatctcatactgccaccagttggtcccattactgttgatcctcagtgcgagcatgcggccgagtaggtgtttatccgatctctccattgtaagcttatctgttttcctttgccattagtgagtaatctgtggggtgacactttgagactccatggctatcctgttcctcagctaccttccatccggtgattttagcatccgttgataatcctcacttgagttgattatcacactggtggttgcaaagtgatgactttctaattttgctattccttctccattttattagctggcagcatttttctgtgaagaggaattttcccctcccccacctctcactcttgctgtttcttgtgtctttctttaaaccacagaatatgcaaaatggttctaagattatatgtccctactactaccaaccacagatctaagtaaagttcagagtagctttgtagttcctgttattcttagaatacactctactaagggtgtacagtaagagtactatgtttaaaagatacctcaattagttacttttccctctgatcatattgtcaacatgatgtacatttagaggagatagcatgtttttagaaattatgtttcctaactttgtgtctggagtatagacatactgtttatttgtttctattgtatttataactatcaacctaattgaatttttttttttttttttttttgagacaaagtctcactttgttgcccaggctggagtgcagtggtatgatctcagttcattgcagcctctgcctctcaggttcaagcaattctcctgcctcagcctcttgagtagctgggattacaggggtgcaccaccaagcccggctaatttttgtatttttagtagagacagggtttcgccatgtttgccaggctggtcttgagctcctaacctcaggtgatccaactgcctcagcctcccaaagtgctgggattacaggcatgagccaccacgcctggccggaattcttattaactctaataatttacctgtaaattctctcaggtttttactctatataattatatagtctggtgggcgggggcgggggcgggggtggggggaagaaaaattaaaaaaggaagttttgttttttagttttaatcttgtaaaccaccacttagtgacacagtaaggaaaagtaataagtactaaaaaagtcataagacctctactaccatgtttttggtttttgagatagggtctagctctgttgcccaagctggtgacacagaggttgcaataggtgatatgggctcactgcaacctccacctcctgggctcaaataatcctcccacctcagcctcccgagtagctgggactacaggcatttacaaccacacccagctgattttttgggtttcgccatgttgcccaggctggtatcaaactcctgggctcaagctatctgcccaccttggcctcccaaagcactggaattacaggagtgagccactgtacccggcctacttccatgttaattagatgcagtgatagtggaaatctataaccttgctcctgattttaatgggactgctgttaagatttcaccatgaagtataatatttgttgtagctttttggtagatatctttttattttatttttatttttaaaaaaatacggaatgcttcacaaatttgcctgttatccttgcatatgggccatgctaatcttctctagattgttccaatgctagtatacgtgctgccaaaatgagcactagatagctttataaaggtcaaatattctcatataaagagaatactaaagagttttattatgaatgtatattgaattctttagtctgtaatagtcatatggtttttctcttttaatgtgttaaatatgttgagtcacactgataacgtgttctaatgtaagaatgctggcattcttatattaaaaccaccttggttataatgtatttttaaatttcgatcttatgtcagttcagcttagaatttttggatctgtgttcttgattgaattggtctataattttctctttcttaactatgggctcaaagatctgtttagcttttctgtatctccttgaagcagttttggctacttttttttaggaagctgttcattttgtctaagtgataaaacttgttgacatgaaattgttcacactgttctcttacattttaatttttttaagatctttttttatgccccagaactgagtggattatgttttaattttctactagagatttgttaaagcatttttcaaagaagcaactatcggccaggtgcggtggctcatgcctataatcccagcactttgggaggccaaggcgggtggatcatctgaggttcggagttcaactccagcctggccaacatggagaaaccccatctctactaaaaatacaaaaattagccgggcatggtggcacatgcttgtaatcccagctactcaagaggctgaggtgggagaatcgcttgaatctgggaggtggaggttgcagtgagctgagattgtgccattgcactccagcctggatggcagagcaagattctgtctcaaaaaaaaaaaaaaaaagaaccaatttttgacttgttgatctattattattttactttttctgctttttaaaaaaaattgtgttagaatgttaagtcattgtcagtcttcttttctaatgtaatctcttaaggctatgaatttcactccaagtattaactgctttccaaaatttcttaaagcttacataccgtaagatatgtggggggaaaatttaaaataaaaaatttatttatttatttacaagtcagataaaatttacataccgtaaaattcattgatttttaatatatttacagagttatgcagttatcactaataatctaattttagaaaacttaaatcaccccagcaaaaaaacctcctgtccattttcagtcattttctgtttctgcctcatccctgggcaactactaatctgcttctctctctatagatttactttttctgggcatttcatgtaattggtgtcatagaatatgtggtcttttgcatctggcttctttcacttaaaacttttgaggttcatccatgtgtggcatgtatcagtaattcattcttcctttattactcagtagtgatgtagtattttcattattgtccagaaatattttccagtgttagaatttcttcttttacccttgagttatttagaagtgggtattttatttgtaaacttaaagggtttttaatttctcttttttatattgatttctaacttaattgcattgtgtttatgattctttcatgcttgctggaactgctttaatggtctagtggttgattgattttcataaatatttcctatatccttgggaatacttgtgtatttgctaacgttatggacagggttttacataagtcattagattgaatttattacttattgtgttcaaatcttttgtgtccttctaatttttgtttgtttgatctatcaatactgagagaagtgagacaaaaatctccctttacattggtgggcttttttctgatagtttagtcaatcttgttttatgtatctttgagattatattactagatgcatgcaaattttaaatcctgatatcttcctggtaagttgactcttttatcattatgcaataatccttcttatctttaataataccttaaaacgtattttacgtaacattaatatagctgcaccagcttttttttggaggtatatgtcttttccaattcttttacttttaactgtcttgtgactttttgttttggatgctgtcttgtaaatatagctagattatctttttaatccaatttaaaaatgtttgtcttttaaccagtgcattctaggccaattgcatttattgtgattgctgttatatttggcctatttattttattttattttattttattttattttattttattttattttgagacggagtatcgctcttgttgccagggtggagtgcaatggtgtgatctcggctcactgcaacctctgcctcttgggttcaagtgattctcctgcctcaccctcccaggtagctgggattataggtgcatgctaccatgcccagctaattttgtatttttagtagagataggatttcaccatattggccaggctggtctcaaactcctgaccacaagtgatccacccgtctcggcctcccaaagtgctgggattacaggtgtgaaccactgcacctggccatgtttgcgtttatttccaccatcttacttagtgcattctttttgtcctgctttgtctgtttatctttcttttttgtctttttctggatttgtttgagcctttattttttatttcatcttttgccttcactcattggccacctttaatttttcttaacattttgtaatagactatttcaatcatgaatatagtagacaacctattatattagattctcacatacccatcagtaattactagcattttgtcaatttggttttatctcttacctccatcgcctttccccccgacacatgtacatacatttctgcagtattttaaagcaaattacaggtatcatattatttcaccaatacatactttttcccatgtaaccacaaatatgacacctacaaagctaacaatcatttcttagtattatttaataccaacccttcttcagatgtccctgattgtcttaaaaattcattgtaatttggtttattcaaataaaaatctatataaggtctacatctggcatttggttgatgtatataattctttcactacttatttaccttttccctctacttaaaaaaaaaaaaaaagtcatgtatttgtagaagaaaccaggtcatttgtcctgtttctcatactggatttggctgattgtatcttcgaagtgtcttaatttcctataaactagttagatttagaggcttgattagattcaggttctgttcttttgacaagagatacttcatagattacagtactgtatacctcctatttcaacatttagtaaacagatattttccatatgacccactgctagtgatgtaaaggctgatcagtgggttcggatattgtcatctgatccatctgttataaagttccctatcagcctttttcccagtcattttagcattcattggtagttatttcctagagctgttatttgattagggactgcaaaatggtgattttcttacttatatatatattttttttattaaaaaaaatgtttttttccatgacatatctctcaggagctcctgagaacatgtgccccaaaatggtgattttctaatttgattattccttctggatttattagctagaaagttctttagaaataaagaacttggctgggcatggtggctgtaatatcagcactttgggaggctgagttgagaggattgcttgagcccaggaggagtgtaagaccaacctgggcagcatagcaaaaccccatctcattttatttaaaacatttttttaggctgggcgcagtggcccacgcctgtaatcccagcactttgggaggccgaggcgggtggatcacaaggtcaggagatcaagaccatcctggctaacacgatgaaaccctgtctctactaaaaatacaaaaaaattagccaggcatggtggcaggcacctgtagtcccagctacgtgggaggctgagacaggagaatggcatgaacccgggaggtagagcttgcagtgagccgagattgggccactgcactccagcctgggtgacagagcgagactccgtctcaaaaaaaaaaaaaattttttttaaataaattttaaaaaagaactttatataatcaactactgaggtaatttgaagtgtagatcatgtaggaaaagcagaatacatgcatgaatctttccctttatttatcaatttatcaattttttagtataatgagtcaagcctctaacagcttttcagaggtgagccaggcaccttcccacctcccaatcctaccctcattctttggagtatcagtatgaactcatgaagatacatatatatatataatttatctttatttatactgtaaaccaagttggttgcacagtcactcaaagaagactgtcaagtgaaagtcatttagtcatcttattgttaatactaatattggtcatttactttactacttgtgtgtttaagaaagatacatatatatatgtaatctcactaaaagaaacagagctctctatatagagtatttctatatatatagaatatatatatgtatatatacactatatatatatgtatatataatatttctgttcattgcaggcaccaatctttttcacaatcagattgtcctgatcaccctggctgttgtgtcctttttacatggcccggtagactttcttgctttctggcggaaaaaaattactccaagcgtatcaagtatatttcactcaaacctgggcatagccatttccaaggagctctgatttcttttagtgagattacatacatatatatatattttatagatgtaaatagaaaatgaccaatgttagtattaacaataagatgactaaatgtagtttaagactttcagttgatattcttcttgagtgattgtgcagccaacttggcttatagttatactcatttgtttctgtttattttcaatttttagaaatttccttgagtttacaaaaaatttaggctgagcgtggtggctcacatctgtaaccccaacactttgggaggccgaggcaggtggatcactcaaagtcaggagtttgagaccagcctggccaacatgacgaaaccccgtctctactaaaaatacaaagattagccgggcatggtggtgcatgcctgtagtctcagctactcaggagactgaggcaggagaatttcttgaacccgggagacagaggttgcagtgagccaagattggaccactgcacttcagcctgggcgacagaggaagactccatctccaaaaaaaaaaaaattacttttgttttagttatataagacattaacatagttccagagctagaactataaataaaatcttatctagcaacgtctagcttctgtcaccatctttatacctcgttttcttccttcctttattatttcctattgctgctataacagattaccacaaatttagtggcttaacacagatttcttatcttacagctctctaggttatatttctgacatgaggtctcactgggctaaaatcaagatgttgacaggactgtgttcccatctggaagctctaggggagaattgttttccttgctttttctagcttctagagcacgaggagttggacaagcttgttttagagggtgcctgcgttcctaggcccccttcctccatcttattaaacattattgtcgttttatgtcgtgtttgtttatattcatccacacatatttcatgtctcatcaccctgtcttccatattagagctttctcctagaatcatattctttcttcataggacaaattcctcttaggagcattcattgaaataaactgctcttatctgaataagtctttatttcaccctctttttaaatcttcatttggagatttaaaaattaaattaaaaaatttatttttttagccaagaatattattctaggttctcctacaactgtagatacgatcccactttctgacttctttttgttgccgttgagaaatcgtgaatcccttttacatattttttctgtggctttacttctcattgttttgttatcctgaagtgtttactattatatatctagatgtgaatttcttttgattatcctgtttgagacttggagggcttcctgaatgtgaggattggtatcttatcagttcctgagaaattctcatctattatcttttttggaattttgtccttatacccttctatttttttttttctttcttttcttttctttttttttttttttttttgagatcaagtctcactctgctgccaggccggaatgcagtggtacgatctcggttaactgcaacctccaccttccatgttcgagtgatcctcatgcctcagcctcctgagtagctggaactacaggcgtgcaccaccatgctggctaattttttttgttttttgcattttcaatagagacagggttttaccatgttgcccaggctggtcttgaactcctgtcctcaagcaatccacccgcctcagccttccaaagtgctggaattataggcatgagccaccgtgcccagccttattcccactttttttaaggcattttaaacagactaaattttctgtcgaatacttctattatatataaaactcttagtgggtctgattgtgtatattgtttctgagaagtcatgcttgtagtggtctgtttcctcacgtgttttataatttcgaatcatatagcatattcaactgggctttccctggagcaatactagaaaatctgctctaaatttgcatctttccagagaggatgtgcatttacttctgccaggtggtccatgagaactttaatttcttggcttagagattcccaggccacacagttagtgaaaataaatccctaaacctgtacaatagatgcctgaaattatgaactcttaggggaggcatttttctgcctagaccccacatcacaactggcaaatttctttatctccttttaccagtggacagattttttttttttaactcaccatttctcttaatatgtagctctttgaaagtctggctttatgtgagaggctttagttctttttttttttttgaaacagggtctcactttgttgcccaggctggagcgcagtgacatgatctcagctcactgtaacctcacctctgaggctgaagtgatcctcccacctcaaccttccaagtaactgggactacagacacatgccactatgcccagctaatatatttttttgtacttctggtagagacaaggttttgccatgttgctcaggctggtcttaaacttctgagctcggggtgatctgcctaccttggcctcccaaagtgctgggattacaggcgtgagccactgcgcctggccacttcagttctaataatcttataatcatgtttatatttttgtacttaattttaggcttttcatagtgggggagtttggaaggagatctagtgcatcatattttcaggagcaaaactgtgttcttttaaaatactcatgttccgagcaaaaagagaacacatgtgaaagggtaaggaagaagaggcagctcctctagctctctactcagcattgaggtgcttgcctgtccatgtcccttgggcagctactccttatgaataagccacggaaatgctccctaatcatgcctaataaaatggcaccaaggaccaggaagcttgtttcctctttctgtctctcagttttctctgacctccccgccatcgctgtaggcctgttttcctccagcttaggttttctactttctttcaggctttgcataataaaaatttgcctgaagaacctttatatttagtctcattttccttgatctttgtaataacatttttttttttttgagatggagtctcgccctgtcgcccaggttggagtacaatggtgtgaccttagctcactgcaacctccgccttccggtttcaagcaattctcctgcctcagcctcccgagtagctgggattacaggcacatgccaccatgcccagctaaattttgtatttttagtagagatggggtttcaccatgttggccaggctggtctcaaactcttgaccttgtgatctgcccgcctcagcctcccaaagtgctgggattacaggcgtgaaccaccgcgcccggcctgtaataacatatttgtatagggaccactatacatatttgtatggggaatcactacaaaactgtagtgattcaatttgggggatggtggggaccaggagataggtagaaatgagcctactgagtcaaatgtgtgccacatggggaccaggctgtaatcaccttagaagtcaaagttatcattagggaatatgttcaaactcttctttaagcccaatcctgtatgtcctatcgatcttgcctctttgggtaatgagtactataaatccattactcactgtttgagatagcacttttttttttaagtaatgctttttatttattccaacttacccgacttgcatgtggataggagtgaaaatacatatgttcattttctaaattatccttgttaatggagagaaacaaaggcagagagagctgtaaaaatttggggaagggggccaggcgtggtggctcacgactgtaatcgcagcactttgggagggcaaggcgggcggatcatgaagtcaagagagcgagaccatcctggctaacacggtgaaaccctgtctctactaaaaaaatacaaaaaaaaaaaaaaattagccgggcatggtggcgggcgcctgtagtcccagctactcgggaggcagaggcaggagaatggcttgaacccgggaggcttgaacccgggagcttgcagtgagccgagatcatgccactgtactccagcctgggtgacagagtgagactctgtctcaaaaaaaaaaaaattgggggaaggggtgtcaaatattatttgctacttattactggcgtgtaatactatctgaagctcataacaaaataaaacctacatcttgaagacaaatctttaacctggaaagtagttgagattttctttacccacaccttccttattcccagctttatttagtgcatgttttttcttcctacacctaaaaggtactgacttcagtagaatctcctcatcctatccctaccccagtttgcttgcttattttggctcataatctctcagagacatagttaattaattaagacctaagtaatgagttaattactataaatgagctacaatacccataatcaagagttagctgtatttattttaggaaggaagtggtaattaattagagccaaataaacaaaaggtacatttacagttggtaaaaactttcaggtttatttttaagtttagtaattccaggaatccttcaatgatacagacattcattgagcactgaatagtattcacgtccctgttctagtgcttgacatgaattatcccatttaagccttagaagtctatgaggtaagtattattatctccattttcccatggaagagcctgggcacagggaggttaaatgagggttacaaagcccctgctgtgcagtaactggctcgccttgtgtgtaaaaacctctgacaattgttttgagtccccaccactatcaccatttaagtttgtgtcttttttttttttttttttaagagacagggtctcaccctgtcaccctgcactctgtagagtgcagtggcacgtgcatagctcactacagccttgaacttctgggctcaagcatttctcccaccttagcatccagtagctagaactacaggcaagtgcccagctaattttttgtattttttttgtagagacaggatctcgccatgttgcccaggctgttcttgaaatcttggcctcaagcagtcctcccgccttggcctcccaaagcactgagcctccaaacctagccaagcttgggtctttgaaatatattctcagtagatagtgtagtgtggaaacccattccatagttgcctttatttgttcacatgagcttaaggtaagcctgggggttcaatgtccttcatgataccagctggttgacctcttgtccatttcagtttttgttccagcagctgggaatgttggtgtcctttgtgaagagccacatcagaccttatatggatgaaatagtcaccctcatgagagtgagtagaagttaatgctttggcctcttccatgtttgggtcaaggaaggctcagaagcaagtttgaatgacatagactttttttcacggatctttgtagagctgttacagtcttagtacaggaagtggaacaaagcccactggattttgagggggaggaagggctgttgctccaggttcccaggtacaaaactacaaggcatgaaggctgaagagaaatcctgcagtaattgttctgccagaaatagacaattgggttatttgcctcacacacaacaaagcaattttactttaatatcacaagggtgcttttctattttcatgaaagccctctttgttactgctcataaaccatgaagggattgggttttcttagggctgttaaatatgatggacacgtgttgggcaccaaggaacaaggtgatgctttaccctgctacctccaaaaccatacatatcaccttttgactgcagtggcacatgagaaaaggctcaggttccaggattttataacatgcattaagtaggtgccagaagacaccccatgggcaatatcatttttccttgtgttctatataatttaaatgtctctacggggaagattgcttcacagggacggcatgtcctcaaagagttggaagatttctgttctttcacaccagacctttgtagttagtttggactaaaatcaaaatggctggactatttgattttagcaggactaaaatcaaaatggctggtttcaaatggaacttcccagcacctggatctcagaactgaaaacctccctacatgtataaataattaaaagctgctctattccctgactcttaccacagaagcctctgtacaaggaggatttaggcagaatgctaaagaggccgatggctagtcttagtgggaggaggggcaagggaagaagcagtgtcctcatgggaggaggatgaagtaatctgtgacttaatccccccaagaaggctaaacaaggatacaatatgaccatattatagtcataacaggttgatgaccaaaacacagggaattgaggcagggagcctcacacctgcaaaatacagctttcatttcatcccagatagagaaggtgcaacgggggctcttcctttgactgttgattctgggcattttaatgagctcccccgagcctgggaagaaaatagtctttgtgaacagtgatccagctgacatcccttggcaggctgcctgacatctttgaggtagagaagcccctgtgaggagctgatgataatgcagctgggaggtaggttggccttctctaaagaaggcagagtagggttcaagtggatgaacatcagacagactctggaggctgtgaaatctgtggtgtttctttggcaacacttttaacctagaaaacacagctttttcagagagaatacttctctccaagtagagagaaaggaagttttaccagcatcttctagtatagtttttgctttctaaaccattatgcttttaaagatacctttttaaataaaaatactatatctttttataaagcctttcatctgaggagttatccttgttgttatggacttctactttgaactatttagaggctccaagaatattaacattcatgtgttgccatcattagtagggtttctattatcattaaatttcctactccagaacttttaaagatggtggtaggcagctgtctttttgagttgatagaaatgatatcttttcctggagttagaggcttggactaatttgctttgcagcactgaggcaggatctgtggccagttggccaagtttttattttagtaacttgtgtggaaaataaccatgtgggtgtagaaaggggctcattttgtggcactgttcaggcctgatggatagatttttgggaagggacagatatcagatgctatctattaatagcaaaatctaaatccagaaaagccaggaaatatttgtaatactggagtcaccctctggtagagatcaggtgataccaaagtaaggtccaagtccaccctggaccacttcagagttttttgagtgacttagtcatctgttcattctagaatattccagatgctctgattgatagattctggggatacagagataggatacttgtccctaagtagcctacagtctagagggaggacagcaaagcaaaggaagtcttataactgctatcgctatcaaagggagtgcaaaggacccaagtggatcatggaaggagaagaagaaagcctgcatgggagaagtgaggctagagccaggtctagaaagacagacagggcttagctgagcaagaagtgggattctaggcagaggaagcagcatgagcaaagcccagaggactgaggtagcctggtgcatctggggaaatgcaattgagtttgtccagtgtagctgcaacataggacacaagaagggcccagtgggaggaggggagtgaggagttgatctcggcgcagaccatgctcactacagttttgcttttctggccatcttgattcctttgttcatatatcatcagaaagggacctgactcagctcctctgacttttctctctttgtaggaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaaggtgagtagcctacgtcatcctccagagagattttctgatttcctctgagtccctgggtgatcagctaaaagctgagacctcattctgagtgacaggttgatgcccattccataagacagaatcccaagaatactaatacccaatgtgtgcagtttacagaatgtctgtaatcctctcttgattatccttatgttttgtatctgtttcaatggattaatcttgggaaatattttatcccagactaattttctttattttccagcaacggattccttatcaactcaaataagcacagagaaagcaaagtaatatgtaagcaaataaaatgaggggaagaaagtgctatcaaaaggatatagttcaaggccatttaataaagagttttcccagtccccagagaactttgaattgtctacaccaccacccgctgcgtgtccttagatacttgggacctgactattcatcaccatgcttttgctcccttttgcagttactggctgcaatccagctgtttggcgccaacctggatgactacctgcatttactgctgcctcctattgttaagttgtttgatgcccctgaagctccactgccatctcgaaagtgagcacctcctctttgggactagcaatctttaagctttaatgttttgttgaaaatgttcatttcttaagttcccaggccatctttctattttttttgttatttcaactcacattattttagtctagaaatatcccaggtttatggaaatcttaactgtccctatcccattggaataaatgttggatccatgtcatccaaaataccttagaagccgttcattcccatccctttggtgctgattgttaagctcaccctcagtcacgtctcttccttggagattgtatgttagcagttactgtatgttagtgattgttgtagggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaaggtaagatgggagtctggacagacaggtgctcttctgccttatttggaaagaagactttgtctgtgagccactcagactttgtctgatgccagccaccatcagagaacgtggaattacttgctttttttcttttcatgtgttcagcaaacatttattgagcaacctatgtgagctaagtgccgttctgggggtaacacggtaaacagaataaagtccttgctctcatagagcttccatcctgatgaagcaaagcaaataaacagtttgtttcttaagagtgatgggttgaagtggggagaagtgctctttatttagggtagacagagaagacctctgatcagttgacactcaagcagagacctagataaaataaaggcctggttgcaaagaattggatgcaaggagaagaaatagcaagtgctaaggttgaggtggcagcttgctcaaagagttcagggcacagcaggaaagcagtgtgacttcagaggagcaagcaatggggaagtgcttgtagttaaggtgatggagataaggcagaatagtagagactagattttgtaggcctggagctctcaaaatatcattcctggacaagcagtatcagtgtctacatacctgagaacttgttagaaatgcagattcttgagctaggcacagtgactcacacccgtaattccagcaacttgggaggctgaggcaagaggattgcttgagatcaggagttggagaccaactccagacatagcaagaccctgtctccacaaaaaaatttaaaacttagccaggcgtagggacacgtgcctgtggtcccagctactcaggaggctaaggcagagggatcgcttgagcccaggagttccagactgcagtgacccccataattgtgccattgcactccagcctgggcaacagagcaagacctcatctcacctaagacctactgaatcagatcctctagctgtggagcccagcagtctctggtttcatgagctgtccaggtgattctgacgcccactaaaatatgcaaatcactattgtgggccattgtaagtactttggcttttactctgagcaagactggaagtttttggtggactttgaacacaggaaaaataagatctgacttaatatttttaaatgataactcaatgccatgtgggaaaataggctgcgggggcaagggcagaagcaaagatctgttaagaggccaccatcataaaccagatgatggggacttgaactaggattataacgggagatgggaagaaggattcttttgaatatcacagagctagccacaaacccagaagaaatggtcataatgtagttgtataatattttttcctctactttttctccactctccaaaatgatagtttctcatctcttccccctcctgttttagtaccaaattttcattccaatggtgaataaagttctggtgcgacaccgaatcaatcatcagcgctatgatgtgctcatctgcagaattgtcaaggtgaactatacttcttttctgttctgaagtccctgttgtctttactacttgatattcttgtaatcttggctatgggagtttgtgtagctttttggctgtaaattagggattggcaaacttttttccagttttgtagactatgtggtctcttttgcagctcctcagctctgccactacagcctgagagcagccatacacaatgtgtaaatgatgagcctggctgcattccactaaaactttatttatggacacctaaatttgattctctcaattttcatgtgttgcaaaatatcaatcttcttttgattttttttccccccaaccatttaaaagtataaaaacccttcttagctcttgggctatataaaaacaggcagagggctgggtgcggtggctcccgccttgggaggccaaggcaggtggattgcttgagcccaggagtttgagaccagcctgggcaacatggtaaaaccccatctgtacaaaaaatacaaaaaattagctggtcatgatggcgggtacctgtggtcccagttaccgaggaggctgaagtgggaggatcacctgaggctgcagtgagctgtgattgcaccagtgcactccagcctgggtggcagagtgagaccctatctcaaagtagattaaaggctaggcacaggggctcatgcctgtaatcccacaactttgagaggctgaggcaggaggatcacttgaggtcaggagttcaagaccagcctggccaacatggcgaaacctcgtctccattaaaaatacaaaaattagccgggcatggtggtgtgcacctgtagtcccaactattcaggaggctcaggcaagagaattgcttgaacccaggaggcagaggttgcagtgagctgagattgcgctactgcactccagcctgagagacagagctagactctgtctcaaaaaaataagtaaataaataggttagattagataggcaggtagggagtggcacaaataaataagtgaatagatgattctttttaaaaagttttaaaaagccaggggatgggggctgtttgccacctttgctccaaacactttatcgcttttcccattgccgacaattgtttatctttgctagttgcatggttgcttgatcttaatactaagtcagtgcttgtcagtaactaggagtgactagcaaagactgtctacagttggggagtcagcccatctgtggttcattttgtccatatgtgcaactttttacttcttactgaaatcctggctctaccaggtctgcacctcccaaaatttaaggatatttcctaaaccagaagcatctagtagagttataggtgtttcctataaatctttggttgtagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcaagtccattgtttcaggtgactgggaaaggagagctctgctcttctcacttactcaaaacttttaactgtttaaactgggcaaccgaaaaccagcccaggtgttttttccagaaatctagataccatgaacttagatcattttgtctttttacaggtgcctaaattgtaattttgttttgaatagagaaaaagtagagaacaaaatgtccttttgtgctcccttggaatatggatggtagaaccttttgttgcaaatacattctcattttttacatgaagggaacaaagctagtgagccccctagttggcattgagactgatgaaggctctttcaaacagtgcttttcaaacttctcaaactcattgggcttaccagttgctgggagtcttgtaaaaatgcttattctgttgttggcagtctgatttggggcctgatattctgcatttctgacaagctgccagctaatgtgatgctgctggtccatggaccatactttgagtagtgaggttttagatgtttccaagtgattactgaattatctctgctggccaaagcctaagatatgaccagcttttcaccatgtatgccatcagctatccacctaaaaacaggcagtttcaaagcatctctagtgaatcagagcacaataatcataattacttcaccaactttaaataaatataccacatcgagtattttccattttgcattagtctttcatgtttctggtgactgtaagcaacttccagtttagatttcagtgttatttttcatctattagccatctcactccatgtgcagcagcagatagaggtgaagaactgggcaagactgtgtcctagctgactcgttcacttcttttggaaaaacccataaagatttgaacacagtcctttgtgcatgtgtacgggctcacgcccagctttgcggagcactgggggtttattactgttgtttcagagtctttactcacacaaacagcttcaagtgaccactgctaagaaacgtttgctgggttaagatggaggtagtaaaatattcctgggtcaggagtgatgctgctttccctctggggattttgtaactgctactctgagactttaggaggaagaaaaaggttatcagtcacttggcattcccaggtaatcattgaggccaccctgctgacacctcacactggagggaggggccaggcaggaggccagatgtacatttccacccagatgttttcatcctgactaggttcagaatgtccttccaaccaggcagccgtccaccctgctttagagctttgttctctctattttaggaaattcctcagtaatctagtttgcttccaggaagttttgctttctacccagacttggaaaaaataagcataaaccttgccagatagacaaaagaaagactcttagtttatctcacctgagaaagtagatcaagttcaaaactctagacagaatcctccacagctcactctcagatctatttcattgggaagtaaattgtgggagctgggcatggtggctcatgcctgtaatctcagtaatttggcaggccaaaatggaagaatcacttgaagcaggagtttgagaccagcctgggcaacatagtaaaacaccatctgtataataaaaatgaaaaatgaaaaaaattaatttcagcctgggcaacagagtaagaccctgtctcaaaaaaaaaaaaaaaaaggaattgaaaaaattttaaaaattagctgagcagagtggcacctgcctgtagtcccagctactcaggagactgaggcaggaggttcacttgagcccatgagttccagggtgcagtgagctatgattgcgccactgcactccagcccaggtgacagagcaagattctcttcaaaaaaaaaaaaaaaaaaaaaagaggtagggggccaggtgcagtggctcatgcctgtaattccaacactttgggaagccaggcgggaggattactcgagcccaggagttcaagaccagctggggcaacatggcaaaattccccctctacaaaaaatacaaaaattagctggacatggtggtgcatgcctgtagtcccagctactcaagaggctaaggtgggaggatctcttgagcctgggaggtcaaggctgcagtaagcagtgatcatcccacttcaccactccagcacaggcaacagagcaagaccctgtctcaccaacaacaacgacaaaaaaaggcagcagacctcattgttcagaagtaaattgtgcctccttataatcatgtgatgataattagggattggtgcatttatcagtcttaaccaactttcagagtaacaatttgccacctcagtcaccattttatttgttatgataatattagatttatgtgatacagaaaacataaaaaccatttatgtatacttctagaatgccttccagaattttcagcagctttactgtctgtctgaatgataatctgtttgggtttaccttcaccatgagtaagctggcattccatgaacaggcaccagcatcaccagatgaggcgatcagcagtgggtggatggcaagaggaagcagctcgtgtttacacagttgttatagaacccagagaattgagagttgataatgttttacagagcagggggaaagggccacatgggggacttgacctagtcaataaattaagctatgattttttgaaaacctatttactgccatttatcaagtaatagtaacaactgacatttattgagtgctttccgtgtgtcaagcactgtggtggaacactatattaactcatttaatcttcatgataaccccatgagttaggtgctgtcgttgctgtcccactttacagatgtggaccgtgaggcactgacgggttaagtaatttgcccagtgtcaactagcatcagtggtggagctgggatttgacctagatagcatgactccagagcccactctcttaaccactgtgttgaattgtgtctgccttacccaggcccaacctcatttcattagagggaaaaagaaactagtaatacttccctgtttatgtgcagcttttaacaattgctgtataatataatacagctacacacaaacccatcttgtagggaagaaaccaggtatctgtgggcaggaaaggactggatgttcccattgtgctcaacagagcaaggtctaaaaatcagtctttggtatctagtctccctcttccttctcattcagaggttctcgttgtatggtcagtggtattatttagtttgtctcttgtaacatttctgcttcggtttttgacataaagtgataggttgtctaattctattcatccataactctttagaagcaacagcacatctccagtgtatcccagggaggtgatggttgagtccttgatggtatagcacctgggggtcttttcactcactggaccacttcactagtccaaagtttgagaccttctgctctgtcttacatgatttcccccatttagggaggattgatgtgtcctgctggaaaaatctatgaagaacatattttaaaagttagggatttagtgtagttaggcctaggccagttcaaataggtgtcgttttgacaataataacaatcattttttgctcctttattccggctaagccatttagacacattatccctagatgaggcactctgaggctcagctgcaaaatacaagtaatttgcccagggtgttacagctgctgagtggaagagccaggatcccaggcaggtgtttctaactttagagaactaggcaaatagtactaactttgtgccaagcactgttataaattcattacatttattaacttaaaacaccccaggaagcagaaactataatcctcattttacagatgaggaaactaaggcacaggggagttaagtgacttgccaaagatcagagagccaattatgttatataactgggatttgaactgaagccattgagtcaagtgtagctgttgcccactacactatactgttctccaaaacctcagcctttccacccacctgaataagctgcccctggtagtaactcttgatgtctggagagttcagagttttgagagaagttggaggggatagagtagaaattaaatctgttcaacccctttttcttgttttaccacagtgccatgtgctttgggctcactgctcacctggttgcaacatgattcactatggtgtaaacctgagccttttccctcttcttgcgtgactcttcactgtcagatgagctggtgttctaatgcagaggacacagctcccttcatgccctgctggagcccattaggctttgtcgaatgcacccgagtgtggcaatcccatgtattctggttctgtagtgctcctttgctgcagtcagagtccagcacaaaggagttgtgaaacaggctttttccacagtgtggtatgttccagagttgctgttcttaattaaatattattcttttgtatttgtactctaggggaattttatcgtgaaagatggattttataaatctaaaagtagaataatcattaaatagatgaggacttttttcaattggcccttgaaactgattgttttccattgtcacctgtgggatcacaggcctggggcgctgccaggagggtctccaaagatgactggctggaatggctgagacggctgagcctggagctgctgaaggactcatcatcgccctccctgcgctcctgctgggccctggcacaggcctacaacccgatggccaggtatagtgtgtcagggcgggtggagaagatcagcacatagaaaacgatatatacaaattagtttttattagaagtaataatcaaggggctggtatttttaatttttctaattttgtgggatacaaagaaagagaaagacaaattcaacaagctcatactgtagcatctatcttaaccttgctagtagaccacaaattcctttttctagtagctttaggtctaacattttaattacaaagttatttataactctaaaagcaactgtgtaatagttgaatgtaacctatttccaataacaatggtattctaattattgctgtttgttacaaataccacaggaaaaaaaaggtctgaaacaataacagttatttattttactcctgaatctgcaatttgggaggacttttgggacagctcgcctctgctccacatggtgtcagtggagatggtttgactggggcaggatggaggatccgcattcaaggctggcttgtgtgtctggcaaagtgcaggtgactctcgactaggaacccagctctggctgggggccttggttcctctccatgggatcactccatgagttgcttgggccttctcacagatggtgactggcttcaagagtgagtgtcccaagagaacgaggtagtagaagagcatggtgtttttatgatctaagtcataaagagtcttggaagtcatgaagagtcacttctgccttgccctgttgctcaaggcagccacaaaggcgcagtcaggctcaaaggaagaagacatgggcacccacctcttgagagaggagaagtaatattctaacagactatatgggacaggagccactgttgcagacatctttggaaaatagaatttgccagaatttattttttctttttttgagagtcttgttctgttgctcaggctggactgcagtggcacagttgtggctcactgcaaccctgcctcctggttcaagagattctcctgcctcagcctcccgtgtagctgggattacaggtgtgtaccaccacacccagctaattttgtatttttagtaaagacggggtttcgccatgttggccaggctggtcttcaactcctggcctcaagtgatctgctcaccttggcctttcaaagtgctgggattacagacatgagccacttggccaaaattttttttattgatacataatagatgtacatatattttcaaagtacatgtgatatttcgatacattcatataatgtgtaataaaacaaatcaggataattgggatattcatcactttagacatctttttttgttgttgttgtttggttggtttttttgttttcatttttgtttttgtttttgagatggagtcttgctctgtcacccaggctggagtgcagtggcgcaattgtggctcactgcaacctccgtctcctgggttcaagcgattctcctgcctcagcctcccgagtagctgggagtacaggcacacgccaccacgcccggctattttttgtaattttagtagacgtggggtttcaccatgttggccaggctggtcttgaactcctgacctcaaatgatccacctgccttggcctcccagagtgctgggattacaggcgtgagccaccacgccccgcctggttttttgtttttgtttttgttttggaaacagggtctctgctgcccgggctggagtgcagtgggacgatctcggctcactgcagcctcaacctcctgggctcaagtgatcctcccacgtcagcctcctgagtagctgggactgcagacacgcaccaggcccagctaattttattttttgtagagacgaggtctcactatgttgcccaggctgatctcaaactcctggactcaagcagtcatcctgcctcagcctccaaaagtgccgtgatttataggcatgagtcatcaccattttttttttaatttttaaaaatttttatagattttggagtacaggtgcaggtttgttacatggatatgttgcatagtggtgaagtctgggcttttcgtagaaccatcacctgaataatagtgtacatcgtacctatcaggtaatttctcatccctcaaccccgccaaaaaaaatattgttttaaatagtaaatctttttttttttttttttttttgagacggagttttgctctgtttcccaggctggagtgcagtggcgcgatcttggctcaccgcaacctctacttcccaggttcaagccattctcctgcctcagcctcccaatgagctgggactacaggtgcacacctggccaattttttgtacttttagtagagatggggtttcaccatgttagccaggatggtctcgatctcctgacctcgcaatctgcccacctcggcctcccagagtgctgggattacaggcatgagccactgtgcccggcctaaatagtaaatcttaaacagccatttaaaatttggtttacaggctgggcattgtggctcctgcctataatctcagcactctaggaggctgagacaggaggatcacttgaggccaagagttcaagaccagcctgggcaacctagcgagactctatctctacaaaaatgaaaaattagccaagcgcggtggcatgaagctgtaatcctagctactcaggaggctaaggcggggggattacttgagtccaggagtttagaggctgcagagagccacaatcgtgcccctgcattccagcctagatggcagagcaagactgcatctcaaaaaaatttttttttggtttataaaacttctaatgcatgtgaaagatttataatataatgtaagtaaataaaatggaatacaaaattgaaaattaaaataaatgtgaataggataaagattagaaagtaatatagcaatggttatctttagggaaggcttaaggagtgattattttcttttttattctcttctttatttcttaaatttttctgcattggatattaattatttataatgaggcataaaatggtgatttaattaataagcagcccttcgcattggcaagaagcagaaagcaaggcatttcacttcatttttgtcagcagctggtttgctgttatgatatatatttagcagtagtgatggcccctgagactgttggtttgatgccatgatttgcatcctctaatttctttcaagtattttttaatgctttaaaatagtttctaggacttccctgtttccgtagtgtggagatatcatgtactcagctgatgtatttattattcctcttttctctccagtcacctctgagcacagtgttatccatgagaggcttgtgatatacacaatgtttttatccccttagtcccaaatacgttcattcaagatccaatgtggcctctgacctagatcaggaaaactttttttatgattttagagatgaaggtcttggttattgccctggctggtcttgaactgctaatctcaagagatcctcctgcctcagcctcccaagtcaccaggatgaccagcgactgtaattacctggctccgaaaacttacttttaattttttttttttttttgaaacagagtctcgctctgttgcccaggctggagtgcagtggtgtgatcttggctcactgcaaactctgcctcccaggttcaagccattctcctgcctcagcctcctgagaagctgggactacaggccaccaccaccgcgcccggctaattttttgtatttttagtagagacggggtttcaccatgttagccaggatggtctcgatctcctgaccttgtgatccgcccgcctcagccccccaaagtactgggattacaggcgtgagccaccacgcctggccttatttttaaatttataacagactttttttggtcttcatttgatcctttggatttcaaattttgttttttctatcaaattccaaaattatacacattggtctaacttaacctgttaatatgtaacagaaaataggtatagaggcatcaaatgctaaatctatccattgtaggtatatcctgttttttcccatttccttccccgcacagtcaccagaacagtggggaggacagaattaatgttagatgtaagggatggcaaatgtgtccatcatgtggtactgtggtaatgtaaagtggtcatagtaatctttgaaatggaacctctggttccatgtctttgtgaggccccaactgttggcttagaaaatcttttagaacttaaggatttggatcctatttgctaatgcttctagtcctgttgtcattttttatgaccatccaactaaggattctggttatattttgaaagcaattgcagatgctgcctttgacatttctgaccttaagaatttagacattgtcccagaaacatcccaagaatcatttaatgattattattttctgcatttgttaatgccaacttctatgttagaagtccctatactgttcatttcccatttcctccagtgaagagaaataatgcaaaaactgccaagaaatattcctttggagaaaagtcactttgctctgctcttctccccgccctgccactcgccccccaagtccctgaatatcacaatgtctgtacctgcagtgtaaaattcagtagacactagccatatgtggttaattaaaaataaataaaatgtaaaattcagttccttggccacacttgccacagttcaagtgctttagtgatcactggctaccatattggacaggaaaattctcttggacagcactggtctgtatagcactggtttgtataaccaaaatcagtgatgccaaaagcgaattgataggtgtgactttgaggcagcaggcagaggcacgggaggtctctccattttccaccttctctgccttcagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaaggtgagacttttccccattgtccagatggaggctgacagggaaccagctggtgggaggagagaagcatccacacagccttctcttgtttgtgccccatctgccattttcctgtgctgtgaggttttgctcttctccagggccccctgccactgagagatgacaatggcattgttctgctgggtgagagagctgccaagtgccgagcatatgccaaagcactacactacaaagaactggagttccagaaaggccccacccctgccattctagaatctctcatcaggtaggccataaaccctttttaattgctgccttcatgcaaaatgacctctcttctcccactgcctggtgccacttcactggagtcacttgaagacttctgctctgtgaaatctgcctctgggtctggccagcatgtttaaatgacatgttgttgcagatggctctccccaggaatctagccatgattgtcatttctgttgacccttatcacctgggctcctgttgttttccaacctgtcctttcttgttccagtgaaatttagttgagaagcaattctgtggccatggcagcctaggaagataggttttatgtctgggttagatagcgctgtctagagctggagtagaatgtgctggttcctgggcttcagagggtactcaagggcacagtggggttttatcaactaaatctattgatgcctgcatcttcctcctctggtgttttgtgaatataaaaggcagagcataatctgaaatctaatggtcttttctctgatgtggttatgttcgctcctctgttaagacagttttcagtcttctgggtatggaaaaaatagttcgtttaataaattttctgctgttaggaaattacaagcagcatgaaacattagctccagctcctaaaaaaccattcacttcccctaatgattatcagagaatatcaacttcgggatctcattatcttcatgtgaatgctaaatggtcggtcatttcactgcagatagtttagaaaaaatcatctggctagtaagttccttcaccgtggctgatagagcctgctgtgtggctctatcaaaggaggatagagcctcctttgtttgagagggtaatcaaatagccaagtcctttcctagctgtgcttttgagaagatatttaaaagagttcctttaacactttaaaaagttagcgaaaagatagaaatagaatcctgtttttgcccaaataaattggacttggagaaaatgttgatttctgaaataccatgtaggaataattaaaaacatgccgtcctctgaggcatgcttcagtttcacatcaggcacagtaaatgtgaaaatccactttcttccttccatctctggcttaggtaatgtgctgtcacttgatagctcatagaaaatacggtaactaagtatgatcactttaaggtcagataactcattttgcatattaatttccttgctcacctgtttgagacctatttgaaaccttcccaattccacccttaatttttccgcatatttgatacaatcataaaaacttaaagttatgcagatttgtagcagaaaaatatagtcagaggcctggaaaagtgctctagaaggttatttagctttgtaagcaaatataattgaaagtaaatcctcagaattccctggagattgatcttgtcctttgtttaaaacgctgttccaggccgggcggggtagttcacacctgtaatcccagcactctgggaggccaaggtgggtggatcacttgatgtcaggagttcgagaccagcctggccaacatggtgaaacacccatctctactaaaaatacaaaaattagctgggtgtggtggcgcacatctgtattcccagctccttgagaggctaaggcaggagaattgcttgaacctgggaggtggaggttgcaatgagccaagattgcgtcactgtactctagcctggatgacagcgagattctgtctcaataaaaaagtgaatgaatgagtgaatgaatgaatgctgttactggggaaagccagtgtgctcggctctttgggtgtcctcagctaagtcagctcagcttgcatttctgcctcccttctgctggtctcctgtgtcttcccatcacctttctttttttgcttccaattgcagtttttacttctgattttgtaaagctgcttttcctaagcccggttgtggtggtatactgtcgtctttactgaaggaagttttaagaaacagccttagacaaagttgctcatagcactacccctagttctgtgggtgagcctcatggaaattcttctcaggggtcttttcccactgttggttttatgtccctgagccactacttggatctggccttggagacatcgctttgcagtaagggattgaattccttcctcacagtggctgctagagagcttgaagctaaattcctggtctacctccaacaaattccagacatcttacctgtttttactactaaccctcccccaacccccacaggctttgttttatttttcctactcttattttcccttcaccaagttgtctgctttttcagagcttattttagtatatacatttgagtcaacttccctaaattctttttgaaacaattagggtagccctacacaaaaacatctttgttcagctatttcttttcttttcttttcttttttttttttttagatggagtcgcgctctgtctccaggctggagtgcagtggcacaatcttggctcactgcaacctccacctcctagatgcaagcgattctcctgcctcagcttcctaagtagctgggactacaggcgcatgccaccatgcccagctaatttttgtatttttagtagaaaggggtttcaccatgttggccaggatggtctcactctcttgacctcgtgatccacccgcctcggcctcctaaagtgctgggattacaggcgtgagccaccgcgtgcagctatttcttatttttttgtctttgctttaaaaaactgtgttctgttgacagtattgttctcttgctactagttcaatccgtcttgcaacctattgacttttttaacctatctgctacagggcaaattaaatccgagatgtaatcccaaatcagggctaacactgagatagtataaactacccccatctccttaaagctcacatatcagtaaatatatttgctttcttggggacagaggattgagtggttatttgttagaaagcgcacacacaccacttttacttggttagccccgagcattagggtaaggtctgctggcctgtttttgcttctctatcctaagtagaatagagggtctgataaggctggatgccttcactgcccagccccagacgtgtaatcccctttatgaagaattgtcctggttgctgcccttttgtcccttacctgttcccttttggcttctgctccccgcttggttgccctgaacaccaaaacaaaccccgggcctctgtcactgctcaccctctgatttaactttaactttttatcctgctgtaagtggtaatggtaagaatttaaaaagaagatactcacattttgaaagtgtttattgtagaaggaaaagaaacgttgaatgtttaaaacaaaaccacaatattttatttttacaaagtgagatgcttatttacagcatttattattaactataacaccatctaccttcagttttcaaccatttcctacagacaaaatttaaaaggaagctccttgagcttgtttcttacaaagtaaataaaaatagatatacctgtattaactatgaatattttaaggcagttttgtgccggcatccatgagagactctgtccacctcctgctggtgcttcattcctttcagtgctgtacatgaccaaggcgagcaggggcagtgctcagagtctgatcgccagatgcagtgccctggagtttcctccccgcaagtccagcctgggtcagttccagccgaacaatttttgtgttttaaaaataatgtgtagactcaagataatttcactggatttaaaaatagaaataccatttcccacctgcctccttcactcctttctctaacactcaaaggcctatcctttgagaatcaaaataatatggttctttttagcaaagggatttgtgttttgccctcacatagcctaagccgtagagaaaatagataaaacgatctcaaaattattttctttcacagacaaatcatgtggaaaagacaagctactgctatgtcagggatcttgggcagagagaccccactcagtctaccaccttgagaaggatgtggcaggacccagtgggtttaaatagttcatcctgtttactgtaacatccttggtacatatgatttttttgtgctccttggagacttattctttctttggagattataggctgtttctcagtcctaccctttctaacactctcttcctgtcctcatctgccctcatccagtctccacgtgtctcagtttctgtatccgtgctccacggcagcctccttttaaggcttgaagtcttctgggcggattttcatctccacccgtttgagggagtaggtagatccatgccagccataccaggtgatgccatccaggtgcttattgtgctcacccaggcggtagtacactccattgaggttggagtctgtgcagcagttgtaccagtagccacctggcatgagaaacagacccagtgctagtaagttgactgtgatagaccagacatcaggtaaggagttagagccagggtcagaaagaataccaaaaccggaatatcaactgtacagttataattcactctttctcctcaagtgggattatgagcttgtacctgaacttctcctttccggtccccccaaatctcacctttgcggagctgtgcacacttgtccaagcagttgtcattgtccttgtccttggtgctgaaggctgtgttgttatgatactggagggcgtcgttccccacattgccagtgtagttccccaggaagaggcgatagctgttgagttcattgcccaaaacaaagtggctatactcagcgtagcgcaggttgccctcccagtcctgtcaggaggagcagagccttaaagaaagtgcagcaggctccatttcatgctgtctctataccccttctctcctgacagtcccatagccaaacatctttttataggtgtgaatctaataagactttattacttgtttacctccagtttactgtgttaacctgggaatcagaaaacaaggctcgaacttctttcctgattcaccatatggccttgattagtctctctttctatattcctcactttcctgcttataaggtgcagctatgtttttgctgaatcccacacagagctgctgtaagagaaacatgaggatatagtgagtgctttcagaccttcagcaagggtccccaaacagtatcagtaagatttgcacctaaaggacctcatgctcggccagagcagagactagtgttcggcacagctgactgttgaatttgctctactctggcctgggtctggcctcttcctgtcccacctgcagccccacttttgtcggggggttggggggttgcagaaaggaaaaatacctatttttcctcaactccattacaacttgcaggaaaaccatcacaatgaatatacagatttgtcttgaatcagaataggaatggcacccccggagttgtacgcggtcatgtgtggtggcactggtccagtcatggggcccctggccttgtgcttacctccatctctacacgcagccgggttggctgtctggagagccggtggatgtgttcgttccccagccagaagtccccacggatgctgccaaagccctgcttgtactgcttccagtcccggtagaaggagacaaggccactttttcgtctctggatgatggtccagcctccgcctgaagtctccatgtcacagaacacctgaagcagaggggatactctggtgagggacttgcaggggcagaaggcaggagcaagagggcaggcttcccaacctgttcctgtccctgcagagccagtagatgtgtgcactcccgcagtcacactggctcactcgggcagtgatgctgccccactgctggtgagctggggtgggtggtgcattgctctggaagaacgatgcaaattgggcccgggggtgagtgcacatgaagcttggagggaaaaatccagatactttttttttttttgaagcagaatttcactcttgttgcccaggctagagtacagtggtgcaatctcggctcactgcaacctccacctcctgagttccagtgattctcctgccttcctagtagctgggaccagagtgcctgtcaccacactgggctaatttttgtatttttagtagagactgggtttcagcatgttggccaggctggtctcaaagtcctgacctcaggtgattgttccgcccacctcacctcccaaaaaacttgggattacaggtgtgagccaccatgcctgggtgaaaatccagataatttgatgctgccttcgtgttttcttttctcctcccccaaggaatagctgttctaggacatggcaagagatttaaactaagttatgtggtggttataagaatgatctgatctatgttagaaggcttgttgtttgactgataatgatttgaaggggccaaacagatgcctgggtttggagtgcagggcataaactgagtgtttgcatagctctgtggtgtttggtgtgtttgcttgtgtttgagttttccttttttttttttttttttttaattgaaatggagtctcactttgtctcccagattatagtgcagtggcgtgatctcggctcactgcaacctctgcctcctgagttcaagcgatcctcctgtgtagcagggattacaggtgcccaccaccatgcctggctaatttttttgtatttttagtagagacagggtttcaccatgttggccaggctggtcttaaactcctgacctgaagtgatccacctgcctcggcctcccatagtgctgggattacaggtgtgagccactgcgcccagccgaattttcctttctttaaactgtgaatggccctgttgttgtagtccccttgagggggtgaaggacaggtattagggcatggccagtgactgtaatgacctcacctccagttcagggctgcccaggaagtcatcaggaggaagcttatacactccagagatgcggtagttcttctggtagagggaagagcagtcgtagatggcatctacaagagaacaaaccacagggtgagcatttagacccagtggctccatctgagttgagtgtttagagactgagcctttatttctaccctgggattctcagtggtgttaattacccatcagtgtctgcatttgggagaggtggatatggggagatccagagggggtgtattttggctttactagcggtggagcagaggggtagggaagcccttcacctggatagcattagtgggacgttccaacaggtggtttcaggttaactctgaaataaattattctgctatagctgggccatgaattctagaaatgttacagtgtatgagggccacgtaacagatactcctgtcagatagattcagacttcttagacagccgccactataacaaatcagtcgtgaatatctcatagagtctggttttgttgatgtttcctggttggttgtttttgttgttgttcagagatggtggctactgccacctgagaccataattaagggagatagattttattatcacatattttccccttccatccagctagcacctcaaaacactcagaagaacctttgaggccttcctcccagaagttttgttaaaacaatgaaatgagagcatcagactggccagtttttttactctagggccatggagctgctactttatgcaggatttaagctctgtattctaaatatcaaagagcatagtggaagagacagccttttctgataggattcagagactgcggcccttactatccaagagaagcttcctgcctgctatgtctcggggtgcttttcttggtgaccactgcactgggaccttagagaggagcaccaagatggcagatgggagttgtctgaggcacataggttctcttgcagagcaccttgggaaagggaggtagagtacgtgtgccttcgccatcactattcttcatttcgtcttagtggtgaaagcaccaacttactgcttcctctaagggactacctacttatagaatataagggtaactgagcacttggtcatagagaagaaaaataaggaatgatgtcctgggcaagaagagcaagagacctggtgggagagctgcacttgaccccaagaacctccttgcaggatggtgagaaagcctcctgtttggatgagcaggaagtggcacggtcagattcctctgtctggcctggtcttccgcatgtctggtttcatctcacagaccaaatcaggactcacttgtctggaaaatggcctgagaatacctttctaatcccaaactgagggcccggaagtccatgcttagaaagtgattgatacatgttggttcaggtaacagaattttcaagcttggtttcatgttaaaactttttcttaatttgagctgaggttaaccattgacttagtcagtagaagctgatcatgtctttgttcttcatgtagtttataatgggaccaatggtttttatatcagcaagaaatgacatgtctataggatatgctccttacaactaatattttcctgataatttcagaaaaccaaatttttatctctaaaccgtaaattcatgttggcccacctgagctgagctaaccagaaataaaagttattttgcaaaagaaagattaaatttatcttatttttggcctattaagtctatatttcagcattgcatttaaaaaatcctgtattcggagaaattcatttaagaccatggaaaaaaatagacgtatcacaattgaggaaccttaaggagccgcatccttcctgaacacaaagggactcttcacatggttatgtgtctctacacttaactctgagccaatgagaagagttacgtttacagagagaggacacaaaattccattaatgctcattcctggtaaatcttaggaacaccagagaactgtttctggcaaaactttgcttccagaggaacagctgttacagtttggtgcttccttggaatttcttgagatatagcctgtcagctcttggtgaggaagtagcagagctacaccaatcaggaagacttgaaccctgcttctaagacttgctgggtgactttgggcaaaccatgtagtatctcagcactccaagatggtaggctgaaacactgtgtggataaaagagacccgtgaaggtgttaggtaaacttacatagcattagaagtcaaaggaaatactgcataagcctttactaaagggaaagtgtacccacaaaagaggccccagtagtggttctgatgaccaggatatgtagaagcagtgctgtagatggggaggcactccacgctccctcaggggactggtctccttacctgcggaggtctgagtgaccgtctgtgctgcctgcagctgcatgatgtcaatttggttgttcatctcggagtacttgctctcagcatctgtgagccgcgactccatgcgcttgctgttgctctccagctccatcacctgcatgaccacgctgacccagtccctctcctgcttcttgttcagttcactcagcaggctgctaaggttggcaacttgggccttgagctccttcacctcctcacagcagttggccgctttgagctgtggctgtgctggtgtcttgtgcttagagagcttctgcagccacgctgggtggctgacaaaggccacgatgaaaatgcagagccaggtcacagctgagagaggctttttcagcatcttttgtgggtttgggtgaggaaggctcttccttcaggggagtctggagatgcccagctgaggtctgcaaagctgcagcaggctgactgaaccttacgctttcactctgagggcctcgccactttgttgttttctctctttccttgctctttgctagcctttctcaaagcttgagtctctgacaggggagctgaatgggtagcctatagctttccttccaagcccgaatgctccacaagtcagcatcttaaatattgtttgctgcctgtacctccacccctaccatggctgcaccaggctttagcccctcccagctcatctgggagggtcaggtgcctgttgggtgaagtcagcggcaacttaggccagaggaggggaggagggagatggggcgagtctttctttccttgcctgtacagtctctgggctaagacaagaggactgtgaatttgtgtgtttccagtttcgcctattagattatgcccctgccagccactggctcaactctatcagcaagcaggacagggtcagaagaatttccaaattccgttcaaaaggttatataaccatggggtgagcgtaaggtaggcgaaagagacgctactcacccagggaggcctgttaatgtaatccatgctgtttatatgaggatctggtatattttgacatcctgctgaatatgcttttatctaggctgattattcccatctctgatcattatttagtattttataaaatccttactcaacctggatctaacactatctcacatttgaaatcttccaacttagaaaagttctagaaatagaagaatagagtaaatctcttaggaagccaaaaaaagactttgtagccacagggtttggacagttgtctttttacatgctttctccttcaacaaagagagggccagtattagcatataacacttgatattttgcaaggaggtgtcagaagattacaacagagatgaaaactcagcagtgccaagcatgtctgggattggtcacccatgcttctgtcagtttctaggcaggacagagaacaggcccatccttagcccgtggttcaaaacttggaaaatatattaaaatatagagaaaagaatccctgtcacctaataaatccatatctagagtctcatttccctctttctttgctggtatggtttgcaatttgaaattattcctcctctatttgtatatgactttgtatctaaaaaacatgaatattgtaatttttcatgtactatatatgaaggacaatgctcttttgaaaagaaatgtgaaaaacatggagtttcagcaaacatccttaaaataagcttttcactaagaatctatacaaaggttcctctgtccttaaaacagtaactctgtctttggaacatacgattgctgtttccatgttatggagccactcaggcagttacttgtactgttgtagtcagcgtgggtccttcccacataagcctgatgcctgacagctctcctcccatgccataatcccccagagctcttttccagtcagggcttctagctcctcagaaagtaatttctgttcaggcagctggagttactgaacaatttttttttttctcagaatcaaaaagcagtggaggatcaggtggatcagagtttgttttctcacatacccagcctcctttgcctgctaaagggtgaggatgttactgatacccttatagcaacttggcattctaatcaaaagattctgttgagaattggcactgtctgccagtctgctctctttttgcaaatgtctagcccagctgggcaccacagccttagctccatagcattcattttagtaacgagactctggccccaaatattggcatcctacaaggtctgctaaaaatagggattttcaagtggatctcctggccatcaaatgacactgagcttaaaccacatgccacagaagtgctatgtaccatacagtcatgtatagcaggggtccctaatccccaggctgcagacctgtacttgtccatggcctgttaggaatagggccatacagcaggaggtgagtggcaggtgagtgagcattaccgcctgagctctgcctcctgtcagatcggtggcagcattagatcctcacaggagtgtgaaccctgttgtgaactgcacatgtgagggatctaggttgcgtgctccttgtgagaatctaagtactgcctgaagatctgaggtggaacagttttacctcaaaaccatcccccatctccccacccccaccctggtccatagaaaaattgtcttccacgaaaccagtccctagtgccaaaaagattggggaccactgatgtatagcatcccacgtgaccctgctgccttggaactctcatgtaacagtgcagcagagaaagcacaaaagaacagtggaactttgtggagttctagccagcttttgtttattcttcccagtagctcacccaaacaggaaagtgttatgaattgattcttatatgtgggcagaaaataaattaatcattcatatttgtaccccatgtaacagtcccttttaggaaaggtaggaggaggttcgtaagtttgtattggaagcatctagcctttagcatgagtgtctggtctttgacatttattttctggaaacttatttctaacataaggcaatacttgaagacagaagacagaagctcttgaattgcataagctacccaaatgtcaatactcaccccccctccagttttgaggaaaaatagctaattaaggatatttctcatgccagaagattatctattttctaaaacatccacaaccttatgatgtcctagattctgaatatctaaatgaaggaaaaagaagtccttgttttgagcacagctaagccagtagagaaaaccatgaaggatgtggaggactaaaatggtattgccttctctgaaagaggcttttaaatccttcttctgcctttcagtgagcagagtgaccttaaaaatgggaattaactgacaaaatctggaaaacctaggttggatactgtttagattttccttttctccattttgctggtgttgaaagagggctagcttggtgctcctggaaaaggtgtttatgaaaattaagcttttgttcttaatgaaaaaagtcagtgaggttgtactcaacctggaggttctcaaaagacttcacagtgtttgggccgcactgccttgggctggcaccaaggtagtctgagggtcacagggcaggggagcacctaggggtggtctctccttctatccagagaggagcatcagatcccatttgcttgaaaatgccccgttggagagactgctgcccactctcagcttgtggaatgaatacatctcagaagaagctgccttgctgttagttttaattgtgtatctcaaaggaatatttcacttcttctgaagtctttgaaaaaaccacagcctgccatactctatacagccgttgaatatctgcctttttttttttttttttttttttgagacggagtcttgctctgtcgtccaggctggagtgcagtggcacgatcttggctcactggaagctctgcctcccgggttcacgccaattctcctgcctcagcctcccaagtagctgggactacaggcacctgccaccatgcccagctaattttttgtattttttagtacaggcagggtttcaccatgttagccaggatggtctcgatctcctgatctgttgatccacccgcctcggcctcccaaagtgctgggattacaggtgtgagtcatcatgcccggccacatatctgcctttctagcactccatcccattcctgtctcaactgaaagtccaagtccatcacagaagatatttccatcttttccctgagctttctaatttgccacttctatcaaagaatgtgtcctgaacctattagaagtcttttctctcaggccttctcttagagtcctgttttgttttgttctgttttgttttgtgacagggtttcactctgttcaggctagagtgcaatggggcaaccatggctcattgcagcctcaacctcccagtctcaagtgatccatccacctcagcctcccgagtagctaggactgcaggtatgcaccaccacacccaactatctttttttctttctttctttctttcttttctttttttttttttgtagtgatgggggtctcactgtgttgccagggctggtctcgaactcctgggctcaagtgatcctccagcctcagcctctcaaagtgctaggattacaggcatgagccaccacacctggccagagtcagttttaaattatggaatatagtaaaaaaaaaaaaaaagtctctctgatttctgtcaggactttatagctctgttagcctccactcaagttgcacaatccagcgattattctggcccagtgtctggcagtctagttagacagctgaactcttggacagtgtgacatgctaggatgggagacacagaggacaaggagggccttctagagaagtgatacctaggttttaaagaaaaaggaggaaatagccaggaatgggagaggatgttgtaagcaaaggtgcagctatgtgaaagacttggactagtgggagaatgtaagtagtcgagtgtggcctaagagtcaaagggaagaagaatggcagcagaagctaaagctggagaggtggaggggggccgtgcccggggagcccaggtgaggagcgggactgatcctctgtagacatgggaaggaatcctagaggtttttccctcttgttccattgttttcctgagttccaccaggaaagtggccttggtaattgccaaacaatttttttttattttttattttttttagagacatagtctcattctgttacccaccctggagtgctgtagtgcaatcatatagcttactgaaacctggaactcgtgagctgaagcagtcctcctgcctgagcctccaaagtagctgggaatacaagcgcacaccaacacgcctgcctgtttttaaatttttttgtagagacggagtctcactatgttgaggctggtgtggaactcctagcctcaagagatcttcccatctcaacctcccgaagtgctaggattataggcctgagccaccacacacagcccaaacaagattttttcaccgcaaatgaatgatttagaacgtgagaatttcttaaaattgtaatgcattcatattaaataccctgacggggtcatttggcattaggattaaggaggtagtacatatagcacttgagttcttaggcctagaagcagacaaatctggattctaatccctccctagcacttggttgctgtgtggccatggacatattacttctctgagtttgccaacctgtgaaatggagataaaaatcaaaactatctcataccacaggcttttcatgagaattaaataaagcaaagggttaaataaccaaggtatttttggataaggaaaataaatttggaagagttacactactacatatcaagatttatcataaagctgcagtaagtaaggcagtacagtagtgacatggatgaacaaatggaacagaattaaatgtccagaaacagacccacatatgtagagatacttaattttgtgtatttatatttatgtatttattcctttcctctcaagccatgtgatatagacacttgatttataacaaggtagcaccacagagtggtgaggaaaggactgctaagtcagctcagtagccttatgggggaagaaaatttttttttttccctcagtgatcctttttctgaaagaaaagactgttgatcgttacctcacaccacacacaaaagctcaagtccaggagatttaaactcttaagtgtgaacagtaaaacaataaaatttatagaggataacgtaggagattaagtggcttcctaagataagcaaagatttcttaagatagaaaaaacaccaatcataaaggaaaatattaagaaatgcaacaaaagtagtcattctgttcattggaagacacaatgaagagaatgaaaggcaagaaatatttctattatcttcaatattgtatatgtattatacccagagtgtataaagaactcttatcaaacaataaggaggaaaaaggtagcacaataaaaagattggtaaaagaagccaggtacagtggtgtgtacctgtagtctgagctactcgggaggttgaggtggaaggattgcttgagcccaagagttggaaaccagcctaggcaacatagagagactctgtctcaaaaagaaaaaaataaaatattgacaaaagatgtgaacaggcacttagttcacaaagatatccaaaaggcttataaatacatgaaaagctatcccatctcattagtcattatggaaataaaaatttaaatcataataaaatgccactgcacaccaaccagaagggctgaaatggaaaaggctgaaaatagcaaatgttgacagagattgtgaagcaattgggcttttcatgtcctattggtagaaatgtaaattggtaaagccactttggaaaacaatctgtcagtatcttataaagctaaacatatccttatatgtaactcaacaattctgctatagatattttccagcagaagtgcaagcacacatgctccagaagacatggacaagagtgtccgcgtactacccctcgtaatagccaaacactgaaaacaatccaagtgttcatctgcagtaagataggtaaatggtggtatattcacaccgtgaaatactgttcagcaatagaaaggaaaagctgttgcgacgtgcagcagcctgggtgcatgtcacaaacatagtgttgaatgtttatataattaagctcaaaaactgagcaaacaaccccattgtgttagaagtcagagtagggtttacagacctctggggacacagaggggagcagtgattgggagggggctcagtgcctctgagctgctggcagctggttgtgttctgtttctggtctgggtggtaattacaaagatgtcttcactttatgataattcatcaaactgtacacttaggtgttatattctcctatatttatgtatacttgaattaggatgtttgtgtaaaaatagataatgcacataaaacacttgaactagtatctgacacatagtcaacgtctagcaaatatcaagtagtagtattgtaccaagtagtagtattgtattatttagtacacaattgttgtctcgtcataaaagtatttgctgactactctagtctaacataaatccccataaatccccatgtttttctctaagcactctgttctcttcatggtatttgccacaaaagcacttatttcagtttgtacttttttttttttttttaagatggagtttcgctcttattgcccaggctggagcgcagtggcgcaatctcagctcactgcaacctccgcctcccaggttcaagcaattctcttgcctcagcctcctgagtagctgggattacagtcatgcactgccatgccttgctaattttgtatttttagtagagagggggtttctccatgtcggtcaggctggtctcgaactcctgacctcaggtgatccgcctgccttggcctcccaaagtgctgggattacaggtgtgagccactgcacctggcctcggtttgtacttttttgtgtatctacttctctaacctgtaagctctgcgaaagcaaagaacatgtttctcttattttccacagtacctctagcatctagcacttagcataaagcctaagacaaaatgcatactaaattagaacttgtcaaatgaaataatgaatttcaaagagaaggttctcttccccctaaatatctattatggagacttacagtctctctccatggacgtttccagtgttttactgtggtgaggtcttcgctgtagggcatcacattctgtcctgcatggggtcagttttccttcttcaggtcttagtcatagaatcaaagaaagtgaaaactgggagagttgagatcctttgtttcaaccctctttttaatttttattttatttgtttatttattttgagatggagtctggctctgtcgcccaggcttgagtgtagtggtggggtctcagctcagtgcaacctccgcctcctggattcaagcagttctcttgcctcagcctcccgagtagctggaattacaggtgcccaccactacatccggctttgaccccattttttaaatcaataacttgaggtagcttccttattgtataatatattgcatacatattcctagacatcaccaggctgtgtctcatcacttttttttttacttaggaagatgatcagcaagaggaccacagagtatctgagatcaggttttctccctctcctgtttattccagaagccagtgtaaatgacatgtctgattacttcaacctgcactggccctaggggctgcatgcaacagctaatgttgacaaaatgaagaaagtaacatgtccccataaaaactgccttatttcgggcgggcaaggtggctcatgcctgtaatcccagcactttgggaggccaagacgggcagattacaaagtcaagatatcaagaccatcctggccaatgtggtgaaaccccgtctctattaaaaatacaaaaattagctggatgtggtggcacactcctgtagtcccagctacttgggaggctgaggccagagaattgcttgaactcgggaggtagaggttgcagtgagccgagatcgcaccgctgcactccagcctggcgacagagcaagactccgtcaaaaaaaaaaaaaaaacctgccttatttctgggcagctgtagtccccatattttatccccagtaacctaacaaagctcatctgtccccaaagggaaatcaaatgtccattatattgcaatttcagtaaatcacccttagctagagataagaccttgtcaggggttgcaggacaagatcacatgtccaccccaccaagctgttctctgaactacagagcttctctttgggttagacatctccaccctgacttaggcaccacaaactggaaaacaggcctggtcattctttaagaatgttagaggatttgtgccagttatgcctgagcaaccaattaatggcaagggtgactgggttttacagtctgcaggcaaggggctaaatgggcaaacaaaacccactctttgtcttaattctaaacacatgtttccagggtgccaatattgtgctgcttgaaagtatgattcctgcttttacagttgtttcctggcttccagaaaagatatgcggtccttttctttttctgtacctctgctggaagaaaaagcagtcagtccacagaggtgaggttttgctcacagcaaaacacattccaggctgggtgcagtggctcactcctataatcccagcactttgggaggccaagacaggaggattgcttgaagccaggagttcaagaccagcctgggtaacatagcaagaccttgtctctgtaaaaagtttagtggggcatgatggcatgcgcttgtggtctcagctactcaggaggccaaggcaggaggatcacttgagtccaggagtttgaggctgcagtgagctatgattgcaccactgcactccagcgtgggcaacagaacaagacactatctcaaaacaaacaaaaaaccacattccaaacttctatgttcgtgctgacttcagaagggccagtgtgcctgtaagaatctgtgtcctttgtagaaaagctccatgctgcaaagagtaggagaaaagagcaaaagcagaagcagtttgtatctttgctgtagccccattttttttttcaaatgcacttttagattcagcccaagaggccacatctctcaccagttatcagtagagcatgcatttacttctagctgctgtcaagacttcccccagggtcactgtaacagcttgctcttgcagagcgtcttatgaaccccagggaaggctcttcagtggagaaacctcgccatcagcgaggaattgtaagaagaggagagttctggggtttctcctaaagctggccaaaaggacagaggggctattgttacaaaacaagacccttctaaggggagaaacttgctgtatttcagtggtgtccctaaactcttctacaaaagctagcttatccttcagactacctggagatttaatgggactgctcttatgctgacttagagaaactgcttctgatttttatataacactgggggagggaaagaaagtgctagcagttacactgtgtcccagtgctctgaaaccttgaattgtatgctgcatcccaatttcagagatgttaaggtgtgaaaaaaatgtgtgtcttagaactgatgaaatctagtaggtgctgggctctgcctcatggccacctctgactgttcatgcagtgatgatatcagtaggggcaccactggtctctccaaacatttctggacttttcactggctgtgaatcctggtaatccagttatagagtgccacagttctcttccatgaggcatccattaccaagaaggtgggcatggttttttcttttccctgaacccagaatgggcatcattattcctacactgtggcccaactccttaatagagtggaagaccagctcacatctgcttctacaattaaatgtgaagagttacaagctgccagatcactaggtgccagcttgtttaagttttgtttcccaactttatccacataatggactgagtcagagttcttggacattcagaagccaagaaatcaggactttacccaaaatatcacctcagttttgagtcaagagagatgaacattagctttggagtcactctatcagcccaccccttttgctccttttccccatccttttcctgactgctgcttctttctagtagtctctctcagagctctttgtttctctctggatgtgaagaagcagaaagggggagaagaacctgcaggcatcacaagaaaaggagcagtgctcattgttgtagaataaaaagataatggccaatttgtcaagaagtgttgacaagtaagataaagttggaagtaattaactggctgacatgctgggagcggtgtgcctgccaatagctccctaaatcagccagagccttggaaatgtgacagccattcatcatttttacaacacgcctctgacaggctcctcagttgcaaacctggccagcaaaagtcgtgtgctttgacattctggggttgtgcacctctctctgccttattctgggttgtgctaaggtacctgggccctatatccaaccaggagatgcctggagacggtgagtcaaatgggccagcttgccagctcatcgctgggcagtattcctctccgaggctgggcactaggattcccagagctgactttgtaaacttctgcaggacagttcacttagcatagagagtgctgaatgggagccatcagcagcactcctggtggcctggtatctaacaagtgctgctgctaaccagccatgggatctatcagtgggaggaaacgggtatgcagccagtaaaagcaattatgaagactgaatggagtggaaaatacctgtgttatgtgaaaaggcagcatacaaaattgtatctatactttcatcaccagtatgtataaaatatgcatttatgcagaatatgcgcaggtaaaagtatcttggaaaggtgattatattacaatcaacttccctcctccatttttttctttttaaaaagtggtacttccactcaccaatcttgaaaagatgagtttttttgcacacgcgcccccattcccccacgcacttcctaatctcaaaaactgttaacattctaccctctttattctaagggctcacactttctcacatacagatttagcgtgtcctctaggcattgtgacagacaaaccatttaaactgtgaccagacagaaacaaggatgaagacatagtaagaattctttttatttttaggccactctgagcctgagacatcaggaatcttttgttttgtttttggagacagagtctcactctgtcacccagtctggagtgcagtggtgcgattgtagcccactgcagcctcacactcgtgggctcaagtgttcctcccgccttagtctcccaaatagctgggactgcagacacagatcacctcacccagctaatttttaaattttttgtagattcgaagtcttgctatgttgctcaggctggtcttgaattcctgtcctcaagcagtcatcctgtctcggcctcccaaggtggtgggattacaggcatgagccaccgcgcctagccaaagaaacctattttgactgtctaaagctggccacctctcttgcaccaaacttttttttatcttggtgccttaggtccccaagagctccaagtacaccaaatgccccagctttgaaaccttgtaatggggccagccttctcttaatatataaagttctttttcctaagttccagccctgccagacccagaggtactgtcttcatcatctgattctggctttgtttcccttcacttcccctcctgtctgcattccggcagccctcccaaccttctgccccgtcacttttcagatgttttcattttgcttctgtctgccctgctgtcctttctcttctacattagtctgttcattcttgagttccccagaccattctcctgttcccagattcccaaggtagcttcctgataaagacatcaaggcctagccaaccccagatcttcctggccctagaaggaatcagactatttggttgttaatcctgcgttgggcacagagctaagcctcagtgctgggagaagtgacaggagaatctcaagcagttaccactccatgagagaaactgcttgatacagtggttaggacccaaagcagtgtccagggtggcctcagtgtggctggtcaggccacttcagtcagacctgccacagccccatcagctgtgatgcatgtgtcaccagcctggcgccaggggaattcagagaattctcacttgacagggaaccaaatgaaactcagactgtggtctgcactagaaatagacaggagaaagaaggtccacagccatttgggaagccagtgggtgtgttctcatacattcctgatgggagcgctggggaagcctgagcgttgccccagctgtgcctgcagatgctccttgctgcctgaggactttccgacaggcgccgccttgtgtggaagaggcttgcatcactttgctctgaaccccagaggtcacgcggcaccaagactgagggatgagggcgataaccaagtgggccactcaaggaggcactgccatgtcaagttactgtggactcagcatctgtccagaagcctgtggagccgtgactgagggcacttccagagacaatgttctccaggtttctcttcaggtggcaggaaaggcgtttagactgctttgctgtgggtcagcattaagtccttgagcagttaatgacccactatttcagtcaatctcatcctcctccaataaaaggcagtgagggggctgggcacagtggctcatgcctgtaatcccagcactttgggaggctgaggcggttagatcatttgaggtcaggagttcaagaccagcctggccaacatggtgaaaacacatctctactactaaaaatagaaaaattagctgggcagtagtggcgcgcacctgtaatcccagctactggagagactgaggcatgagaatccttgagcctgggaggcagaggttgcggtgagccgagattgcgccactgcactccagtctgggtgacagagtgagaccctgtctcaaaaaaaaaaaaaaaacctgctagggagagcctgagaggaaagggctatggggaggcagcaggcgccactgcccacgtgagctgctctaccgtcactcctgacagggcctttgccgggggaagtgtctgcacagctgaaccacccgctgctcagctcgcatgcttgccctgccttgggaacaaggtttctggatagtggggataagatgttcagcgtaatggtgtgatgtttgctataggaaggcagcaaggcaatttcttagtattagttctgctcagctctagaaaatgttttccttgattgccaagaactttcccagctcaattcaaaactcgaatttgatgaaaggaggctctgcaattcagcctcctttaatcagaattcaatcttgggctggggtggggagagtggagaatgaatgagaatgaatatgtctgtacagcggcctccttctgcccctgatacccagattcaccatgttctcctttccgcctgtcttcgttgtcttcctaacgccaggttcagtttgtgggctctggattctattatgcggataggcagtttctgtttgttctacagattcacaactgtatgatagcaactggatgttataactggaaactggagtagaataccaacataccccacacccatgttagggaggcagtgggaatcactagtttagaaaattcttgggactcagttctcttttccttttggcctcagtaggcgtcaagaggagatgggaaatctgattgacctgtcatttctgcacactgttataggcacgttgctgacaagcctcagtttctttaaacttgtttgtgttcagatcttttccaccagaccagcatcagcagggtctggtttgtggtgttacgtactcctcttctgttgggctggagctttgaacagtttgccctttataagcctgcagcattaatagggaaagactgaggggcacccaagggggtgtttatagaatgggctttataaaactcccagctgccccgtaaaacaagagttcctcgctaagggggcttttgagcaaaggtgatttcttcacaggagccgaacatacagtctctgccttcagtctcataaaaaccacatctcattagaaaagggacataattcaaaggacggctttgtatcacccaggtaggcaggagatctgggacttagtggctgtgaactcctgcattttcacagagacttgcttgtcctgcactttgcagcctgaactataagcctggctgtctttgaaaagcctgctgtgatggcatgctgacttgtcacgtggaaggctggaggcatattagtagcttctggaaggaaataaaaaatgtgagatgggagcttgggagtaagagaggaatgttagtgaggaagttaaaatgaaggcacaggagggctcccttctcctgcacaatgagttctagagagagagttaatggaaacatcccacccattgctcacactcgttcattttacagctaattcctgggtgcctactgatgccaagaggagaaagctaagacaccgcctgtccctcccattgcagagcttgcagtatacccttcattattacttaagatacttttttctctttacctcaacatggcactaaagatacttttccgtggtaacatttttaagagaaagtcaccttttaagggaaggcaatagcctgtgacctactgggctgtgttttcttcatatataaaatgagaatattaataatagtttcacagggtcgaaataatacatagaaacaataagcgcagtgcctggcacatatggtgagctctcttcttattttggtatcttcttcttgtatcttcttcttgttgcctcccgtgatggagtgccagaaggcatggaggaagaagaaaaaattaagatcccaaacaagataacagactctcttgatcaccaggattaataagcctgctgacttcactgtccagagcatccacatccataattagtattctccagcagctttagaggcgtgcatgggaactcctcagaaggaaataagagaaatgtagcttagggagaaagtcctgtaggaaattaaagtgaaaaagggggaagaggaaataaatacacaggctgatagcagctggttcactaaaaatctctttattctttgaacaatcaagagagtaggtgtggctgggcgtggtggctcatgcctgtaatcctaacaatttgggaggctgagacaggcagatcacttgagctcaggagttcaagaccagcctgggcaacacggcaaaacttcatttctactaaaaatacaaaaaaaaaataataatgtgtgtggtggtgtaggcctttgagaggctgaggtgggaggattgcgtgagtccagggggtggaggttgcagtggcctgagatcgcaccattgcaccccaccttggataacagaaccagaccttgttgtgaaaaaaagagagtgggctaggcgaggtggctcacatctgtaatcccagcactttgggagaccgaggcggacagatcacctgaggtcaggagttctagaccagcctggccaacgtggcaaaaccccatctctactaaaaatacaaaaatgagccaggtatgctggtgggcaccagtaatcccggctactcaggaggctaagacaggagaattgcttgaacccaagaagcggagggtgcagtgagctgagatcgtgccattgcactccagcctgggtgacagagtgagactcggtctcaaaaaaaaaaaaagaaaagagagtggatatggacagtgaccttcttaccttcaggttctcaaatcagagacaaagaaattaatttctcagagcgagagtgttcatttttcatgagtttagtcaaagttgtaattttttttttttttttttgagacagagtcttgcttttttcgctcaggctggagtgcagtggtgcgatctcagcaacctccacctcctgggttcaagcgatcctcctgcctcagcctcccgagtagctgcaattacaggcgttcgccaccacgctccactaacttttgtatttttagtagagatggggtttcaccatgttggccaggctggtctcgaactcctgacctcgtgatccgcccacctcggcctcccacagtgctggggttataggcgtgagccaccgcgcctggcccaaagttgtatttttttttttttttttttttgagacagagtctcgcggtcacccaggttggaatgcagtggtgtgatctcggctcacagcaagctccacctctcgggttcatgccattctcctgcctcagtctcctgtgtagctaggactatacaggcgcccaccaccatgcctggctaacttttttgtatttttagtagagacggggtttcaccatgttagccaggatggtctcgatctcctgacctcgtgatctgcccacctcagcctcccaaagtgctgggattacaggcgtgagccaccgcgcccagccaaagttgtaattttttaatgattatgttcttactgctcaataagagcttatcatggatcccaaggtgcacccccaagtttaatggccactggtaaaggcctggtcccccagtgagcccagcctgttgccctctttcctgcccactgagctctgtctgcagcctgacctgcctccacacattcagatgggaaatattatacagataagtcataggactctccctctctctttttttttttttttttgagatggagttttgctcttgttgcccaggctggagtgcagtggcacaatcttggctcactgcaaccttcccaggttcaagtgattctcctgcctcagccttcccagtagctgggattacaagcatgtgccacaacacctggctaatttttgtatttttagtagagatggggtttcaccatgttggccagcctggtctcaaactactgacttcaggttatcctcctaccttggcctcccaaagctctggaattacaggcatgagccaccgtgcctggcctggactctctcttaaaggagttaaggccatatgtttttacatttttaatttgcaaagctatgctggtcagtccttagaggtggtatatcaaggctgtagctgtattaaggtaaaatttgtttctctttcgaggtccctaatcactacttcctaattttgatcagtttgttgtaaaactcattttttatgcactgtgataattgggagagtggattaggaaaagacttgtatttgtttttgtttttgttgttttctcctcggaatgaatcgagcttcggtaatgttaaaatttaaaaataggctggaggccaggtgcagtgcctcacacctgtcatcccagcagtttgggaggccgaggccagaggattgcttgagccaggagattgaggctgcagtgagccatgattgtgccactgaacttcagcctggataacagagcaagaccctgtctctttaaaaaagaaagaaagaagaaaagaaaatagaatgttttccagagcacaagattgaagacagttgttagaactcctggattttctttttcttttttttttttttgagatagagtctagctctgtcgcccaggctggagtgcagtggcataatcttggctcactgcaacctccacctcctgggttcaagcaattctcctgcctcagcctcccgagtagctgggattacaggtgcccgccaccacgcccagctaatttttgtatttttagtagagacggggtttcactggattggccagactggtctcgaactcctgacctcatgatccacccacctcggcctcagttttttatgtcgtttcttagagttagtttcttctggttcaggtgaagaacactttatcttccttatcagaacaattttttactcctaccaaggccgcccggcgtgtgtggtgtggtggtgtgcgcctgtaatcccagctactccagaggctgaggcaggagaatcacttaaacctgggaggcaggggttgcagtgaactgagatcacaccactgcactccagcctgggcaacaagagtgaaactccatctctcaaaaaaaagaaaaaaaaaaaagaaaaggataggattgaaataaagatggccttcatcccaagaatccattgtaataatacagggaccatatcattaaaatatatagactatatactggctttcttttttattattattatttttctttaatagagatggggtctcactgtgttgcccaggctggtttaaaactcctgagctcaagcaatcctcctgcctcaacctcccaaagtgctgggattacaggcatgaaccactgtgcccagccactggctttcttttttcctgttttcttatgcttccaaaatctttatttggcttcaaggaactagataatcccaaatctatacctagtaatattattagtacagtttacccagccccatgtgattgggcacaaagcccagtacctgatttatggggccaagtggcattgggaactgcttcccaatgaacctacagtggagtaggtccctttagacttgcttttcattcttagcttagaaaacctcatatagggcttcctaagggaaaccatcatgccgtggtttcactctgaaattaaaaacatctccgaattttgtagcaggctaacttatggagcatattctggttcattgccttgcttagtaccagctcaagaagcaccagccgcatagcttccccaacgaatctggagcctagaaactggatactggacactcgaacagttctactcaggaaacattgggaattcgcagtgatgacttcctagtcctaacttaagtctccaccgtaggtgtatgttatttctgcagacaagcatatcactgtgttttagcagcttttatgcttggacaaacacaggtgaaggacctgcttagcaattgcatgttcattgtttaattccccgaagaaccctctgaaggaggaggtgatattagccctgttatatagataaggaatttacattcaaaaaagatgagttaaatatgtcctactatgtacctaaaaaaattaaaaattaaaatttttgaaacgacttatttatgatcacacagcttataagtggcagaattagacctccagaaagttaaacccaagtttcaatccttttgtatacatttatgcatgatgattgggtttttaccatcacatgtggtgagatgtgtctccctcaaacttgttatcacgtcagcatgtgatcagtctgacatggggaaaaaccccatcttctgactccaaatccaaggctgtttcacccccaacttttccttaacaaagaggcataaggtgcttgatttactgtggggactttcctgattcctgtgggccttggggaaaatccctgcctttcctgggctttagcttccccgttagtgaaacaggtctgataacacctctcccttcccactcttagggatgcatggggtcaaagaagtgatggattggaaagattatttgaaaacgctttgtaaacatgaggcattagattattactttcacaaatgttagcttctttagatttctgggcaatttcctttggttttattggaagaaatgtggtggaatttggatttttaaaaataatatttataacagcaatttcttgccatattaccacattgaactcaaatcctggaatttcccaaaaccacttaaaaattaattctggtcaagcagacagtttgtactcaaagcagtaaactggatccttgctcattaaaccagtctagactcccaggttgatgtgtcacattttgctccctacctttaaacagatataatcattgtggtcttgtggatttctcaagcgagctccttcaccctcccctctttcccttccttccataactcaggcttatatttagtattgagcttagttgcataagttcctacaggaataaggatctaagcccccatggctactctgttttcaaggcctcctagcagcctctgatgaaccaactgcaggcaccaggcctcccagtggcactgcccagttgtcccagtgtggtaacagtcctccagcctaaagatggcatcagcagagcagggtgtcattagtgaaaagcttctctacagtagaggccagttcaagaaactctagatatggtcccttggcagccttctgcaaagggtggaagggaacagcccctgaagagggtctagggaggcatctgaatttgaagggggtgggctctgtcagaacggtcagcagggctgcattgccacagctcccagggttctgtcattgacgtgcatgccccaaccttggtgccacctgtgtcactcacagagtctgatggttttgattaattttgttattcctactactgaaggcaactgatgagaagttaagacttagaagttcagaggagccaggtgctgtggtgtgtacctgtaatcccagctactcaggaggctgaggcaggaggatcacttgagcccaggagtccgagaccagcctggacaacatagcaagacccggtctcaaaaaaaaaaaaaaaagttcagaggagtctcatatgattgtgtactacaacagggataatttcgtatccaaggtttctggtgtttcagaaacagacacatgttgcctgcctgccggcgtctgagaggaaaccagtctatgctctttttttttttttttgagacagtgtctcactctgtcccccaggctggagtgcagtggcacggtctcggctcactgcaagctctgcctcccaggttcacgccattctcccgcgtcagcctcctgagtagctgggactacaggtgcctgccaccacgcccggctaatttttttgtatttttagtagagacagggtttcaccttgttagccaggatggtcttgatctcctgacctcgtgatccaaccgcctcagcctcccaaagtgctgggattacaggcgtgagccaccacacccagcctagtctctgctcttaaaggaagggccacagagcagcaagatgagtgttcccattactgacccccagaatcatgggaggagagcacaaacctctttcagatgaaacgatttaaactgagctttctggatggtaatagataattgatactctttcagcatctgcaagacattgtcctcaaagtgctggtgaaccatctgcccacaaatgacccccacatctcctaccctcagacctgttgagtgtaactaccttttccctttgttttctcagcattaataataagctacagcagccggaggcagcggccggagtgttagaatatgccatgaaacactttggagagctggtaagcacctcattctttttggaaaagcaggaggtagagacttggctagggagttattggccctgaccttcagaaagttactttccttttctgttttttctccaattcataacagtctgatgctgacttaccagtcttcaggatgaaagagataaactgtgtctgtagggactctatttctttcttttttttttttaattatactttaagttctagggtacatgtgcacaacgtgcaggtttgttacatatgtacacatgtgccatgttggtgtgctgcacccattaactcgtcatttacattaggaatatctcctaatgctatccctccccgctccccacactccacgacaggccccggtgtgtcatgttccccatcctgtgtccaggtgttctcattgttcagttcccacctatgagtgagaacatgcagtgtttggttttctgtctttgcgatagttcactgagaatgatggtttccagcttcatccatgtccctacaatggacatgaactcatccttttttatggctgcatagtattccatggtgtatatgtgccacattttcttaatccagtctatcattgatggacatttgggttggttccaagtctttgctattgtgaatagtgccgcaataaacctcatgtgtgcatgtgtctttatagcagcatgatttataatcctttgggtatatatccagtaatggtatggctgggttaaatggtatttctagttctagatccttgaggaatcgccacactgtcttccacaatggttgaactagtttacagtcccaccaacagtgtaacagtgttcctatttctccacatcctctccagcacctgttgtttcctgactttttaatgatcgtcattctaactggtgtgagatggtatctcattgtggttttgatttgcatttctctgatggccagtgatgagcattttttcatgtgtcttttggctgcataaatgtcttcttttgagaagtgtctgttcatctcctttgcccactttttgatggggttgtttgattttttcttgtaaatttgtttaagttctttgtagattctggatattagccctttgttagatgggtagattgcaaaaattttctcccattctgtaggttgcctgttcactctgatggtggtttcttttgctgtgcagaagctctttagtttaattagatcccatttgtcaattttggcttttgttgccattgcttttggtgttttagacgtgaagtccttgcccatgcctatgtcctgaatggtattgcctaggttttcttctagggtttttatggttttaggtctaacgttgttaagtctttaatccatcttgaattgatttttgtataagatgtaaggaagggatccagtttcagatttctacatatggctagccagttttcccagcaccatttattaaatagggaatccttcccccattgcttgtttttgtcaggtttgtcaaagatcagatgattgtagatgtgtggtattatttctgagggctctgttctgttccattggtctatatctctgttttggtaccagtaccatgctgtttggttactgtagccttgtagtataatttgaagtcaggtagcgtgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttctatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtattctgagactttgctgaagttgcttatcagcttaaggagattttgggctgagatgacggggttttctaaatatacaatcatgtcacctgcaaacagggacaatttgacttcctcttttcctaattgccttttatttctttctcctgcctgattgtcctggccagaacttccaacactttgttgaataggagtggtgagagagggcatccctgtcttgtgccagttttcaaagggaatgcttccagtttttgcccattcagtatgatattggctgtgggtttgtcataaatatctcttattattttgagatacgccccatcaatacctaatttattgagagtttttagcatgaagcgctgttgaattttcttgaaggccttttctgcatctgttgaggtagtcatggtttttgtctttggttctgtttatatgatggattacgtttattgatttgcatatgttgaaccagccttgcatcccagggatgaagcccacttgatcatggttgataagctttttgatgtgctgctggattcagtttgccagtattttattgaggatttttgcatcaatgttcatcagggatattggtctaaaattctcttgttttgttgtgtctctgccaggctttggtatcaggatgatgctggcctcataaaatgagttagggaagagtccctctttttctgtttattggaatagtttcagagggaaggaatggtaccagctcctctttgtaccactggtagaattcggctgtgaacctgtctagtcctggactttttttgtttggtaggctattaattattgcctcaatttcagagccagttattggtctattcagggattcaacttcctactggtttagtcttgggagggtgtatgtgtccaggaatttatccatttcttctagattttctagtttatttgtgttgaggtgtttatagtattctctgatggtagtttgtatttctgtgggatcggtggtgatatcccctttatcattttttatgtgcctttttgatatttgattcttctctctctctctcttttttttttttttttttttcaggcagagtcttactctgtcgcccaggctggagtgcagtggcatgatctcggctcactacaagctccgcctcccaggttcatgcaattctcctgcctcagcctcctgagtagctgggactacaggcgcccgccaccaagcccggctaattttttatagagatggggtttcaccgtgttagccaggatggtcttgatctcctgacctcgtgatccgcccacctcggcctcccaaagtgctgggattacaggcatgagccaccgcgcctagcctctcttttcttctttattagtcttgctagtggtctatcaattttgttgatctttttcaaaaaaccagctcctggattcattgattttttgaagggttttttgtgtctctgtctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctccacaccctgctttaaatgtatcccatagattctggtatgtggtgtctatgttctcattggtttcaaagaacatctttatttctgccttcatttcattatgtacccagtagtcattcaggagcaggttgttcagtttccatgtagttgagcggttttgaatgagtttcttaatcctgagttctagtttgattgcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtgtattaggtccacttggcgcagagctgagttcaattcctggatatccttgttaactttctgtcttgatctgtctaatgttgacagtggggtgttaaagtctcccattattactgtttgggagtctaagtctctttgtaggtctctaaggacttgctttatgaatctgggtgctcctgtactgggcgcatatatatttaggatagttagctcttcttgttgaattgatccctttatcattatatagttgccttctttgtctcttttgatctttgttggtttaaagtctgttttatcagagactaggattgcaacccctgctttttttttgttttccatttgcttggtagatcttcctccatccctttattttgagcctatgtgtgtgtctgcacgtgagatgggtctcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcggtttcttcctagcattgatggtctttacaatttggcatgtttttggagtggctggtaccggttgttcctttccatgtttagtgcttccttcaggagctcttgtaaggcaggcctggtggtgacaaaatctctcagcatttgcttgtctgtaaagtattttattcctccttcacttatgaagcttagtttggctggatatgaaattctgggttgaaaattcttctctttaagaatgttgaatattggcccccactctcttctggcttgtggagtttctgccaagagatccgctgttagtctgatgggcttccctttgtgggtaacccaacctttctctctggctgcccttaacattttttccttcatttcacctttggtgaatctgacaattatgtgccttggagttgctcttctcgagaagtatctttgtggctttctctgtatttcctgaatttgaatgttggcctgccttgctaggttggggaagttctcctggataatatcctgaagagtgttttccaacttggttctatttcactccccgtcactttcaggtacaccagtcagacgtagatttggtcttttcacatagtcccatatttcttggaggctttgtttgtttctttttattttttctctaaacttctcttctcgcttcatttcattcatttgatcttcagtcactgataccctttcttccagttgatcaaatcggctactgaagcttgtgcatgcatcacgtagttctcatgccatggttttcatctccatcaggtcatttaatgtcttctctacaccagttattctagttagccattcgtctcatcttttttcaaggtttttagcttctttgcgatgggtttgaacatcctcctttagcttggaaaagtttgatcatctgaagccttcttctttcaactcatcaaagttgttctccgtccagctttgttccgttgctggcaaagagctgcgttcctttggaggggaagaggcgctcttattttaagaatgttcagcttttctgctctggtttctccccatctttgtggttttatctgcctttggtctttgatgatggtgatgtccagatggggttttggtgtggatgtcctttctgtttgttagttttacttctaacagtcaggaccctcagctgcagttttgttggagtttgctggaggtccactccagaccccgtttgcctgggtatcaccagtggaggctgcagaacagcgaatattgcagagcagccaatgttgctgcctgatcgttcctctggaagcttcgtctcagaggggcacccagccgtgtgaggtgtcagtcggcccctactgggaggtgcctcccagttaggctactggggggtcagagacccacctgaggaggcagtctgtcgcctctcagatctcaaactctgttctgggagaaccactattgtcttcaaaggtgtcagacggggacatttaagtctgcagcagtttctgctgccttttgttcagctatgccctgcccctagaggtggagtctacagaggcaggcaggcctccttgagctgtggtgggctccacccagatctagcttcccggccactttgtttacctactcaagcctcagcaatggtgggcacccctccgccagcctcgttgcctacttgcagtttgatctcagactgctgtgctagcaatgagcaaggctccgtgggcgtgggaccctctgagccaggcacgggttataatctcctgatgtgccatttgctaagaccgttggaaaagcgcagttttagggtgggagtgacccgattttccaggtgccatctgtcacaacttcccttggctaggaaagggaattccctgaccccttgtgcttccggggtgaggtgatgcctcaccctgctttggcttacattccatgggctgcacccactgtcctgcacccactgtccgacaagccccagtgagatgaacccagtacctcaggtgaaatgcagaaatcacctgtcttctgttttgctcacactgggagctgtagactggagctgttcctattcggccatcttggaacctccgggactctatttcaactgagataaatcatgagggtagattcgaatatgcaataagcactgattttatcaaactcttagcatgtgcctggccctttgctaagtgtttatatacttcatgtaatttggtcctcacaacaatgctatgaagtggttactgctgttatcacattttacagatgaggagactgtggtcccagcaggttaagaactggtctgagctgacagagtgaataaatggcaaaaccaggacttgaaccagggcagtctgacattagagccaaggcatttgcccctgatctgagttatctttgtgggagcttgcattgtgtctaggccacagttaatcctcattagatacttaggaagacaccatggccagttctttagaaaatatatgctatacagccgggcgcagtggctcacgcctacaatcccagcactttgggaggccgagatgggcagatcacctgagatcaggagttcaagaccagcctgaccaacatggagaaaccccatctctactaaaaatacaaaattagcctggcatggtggtgcatacctgtaatcacagctactcgggaggctgaaacaggagaatcgcttgaacctgggaggcagaggttgcagtgagctgagattgttccattgcactccagcctgagcaacaagagcgaaactctgcctcaaaattaaataaataaataaataaataaataaataaataaataaataaataaatgctataattgatatctgacattgaggcatttttgtgttcgttattgcttacatagctacttccctactgccatctttggcctaccaatatttaaaatgtttctgttattctttgtggtcttggcagggcattttgataacttctaaaatacataaagcatcaacttaatcaacttagtattgaattcccggaaggtcaagaagctctaggtccatatatttgatgaggaaccttttgttagtcatgtaggttgcttactgtggtttgccttgatcaggagcccaggatgttaaagtgagaaaaattgggaatatttaacaggcttttgtttgatcatctagcattttgcctcacagaagggctagtaaattagaatgaaacgtttaagggaatcttttgccatctttagcacatattatcttttttttttttttgagacggagttttgctcttgttgcccaggctggagtgcaatggcacgatcttggttcactgcaacctctgtctcctgggttcaagcgattctcctgcctcagcctcccaagaagctgggattacaggcatgcaccaccacgctcagctaattttgtgtttttattagagacagggtttctccatgttgatcaggctagtctcaaactcccaacttcaggtgatcctcccacctcggcctcccaaagtgctgggattacaggcgtgagtcaccatgcccggccttagcacatattatctgtaactagactaagacagcatttctccagatgatggcaaagtgaaagaactgtatctcatccatccttgccacaatccttgtttgcagagagaagaaagtagggcgagagggcacttcatgtactccacctagatcaagatgttctctcctttgatatccttagagcttagatcccagaaagtgctgattgagacaaggactccgcagacatctggtattcaggtgatctgccagcagatggtttataccccatactcagaatgccagccttcaatgaaactttctccatcttcaggttccaaaggtggccattagctccaggattattgctaaacccgtggtggattttctgttatatttaggtagctgaatcatattaagcttgacaatggtttgctttttcttggcagagcctgtgctttctcagcaaaatttatgtaacagcaatctcattagaattttgtgtgattcattgcttaaaccttatagtttctgcaatctattgcaattcaaaatatcctaccctctaactgacccactccatatgctgccccctctcccctctgcttgttcatgctgagtgtatgccacacattagtcaccagctcttttttttttcttttccacccagtatagaaatttgaaatgagaaatctaccagtgcttttaaattttacagtttttgtagtcactcttttctaagtttcctattttgtatttaggcataatagatattattttggacaggcttgaaaaatgaagttgagatagtttgccttacgtggagccagatacgctcattttgacaaactccactgatgttgggcaaagactttatggcagcagaattagtctaggggcagcagagggcaccggctctgccagaaagaaccagaccagggaaagtaggtacaagggaacaatctccagcataaatgacctcttttcagaggttcaagaagaaaagattattttagacagcttagcagagtagttgttagtctacatactgcacaaacatcagttttatttagaaaggggaagagggtaatgggagaaactagtgtgggccctgcattatatcatacaaatttcactgcagaatcatattgttgttaaagaaatccctagagagccactacccttgcctgtgcaaaaatagtcatttattgagctgatgatgaagtagcccaggagagaaactgagatggagggcagacagaaagcatataaaacagtctcctgatcatttggagagtcatagtctgtaactttcagactgtagcacctcctactcacgtggacaacaccctctttcagcgtggcacaccatctgctagggtaatgcaatccctcctttggcccctgacactggtaaacctgccaagcactgagcaggagggaacattggatgggagactctagaagaataggggaaagactttccaaaaaattttaagtggtggtgttatattttaaattattatttcctgaaagtttaaaaatgtgttaagaaatgcagagaatcaagaggttttaaaaagtgagttgttttcctccagcaaacatgcagatgaggcctggtctttctggccccatcaggaaagcagctgccatccctgtcaagtagcccagtgtcagcactccagcagatcggagcgatggcacctttgaaacagctctggtgctctggtcgacgttttcttctatccctaaatgatttcccctgtcctcgtgtccgcacatcctggtgtgttctgatgacccatgtgtctgggaaggaaataatgggggaggagtatggcctgacgtctgctctcagataatcccaggatcattccatccatgtgccaaggaaccagtatttccaccttccccaagcagcactcctccagattgtctgaagttgtttttaatccaagcccagacgtaactgtgataggtgaagtgtcatgcgtacagcagcacattaggaaagagagtatgtggattaaacaatgtgatcccttcttctgtgtacctcacagcagtctttctttcccatgtaacaggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggtgagcttcctagaatgatggcatgtgtggctgcaagagacttcgtctctttgatctttggatttgaaaggaaggcttcccccacacggagttctcacttcagactcattttgttccacttgatacttctcaggaatcatctttcacttttggtgtttttctctctccattctatctcagctgctaagtaggaaggccttcacttaaactttataatgctctaggacaggacagccttgggggtgctcctgggatctacttctcctgtctactctcctgatctttactgacccagtgaagagctcatattcttacttggcaaccttgatttttaaaattagctcttgcagatgtttttaggaaagaagaacagtgactgccctcttcaggtgcttcacctatatcggatgcttactgtgtgtccagcactatgccaggctccaaggaaacaaaatacacaagaaaacaggcctttcctgtgaggttgatgagacagccacgtaaacagagggttattatagcctgagaggatgttgataatgtgtgagccatgctaccttgaaagcccaaaggaggaagcagggtgattttgcagtacttcctggaggaaggactgagagttaggagataggtaaaggagaaggtaggggggaaacaggtactccaggtgcaagcaacagtaatgcgtaactgagaacatttggctaggttttggtttggagagttgcttgggaatgttgaagggaaaaaatggcctccattctgtttccaacaacaagtgcaacttttaaaaaatagttaaaataaaatgctatactatcattgttaaactgtttaattgcagttttaaatgactaaaacaggccgggcacagtggctcacacctgtaatcccaaccctttgggaggccaaggcaggcagatcatttgaagtcaggagtttgagaccagcctggccaacatggcgaaacctcgtctccactaaaaataaacaattagttggacgtggtgttgcaggcctatgatcccagctactcgggaggctgaggcaggaggatcacttgaacccgggaggcggaggttgcagtgagctgagattgcaccactgcactccagcctgagtgacagagcgagactctatctcaaaaaaataaataaaaataaataaaaaataaatgactaaaacaaagttccatgctacctcccgactagtaggttatccctactttctctggaacatgatactgagggtccactgttccttcattcagccagtaactatcacgtgtgtattcattgctagtgtctgtgccaggccctagggacacagccgtgagcaagacagttacagcccctgccttcccagagcttacaggacagacaaccaggctgtcgtaatacattgtgataccatcaacaaaggagcccagggggctgtgggtaataggaagcaccctaatcagccttggaagataccgggaggaaacgatatctaacttggacctgtacaatgaggagcacagtatgggggattttagtaggcctttttgttcagattcttctctgtgaccccctgtcttcagaaataaggatgtacctttcctccaggtatagggaaggcatctctcacatgagggccttatgacctccttcaggggaaggtcaaaatatttttcctagatgttatgacctgcttcagggcataagggcaggggagagtcagagtaattttttttttgctgccattttcttaaaatattcagtatgccaaggtgtgctatatttcagggtagtatatcctgacccccatcacagggatgtacattgacggcaatgtgctgtttttaccattttgcactctgctgttttcacttaacaagtctaggccactgttccatatcagcacctgtagagctactgcctcatttttttaatagctgcatgatatttcatcatatcaataaatctagtctatttaatataggcaaatttttatttgtttagacatttcctgccttggaaagtttaagaatattggacaaaatcaaagcaagtcttctaaaagaatgatctttcactacatgtagtctttctgtactaccttagcctcccttgtagctgagactacaggcacacaccaccacagtgggctaattttttttattttttgtagagacggagtctcacagtgcagtctaggctggttttgaactcctggggttcaagcgatcctccctctttggccttccaaagtgctaggattacaggtgtgagccactgtgcacagccttcttttttttttttaagaggcaggactttaatctgtctctcagtggagtacagtggtgtgatcacagctcactgtggtcttgaactcctggactcaagcaatcctcccacctcagcctcctgagtagaaggaactacagaaatgcaccaccatgcctggctaatttttttaaattattttttgtagggatagggtctcattatgttgccaagtttggctgttatttcttaatataaagttattactacatccccaagatagaagatgttataatgttttgcatgaaaatttaatgttagtgaacttagccttaggcattggatcatatatatatatatagagagagagataatattccacaattatttgaaagtggcttgtctgatttaaccatcattaggaagatttttatttatttttatttttttatttataggaagtgttatttatttttataaattaacattaaaaggctgagtgtggtggctcacacctgtaatcccaaaactttgggaggctgaggcaggcggattgcttgagcccagaagtttgacactagcctgggcaacaacaacaacaacaaaaattccatgttcatttacctcaataaatttaggaagcatgtcttttcaaatccgctttatttatttatataactaaagctgttgttgttgttgttgttgttgttgttgtttttctcagtccaacaagtatctaaagctgtattgtccaatatggtagcctctagccacatgtggcttttttttttttttttttttttttttttttttttgagacagagtctcactctgtcacccaggctggagtgcagtgctgtgatttcggctcactgcaaccttcacctcccagggtcaagtgattttcctgccccagcctcctgagtagctgggattacaggcatgcaccaccactcccggctgatttttgtatttttaatggagatggggtttcgccatgttggccaggctggtcttgaactcccaacctcaagaaatccacctgcctcagcctctcaaaggtctaggattacgggtgtgagccactgcatccggccttatggctatttttaaattaaataaaatgtgaaattcagttcctcagtcataccacattttaggtgttcagtagccacatgtggccagtggctgctgtattggacagtgcacatagagaacttttccatcatcacagaaagctctattggacaacactgatctaaggcaaaagaaaagtatgttaataagaattattcacattatttcaaaaacaatttttctagtttcatatcagctgtcatacaatcatatcttgttatgagaaagataaaacgagatggaagtgttcttaaaattcaactctaatcaattcctaaaatactgcaatgtttcactgttgccattggatttacatataaatatcacagcctggcattcaaagtctttcctattatggcaccagcccgcttcttcagcacatttctctgtgaacccttctctcataatctgagctctggccaaattattcactcttctccaagtcctacattcattcgttccattctttgaattgccctcttcttctgcctctttttctacttttgaaatcctctccactgtttcttccctcttgaaacctctcctggccccttccccttccactcctctcctttcacattaaagatgaccacttttcctagctgggttagtaggagcagattggatacattggaagagacttgagatgtggtttcctccaattcctttgtgttatagttgaagaaactgaggctcacagaagttgagaaaaccgagctgagtgatatcgatctcctgatgttgccgttctcagtcccaaatacctctgacctcttgggttctttcccgttttatagttacccataaagcgtaagtggctagtaatgctgaccaaaggatttaagaatgtgggagactaaaagaggttttaaaacgagtcgaaagaagcagaatatttttcctgatcatatgcaggtttctgatacggtttattcagtcaattctgtttagagtgcaatttctaaatttcttttgtgtgcgtatatcctgaatatgcctgaggcagatgttcatcagaggtgacatgaagaatgatctggagttaacagtgagctgagacccttcccatttccccattcttatctgcctccaggaggctgtgagagctaggcaacccgcaccccctgccctgcccagccctatggtgcaggcagccacgcctgcagccaaagtgaactaaagtgaaccccctcctcaaactgttccccacacagctaggtattgagaacagattcctcgggagtgagatcataggccctcaaccctaagaggagccatggagccattccaaatgaaagaatacttcctaagctttttatttgttttaaatcttcagggaccatgctatcttctctgtatcgttccaattttagtatatgtgctgccaaagcaagcactttctgcgttttttgccagaacgctaggtgagaaaatcaaagtctcagagggtgcaccttttacccagtcctccctatgtgtagtgaaaggtatcagaaaaacatatcctagttgttgccccataaacaatctcatgttttttatttatttggttttgcccctcacccaaccgcccttgagaggtaggactcggtatattctgcattattttttgtaacaaatgtttgtggaagagcaatgctcttgtctgtgtactgaccaagctctgacagctgttcccacacagctgcatggtgaaggccgtgcgaagttcactgctagggcttgcccttctgagttgctgttcctacattgctccctgctttgtctcttggggtaacaatttgtgggatttcagcactgaacttgcttcctgctctagatgaaaagaaaaactacatccttggtcctgtggcacagaatcagctgatcctgaaaaaataatagagggaggctgagttaggagggacagcttgcatgaaggatgcattcatccaagttgcttgtgttcaccagctgtaaattttgaactatagggttggaaggaccatttggagatcatgcagctttctcttctacctctagtcaggatccctacaaaaatatgctgtgcagatgagctgtgcctctgctttaagccagtggttctcaaactgtgacccctggtccagcagttttggcgtcacatagaaacttgttacaaatgcacattctcagcccctatcccagcactactgagtcagaaactcagagggtggagcccagccatctgaaggagccttccaggggattctgatgcacttagtagtttgagaactactgctctaagggaacccctagcagggcccaggagtgaagatttctaagtctcggtggcagaaaaccaacacagaggtttatcctgttcccttaatggagcttcagtaaatgcatagggcatcatggccaccagttcctctttttggtctcagctctgtattgagccagagtgcttgtgtccctggttttcttgatcatgtgccagagagacaacaaagttaatatctgctgtactgcgatgctggataatggccctgagtacctctcctagacgtggtccacagtcagcttcttggtgagctcagcctagattccttctgcagggattgacttcagcatctttatccccgccctcctacaccaccttagagcgcagagcagctcatgttccatgaggcttctgacctgggccacttagaacttgtgcccttcctcatgactccacctccagtgccaagttaaatcatcctgcagcatgtctttcagaaagcaggaaaaattaaggagtctcctagctgcatcttgaagctcacatgaaatcagggactcggatttgcataatagccgagtttattttttttcactgagaagcgaaacatgagagggagtttcaacagtcaatagcaagaccctattctagggcttccatgttctcttttgtttattggggtgtcttaagcaccatttatatctcaatatctcatagtcctccttcacattcagcaattgtgcaaaattctgagaataagcagcatctagccttctggtagatgtgaccattgtggagcctttcttctgtacagattgatttcatctgggtttcatttcagactgaaaccattggtataatacttttaggagccagttctccctatagctttgagcccaaaatgaatgtccagatgcgtctcttcagattgctttctctgtaggcctgccaaagggaaagagcccagaattctttggcataggagagaagttatttaatatttatgaagggagccagatgttcaggacatttcatatcacagagttaggcatggttcctatccttgataaactcacccagaaaaattacgagcaccgggtcatagaaacaacaaatagcccattgattctctattatgtgacctagtagaatgtgcttttttattaaaggtgtccagttcctgtgtagtcctcacctaacccaaggggcaggagaggaagattggtagtttaaggagatttggattaatctgactatataattcattttcttcaggggtcaactccaccagcagtgctgtgaaaagtggaccctggttaatgatgagacccaagccaagatggcccggatggctgctgcagctgcatggggtttaggtaaagcttccctcacaggcaccctgtgaaggatggggtgagtgaggctaggggctcgcatcagaagagtaaggtgctggctctaggtggagatccaggtctatggaagggtaaaaatggtctgtatccacctacttctacaccttccatctgtcctttctacctgatgatttttattaacttgttagacatggggaaaattggatcttcgtggggaggccaaggaaaacggtgcacaaaatcaaaattgagatttagtgggtgagaaatacacacttagcacactcacacagagtactgatgccagatgcttttccccatacaccaagccattgtcagcagacaccagtggggtgtcaagtagttcatttctgaccctatctacttggaaatagcatcagatcccacaggttaagggctcgtcccaaaatatcgccccacttcagatgccaatcacaagttccaggttgtgatttgtgtttctcactgaccagctgtaaatcagggttcccataaccctcctcctcaggtttgataatttgccaggacagcgcacagaacaaaaggagacactttacttacatttacttgtttattataaagggtattataaaagatagaggtgaacaggtacaatgagggaaggtctagaagggtctggagtgcagaagcttctgtcctgtggtactggggtttaccttcaccctcccagcaccttcatcaacctggaagctcattgttcaagagtttttattgcctttcattttcaacctcttcacctttcctggatgtcagtggacagggctgaaagttcaaacccgataattacttggtctttctggtaaccagccccatcctggaaggggagaaggagggagagacaacataaggcaaagtttaagtcacatgctactcaaagaaccaatctctttggcaataggtttggatattctgtaaggttagtggggtcatacacctacacattcagcagggtactagggtatgcatctctgtgtctccatttacctcttcagttgaaagcagaaataagagatgagaaggctgggtgtggtgactcacacctgtaatcccagcactctgtgaggcttgggcaggaggatcacttgagcctgggagtttgaaatcagcctgggcaacatagtgacactccgtctctaccaattatatatatatatatacacacacacacacacataattttttttttttgacatggagtctcgctctgtcacccaggctggagtgcagtggcacgatctcggctcactgcaacctccgcctcccgggttcaagcaattctctgcctcagccctccgagtagctgggattccaggcactgccaccacgcccggctaatttttctatttttagtagagacggggtttcaccatgttggccaggctggtcttgaactcctgatctcgtgatccatcctcctcggcctcccaaagtgctggaattacaggtgtgagccacagcgcctggccctaatttttttgttttaaagagagatgaggagaagtctctttaggttcctgcatccagctatgcctaaagtcataaagtcatctctataattggccttctcaataaataaattttttcttaaaccattctaccttatcagcataatcaataggggctcattatgaataataaggaacactcctatcactcaggaaatgcagagggttttcgatagctctataccaggcactagggacaaagaccaaacatatttcttcttataccacagtaggatttggctttggttgcctaaagcaagttactgatttattttcctctcttataaatgaaatctagaggtaggcgtttccagactagtattttggctctattatcattagcctttttccagatttctgctttgcatgctcagcctgtgcctccattttaaagttcacctcatgatctagcatggttgctggagctccccatgtcatgtttttatcccaagcaggagtaaagggagaggacagttgtctatctccttttgttaatatttcttaacttatattttagaagtttcccaatatatataacagtgaagattatagtataatgaacccccatctgcccttcaccttttccagcaattacaaacattttcaccatttattgtctctattctcctctttgctgcccaattcttacccacctcactcctactcccagagttaaagcagagatttcttttcaatccctgcagacatgtcaatttctgacactgggccccagctaagaggattatcaatatgtgttccagagatggtcttgataagaagggagaggatatgtagagtgtccctggtgaaaagcttcacctgtggagcccagaggaaagttacataaccctctacctccattctcttcttctgtccctcttgagtcacagagcttataccttttcctttcatgagctctgggctagatccggaacatttttcaaaaacaaattgcttcctgaggagtcattgttagctatttgcttgtgcccagaggcatagagaatggatgagccgatggtctggagtgagaggcaggaaaatgccttgtaaaattggcagccctgtagtttgcagctaatgaagctgatatcttttctgcagatggtcttggaaatcctggcatttgatacatactcaccccaccaggagaagtgaatacctcttcccggatgcagctatttcccctgtctaatatgacacagagagcactgtgctgtgacctagcccatctttttgttataatggagtcgcttaaaatatttatctcctccctcctgaggcaaagatattgccagaatgaaatgggcaagctatttgtctaatcctgtcccctatcatctgtgtaatggctattttcaattgtttggaggaaaatgtaatttcccaacataccattgaactgtgagctgtctcagtagtaaggaagaaagcaattttgttgcacctggagaaacctgagagagttctctaggataatgaggtgctgcattcagcccacttgatgtgcagacttcacactcatgcacttcccctcatctgtcaagatgctccctgggcagccatggagtcctgtgtttggaagacagatgtggctttttttgttacgtcaacctgcatagtgtgtataggggctctgcaggattttggtacatgaggctcaagtttatttgtcttgtttatatcccaagctaaaggaaaataacagtggcaagacctatttgagatgctgcctttagcccaaccagccaacccccttgatgctttctgtctatgtgtgtgtgtataggtcagtgggacagcatggaagaatacacctgtatgatccctcgggacacccatgatggggcattttatagagctgtgctggcactgcatcaggacctcttctccttggcacaacaggtaaaaacctacatgcacccagatctctcagtgaggaaaagattgtagtgcttctaagcccacggtgctttggtaaagaagctgttgtacttcaggtctgatgtttactcggctctgtgagtacatttgaatggttttgattcattgtactcagaagactgccagcaggtcagctggggctacttattgttctgagggggacaaatgtgttctggaagctactgtctcggttgcttttggagttagcttgttgggtcatcattgtatcccttgttgtagagagaagctgtatttcaccaaaaggtaggattcagagagccagcagtctcactgtgcagcagaaatcagtcacaagggtcttctggccatgcaggcatgtcacacattgattaccttccgaggaagctagtacttacttgcaaatagtatgctgacttgcagaatgaaataatgaagtaatcccatccaccctgtcagacacgagacttagatgaggtgcccgggtaaatgatctgagcacttaaggcattgggacactataattaaccttaaacattcaaaaacgggaaaagctctgcatgaggggtttttaattgatggcacagaggaaactcaaactgcagtgctgtggcgtcccccaggctgtcatttgtgtgatgagaaccaagatcttggttgtctctgtcagagacacaagagttcccgttcatgtggacaggattgggcatctctgccaattttagagacactccctcataaggacagagggtgcttggaagccagagctaccacctggagccattgaagtgtgtgcagaatctattttcataaacatgcccagcaagaaaaagttaaaagagggtagatccccaggctgggcacagtggctcacacctgtaatcgcagcactttgggaggccgaggcagacggatcacttgagaccaggagttcaagaccagcctgcccaacatggtgaaaccctatctctactaaaaatacaaaaattagctgggcgtggtggcgggcgcctgtaaccccagcatcccagctacttgggaggctgaggcaagagaatcgcttgaaccaacatggagaaaccctatctctactaaaaatacaaaaattagctgggcgtggtggcgggcgcctgtaaccccagcatcccagctacttgggaggctgaggcaagagaatcacttgaacccgggaggtggagactgcagtgagccaagatcacaccactgcactccagcctgggtgacagagtgagactgtgtctcagaagaaaaaaaaaaggtagatccccagttatgtcctcttgagatgcaagaacccatgattcggttttacagcccacattcccatgcccttgccacctaagattttgtgtgttaccttagatagatgttaaagttttggatgccatacatttctgtcttcgatgagaaattggataatacctcctctcaagccattcagttctgggaaaatgcccttcttcagcgaatttctcttttcatccctggaatttaagtgagacagataacttctgtagctagttggggtgccctaaaataaccctaagctcccaagtccagagctcagtcccaagggttgtttctcttctagtgcattgacaaggccagggacctgctggatgctgaattaactgcaatggcaggagagagttacagtcgggcatatggggtaagtgtcaactattctgcacattgtcatttttgaggcttatttccatacttttttcagaatgggctattgagaacttacaggctgctggaaacatgcctgttttctctgatcggcagataccctgacaccagaaggaatgatttaaattaatcctgtcttttggattgttcgtgcagtaattagtttggaatgcgatttgcttccatcaggccatggtttcttgccacatgctgtccgagctggaggaggttatccagtacaaacttgtccccgagcgacgagagatcatccgccagatctggtgggagagactgcaggtgagcttggtagaaagccccagttcacccacctacccctaccccttccaggacctgggtgagtgcccccctccaccctggctcttactcaacttgcttttcctgcctcctccaccagtgtattgcttggcttgcatacaaagcagaatactcaaaggctcctcacctaaacttaagctgtgagagaatgaccaattttccagtctcttcttattctcttctctaggaattaaaaaaaatgttttttagtaagtgacacctgtgaccagtcagttaggaatcataacctcaaaatcagtggttctcaaccttagcagcacagtagaatcacctgcagagctttttaaaatcctgatgcccaggctattccccaggccaattaaatttctggggagagactcaggatcagtatcttttcaggttcccccagatgattccaccagccaaagctaagaaccactgctctaactacacttggaggccacctgcaccagcttttcagatggggttgccttaggttctcattggccaactcctgctatttatagctacttaggtcagagtcatcctgtcgcctctattgagactttttttccactgcagtttccgcttgtagagaagaagctttcccaagtcctccatcagtgttttcattctcacattctgatcattttaacatgagaaactgtcactccaggtctgggagtcaggagtctaaatgttctgggaaggatggccagttatcccattccttgagtgggtaggataggaagttcatcagcaaaagaaaaaagagagaaagcctttaccactccagaaaccatttgtctccctacctatcataatccatccccgcaattataaaccatttcctctcaactagatccccacctaattgctaattccaaattctcgcttcagaccaatcgaagtttgtgcttccaggcgtctcagtaggctgcgacaaaaccttttgactccaaacacattcctgcctaggaagctcagggcacattcccctggacaggaaagagcaatgggcaaaggaacatctatgaatacagtcatttatggctctgaaatgagcacatacagttcttttacatgttttattagtaattatgaaatgcccagtgaatgttttgatggaaaattgtctcctgggcaccagaaagaattccacaaataagcatttcccacttgatttgtacacaccccaattctttgaaatgcctataataaagagtttctacagcagagatctgatgaaccttctgacagtctgacaagtgggacttgatccaaatgtagacttagaggagaggggaggcatggaatgagtcctgggaagagagatgcctgtctgactttactgggtccaggacactgccaccaccttaagccttcgtgactttcctatcttgaggcagcaagatgctttttggcttacaggaggccaaattatttcagcatctgggagaacctaactattggtgagaagtcacaaaaaacaatcactcagtgtacttttttctgttattttaactttcgaaatcattgttgtcacacttcatgggatggaaaaatgtggtccaaggcctgaaagtaaagcattacatttatagtggaaatttggctcttgtggatggcttgctgtcaaatgaactgctggggctagaaaactgccattttgtggtcaaatcatttaaattaaaatccccaaccagtattatagtagtggaaaaatacatgtttgttacttttctttggagttgcaccaatgcttttggttcctaagaccctcccatagggcagttagagaggtcagccttactggcgctgggtctcttctagccttgggttctccagtcaggctcagactgcatcttatcatagctaaaagcctgagatcattgtcgctagacttttaagtttatctccatggaggacagctccatgggttcatggaatttaccatgaagcagtagatctcaggaactccccttctgagtctgacttcttatcaacaaggatgaaaaaggagttcacttggccaggcatggtggctcacacctgtaatcccagcactttgggaggctgaggcaggtggattgcttgaggtcaggagtttgagacttagcctggccaacatagagaaaccccctctctgctaaaagaaaaaaatacaaaaattagccaggcgtggtggcgcacacctgtaatcccagctccttgggaggctgaggcaggagaatcgcttggacctgggaggcagaggttgcagtgagccaagattgcgccactgcactccagcctgagggacagaatgatactccatctccaaaaaaaaaggagttctgcctgcttctgctcccaaagttctgggattacaggcatgagccaccatgcctggccttctgatacattttaacttccctgcaagccacagccaaatccactgtgaaacacaacggagatttgctgatagaatctcaggttaagggtactgtgagtgaaatacccttaggcagccgtccccaacctgactctctatagttgttagatgtaaaattagcttaagcccctttgataattaattcacttttttattattttattttatttatttatttatttatttatttttgagacggagtctcgctgagtcccccagtctggagtgcagtggcacgatctcggcttactgcaagctccgcctcccaagttcacgccattcttctgcctcagcctcctgagtagctgggactacaggcgcccaccaccacgcctggctaattttttttttattattttttttattttttagtagagacggggtttcaccgtattagccaggatgatctcgatctcctgaccttgtgatccccccacctcagcctcccaaagtgctgggattacaggcatgagccaccgtgccccgccttttttcttttttttttttaattataaagaatttgtggccaggcacagtggctcatgcctgtaatcccagccctttaggaggccgaggtgggtggattgcttgaggtcaggagttcaagaccaggctggccaacatagcaaaaccccgtatctactaaaaatacaaaaattagccaggcatggtggcacacacctgtagttccagctactcaggaggctgaggcagaagaatcgcttgaaccttggaggcagaggttgcagtgagccgagaccgagccactgcactccagcctgggagacaagaacgatcccacctgtaatcccagcacattgggaggctgaggcaggcagatagcttaagcccaggagtttgagaccggccttggcaatgtggcaaaaccccatctcttcaaaaaatacaaaaattagccagatgtgatgtgcgcccatagtcccagctactcaggaggttgaggcgggaggatcgcttgaacctgggaggttgaggctgcagtgagccatgattgcaccactttactccagcctgggtgacagagtgagaccctatcaaaaaaaaagaaagaagaatttctaagtgtaactaaatgaagcatttccccttctgtgtatactttttgatctgagactagtagaaatgaagaagaaagaatctaagatgccaacatacatggcatctcaacagtctttttttttttttttttcagaagtcttaatggaggtttaggctttaataacttcagaaatataaatgctaccaacttaaaaacaatgtcacttcaaaaatttttaaacttctttacatttaattcatttttcaactttgaatgatacattttaaatttaatatctttatcagtgatagtcatcttcaaccagaaagactgaaacaaaattttaaagttgaagatgtattatgtgttattcaccattcacaaaataaattgaaatcaatcatttaatttatttaatcctcaccgtatccctatgaaactggtactatttttattccaccctacagatctgtcagaggttaagtgatttgcccaaagtcacatagggtagcaagtgacagaggcaggattcaagctccaaacccatgctataccatctctcaaactgctgagacgcccctaagggcaggggtccccagacccggggccggggaccggtgagtagcctgttaggaaccgggaggcacagcaggaggtgagggatgggcaagctccacctcctgtcagatcggcagccacattggattctcacaggagcatgaaccgtattatgaactgcgcatgcaagggatccaggttgcatgctccttatgagaatctaatgcctgatgatcatctgaaaaccatccccccgccccccacccaatctgtggaataattgtcttccacaaaactagtccctggtgccaaaaaggttggggactgctgcctaagggtatttcactcacagtacccttaacctgagaaagctgagattctatcagcaaatctctgttgtgtttcacagtggaattggctgtggcttgcagggaagttaaaatgtatcagaaggccaggcatggtggctcgtgcctgtaatcccagaactttgggagccgaagcaggcagatcagttaaggtcaggagttcgagagcagccttgccatcatggtgaaacaccatctctattaaaaatacaagaaaaggccgggcgtgctggctcacgcctgtaatcccagcactttgggaggccaagacggttggatcacgaggtcaggaattcaagaccagcctggccaagatgctgaaaccccgtctctactaaaaatacaaaacttagccaggcatgatggcacacgcctgtaatccccgctactcgggaggctgaggcaggagaattgcttgaacccgggaggcagaggttgcagtgagccaagattgcaccactgcactccagcctgggcgacagagcaagactctgccacaaaaacaatgtatcagaagacatatctaatcttcacttctgaatgttccagggctgccagcgtatcgtagaggactggcagaaaatccttatggtgcggtcccttgtggtcagccctcatgaagacatgagaacctggctcaagtatgcaagcctgtgcggcaagagtggcaggctggtgagtgacaaccacccacccacatgggcaggtagggccccatggtgtccctgggctgtccagttctgtctataacccagtttctcttatttttaaggctcttgctcataaaactttagtgttgctcctgggagttgatccgtctcggcaacttgaccatcctctgccaacagttcaccctcaggtgacctatgcctacatgaaaaacatgtggaagagtgcccgcaaggtctgtatcccaatgcatccagaacagaccaccttctccagaatgctcgcctaatctgcttcgctctgcctctttaaggccagaaaagaaacagtgtttaaaccacctactcacaatgtcagggagtctcttcctgttacaaagctatttggcctgatttcatagagtgaatcatagttgaggagatggtgtgtataccattgatcaaaccaatgaatgtgatcacagttatatgtatttgtatctagaaagtgctgggacatagaaagggcacactttctacccctaagagaagatggactgtttggtacaaaaaagagcagatttgtaaatacacagactagaactttcacaagaccaatttgggtttttcagacctctgtctcctctcctgacatcagtttggattcaaaaggaataacatgcagggtataatgctgaaaccaggagggaaagttatcttgaagccaatgtagaattcttctgactttatgtacagacaagcccttgggaaatagatgtggctcctggtttgggggtttttttctttaaacaatctgcctggatgatgctgaggactaataaacagtaggccctggaggcaaagtcatcacctgctttggcttccccttcctccttcttaaaaggaagagggagtctcactagccttctctccccattgtgacccccacagtgaagtacctgagatgagagaggaataaaacccagccactggagcctctgctgtgggaagatctcataaaatagaagttgtgtttctgcagaaggcacacttaggagatctggggactgggtctagaaattgactaattttatacatgactgaatcagagtggctgtgaataccacccagagtgggatcagccagcctgtacccaggcacctggtctttgggatttactgcagtaccaatgacctaagtttccttcttcaaatatgcagcttggagattttatttgtttttttgttgttttgttttatttttcagtctctgtgagcctcccaggccagagcatttctgattcaaagcctgacctcctccaggcaaatgagaaaaacagaaggtgctggatctgagtatagtctggtttccctcctatgtatagcctccaagtctttgactgtcttgcctaaggcaggccgaagaagtcttttgggtaatatctcaagcaaggagtggcttctttcaacataagaccccagcccaacttctccatggaatagtctttcttagtagcccaaattctgtggaattaaaaatcaggaacctatttaaagtgctgggacttcaagcccagaactagagatgtcatatcttcatagttaaggagctacccaaggaaaactgactacttaataattgtgctactgagcaagacactcactgagccttactttcctccactgtaaacaagaatcatgctctgcctcgcctgaggcaaaggaaagtatttgtgggaaaagcagaccctgttatcctggaaggcatcaggctatgggtatatgtatcatgttttcctagacaagacacttcacagagtccagagacaggctggtccttctgtaaaatttcactgagccaaggccattgttcttgcccacaaacccacccatgcaatctagaaccagaatattgtgcctagctaaaatcctgtgggtctatgagaagccccttcttccaagtgacaggtccttcatttataagagggaaagaatcacttttcccttttttcatttcctggggatggagaaaacaaattttaaatagaaaatttccaattccttgaaaataagttgccttgtactatacagtagaaagatactggattctcttatgctggataaacgaaatattgggcttcaaatccaaacttaatacccagcctccccagctttggcagtttatattttgttcagctccttattaagtccaccaaagagtttaaacccagtgtctggattgttgatgacaggtagcttatgggctctgaaaagcacctaccatcagagttcctagtttagctcctacctgcgtgacgtatgcaatgatcacactgagttatcacctttttggcgattgagtttttttactaccgcctcccaattctttttttttttttttttttttttaatcagatttaagccaggtgtggtggctcacgcctatgatcccagcactttgggaggctgaggcaggcgaatcacttgaggtcaggagtttgagaccagcctggacaacatggtgaagcaccgtctctactaaaaatgcaaaaattagccgggtgtggtgatgcatacctgtactcccagctactcaggaagttgaggcgggagaatcgcttgaacctgggaggcagaggttgcagtgagccaagatcacgccactgcactccatcctgggtgacaagagcgaaactctgtttcaaaaaaaaaaaaaatcagatttaagactggtcaatgtagttctcctagaaaaaaaaaaaactaaagggtggttcacacctgtaatcccagcactttgggaggccgtggtgggaggattgcttgagcccaggaatttgagaccaacctgggcaacatagcaagacctcatctctactaaaaattaaaattaaaattaactgggcatggtggtgtgtgcctgtagtttcagctactgggaggctgaggtaggaggatcacttgagcaaaagtgttcaagtctgcagggagctatcattgcaccactgcactccagcctgggtaacagagtgagagaccctgtctctaaaggaataaaaatttaagttaaaaaaattaaaattaaaggaacatttatcacttcccaagtgtgggatgctattgtagttcatttttcaaagttggtggtgagtaatggatccctgtgaagacagatgtctgagggagacaggtgtcttgttaagtgttggaacatctgtgtgcctgccctgtcctcatgcatggattagctgcttgatcaattgtttgtcatgtcattctggctctgggttaacccagtctcttcatgccaattaattccttatattgaaaagcatctgaggttggtcctggcccccaagctagggagtttcattttcttcaaggccatcatcactaacatgttttttgtttgtttgtttgtttttttgagacagggtttcgctcttgtcacccaaactggagtgcagtggtgtgatctcggctcactgcaacctctgcctccaggttcaagcaattctcctgcctcagcctcctgagtagctgggattacaggcagccaccaccacgcccagctaatttttgtatttttagtagagacggggtttcaccatattggccaggctggtctcgaactcctgacctcaggtgatccacccaccttggcctcccaaagtgctgagattacaggcgtgagccaccacacccagccttttttcttttcttttttttttgagacagtctcactctgttgcccaggttggaatgcagtggcacgatcttggcccactacaacctccgcctcccgggttcaaacaattctcctgcctcagcctcccaaatagctgggattacaggcgcgccccaccacgcccggctaatttttgtatttttggtagagacaggtttcaccatgttggccaggctggtctggaactcctgacctcaggtgatccacccgcctcggcctcctaaagtgctgggattacaggtgtgagccactgcacctggctaacatgtttttatttaaaacaaacaaaaatacctcttatatgatttaccataaggagaactgttatttatctgaagtcttgattttttccttcttctgcagcacagaacacattgcctctttttcacattctctcatataatgtttcctttccctgtgttaatgcatttagattttgccatttttccatttgagcttttgatgtttgtacattctatctccatccttgaagccctttattattatttttttttctatttgtgggttttcccccctctagaaaaaccagaaaagatttgtttttccctttaaaagtgatatggaccgcacttatcaagatgctggttcaactggatgtggcgggcttgtacagtagtcccagatctgtgattctgtctctgcccttcctcagttcagctgtctgttcctgactcacatgccctctgctcactttgtatacaagccggtagtataaatagatctagctgctttaggatgctctggagattttgcccctaagtcaccctgttcaaccagatgtctgctgagctaatatcttctccctattccctgtgaatgcatgcgggttttcactccaaatctgtgttcttatttgggtgctatatgatttttaaatccatagtttttgctccgctggactgtccaaggtaccctggtgttgtaaacaaataccaaagttttattagcctgaaacaattcccaaaagcctaatatcccccagggtaacatattgatagtgaagtaagcagttgtttcaaattactttgtaggaatttttatttggggtagccaggcatgaaactttgccaaggcttataaaactggtaattatagttggcaaaggagagccaagacttgagttgaataagtcatgaatctttttgaaaagcccagtctctcccagtatcacgccctggtcctctgtcctatggggtcatcattctgtgctctagggtattctgtttggagaggggttgactcatgcctatcagatgaacggtagctcccttcctctgaagctgggccacaagccaagtggctctctgtgcctttgtcctgttacagatcgatgccttccagcacatgcagcattttgtccagaccatgcagcaacaggcccagcatgccatcgctactgaggaccagcagcataagcaggaactgcacaagctcatggcccggtgaggtccccactgacctggggcaagtcatattccagccctgtcatcccagcagcttctgcagcaaggaggagttcaaggcttcttgggtggctgattgctgacatctctctttccttttccagtagggatcccaggcaaccaccaaagcatactgctctcaaagtctctgccacttgctttcctaggttcagcagcccaagagcacccatgtgctgttctcctggcgtctggttttagagtccttgttttcaaatgtcagatatgctgcccctcccttttttttttttaagatggtcttgctgtgtcacccaggctagagtatagccttgatctcctgggcttaagcaatcctcccacctcagtttcccaagtagctataggcacgtgccaccacactggctagttttttgtagaaatgaggtctctacaaaagaacaggcatagagcctgcatttcctcctacaagtttaatgttgcccaggctggtctcaaactcctgtgctccagccagcctccctccacagccttccaaaatgctgggattataggtgtgggccactgtgccactctgtgctgcagatttgatatttgacttcagagaagtgacttaacctctctatgcctcagttaccaatataaaagggatagtaacagtttctatttcctagggtggtataaagtagtgtgaggattaatgcaaagagtacaatgccaagcatttcaagcagcacttggaatacagtagcagtcagtaaatgtgggctaatctcattacaaagaatggaggcaaagggaaaagtaagggagaagccatatagcaatcaataaagaagtaactctcaactgtcacccacaaaaaattgggtttggggtaggtaagtccatacagacctatctgtaccaggtacatggtttatgctgtcattgagagacaaaggtcaagatggaaagatggtatcttaaaaatgtattccaaaagcccatctcctttcttgcgtgtggctgaaaattttgctagctccttcacattgcctcttgagaataagaggaaataccagaagggcttcagtgtcccctaacaatttgtggtcctcttaggagggctgttttgaggagggaatgtcatgggggcttgtttctctgcttccagatgcttcctgaaacttggagagtggcagctgaatctacagggcatcaatgagagcacaatccccaaagtgctgcagtactacagcgccgccacagagcacgaccgcagctggtacaaggtgatcagaagcaggccacctgtgagacccagcaccctggctggctcgtgtcctcctgtgtgctcgtggttacagctgagcttctgcggagctaggctgatgctgtgaacttactccttgagtccctggagcctatctataagaggcccagggagcctgcatttccccctacaagtttaattaatacagaaagattattggagaaatacttgttacaccattattatgtgtatgtggtgttggggattgctgctgtcttacagactctgagctgcttgttttcctgggagcatctggacacatggttaatctctggagtgacatcttcccttaggtcatctgttcttgttcagcgtttttctgatttgcatccttgcctgctcctcagctaagaacttaactttctttgtttttattggaaagatccaagtaacatcctgttatgttacaggaaacttttgaaagagataaacagaattagaaaatatataaaagatgtgattgatggaggggtgatttttggaagtgtatatctttggtgagaatatactttcttatttctttttgagaggctttctggtaactacttggtgtggcagatgtcattgacatctttccagtatttccttggcttgccaatactttgtgaattaatctctctgaaatctaaacttgtatctgaggactgcagaagcacttataatacagatcttacctttgtttaggcatgcttcattctggtttgaaaaatgtccattttgtcataagagtaatactctctctaggacagcttgcatgtccaaagctggaaaatacatccggtaaacactattaactggaagcttattaatcagagttgtattctaaccagagttactttcattcattaagcttttaggaagtaagcaaatcacaagaaaaaagttggtttcaggaactttagttttagtttttaaaagcttttcctaatgtgggtcccttttgttttatgatgtattctaccatcaacgtcatggccctgtatgcatgccaggactgtttgtcttgttcaccttgaccccaggtcattgccaggcacatagcagatacacaagagatattcagtgaataaatgaaggtatgggaaaactgaaacctgggtcattgtagaattcttactcatcaagtaaaggttagttgtgatcaatctattctccttagttgagaaaacggatacacctgtgttcaaggtttttggcaaggcatacaaacgaatttcccaattattcagaaagttcagctattaatgggtcacgtagtgtcctactatcactgcaaagttaccatgcctggaagcaaactctgcctcacactcgctaaaccaagtggtggtacgctgtagagtcattgccgctcagaaccccagagagagtagtattcctttatccaaataagcaccagcggttcttccttcaagcattgagcactggttctctgtcaggccgtgggctaggtgttgggaccaggcagatgggtgagattctttctctgtcaggctcctatgctcttcatgtcttcctttgtccactatctggtgacctgtcaaaactttgctcccttgaaatattgtgatgactgctgcttgcccccacttctgcttgccatttctgctctcccctaaatgtacactttatacccagtgcagctctgctttctgggtgaaagtgccagccctgtgcctgctccaggcgtgctttgctggcctcgctctcactcctcgcctgcatgtatcccctgcacggtcacattcatgggcttgtttcccgtgaaccaatctgcacatctctggccttattcttcccccttgccaagtagtccccaccgctgccttcttgtttccctccttgcccttctgcagctctcttccagacctaccccaaatccctcttcttgacaaagctttccaaatgcctgtccttgctactcccattgtgccttgcagagtacctaggtcttcaggtttgtgcgtgagctcccctaggaggccgggagatcccttgaggcaagagctctctcctgctcctcttgctgtgcccttctcgcagtgcactcatagtacgttatatagttagtgctccacaaagtgagtggatcatgttgaatttagtaaaacagccatttctgagtgtctccttgaagtgtttgctttatggacacacagaacaggcaggagcagctgttcctcagcatcgaccttgcgctcctctgagccctgctgttggtcacagctccagtgtctgtccttgcctttctccccaaccaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggtacccttcccttcttccttattaacaaccaaccaaggtgccaggctctctgagaaatggaatcgttgttaagcttaaaaggaacctgaggctgtatctgaagtgccagatggagctggaaaatactgcctatctaccatccagcactgcctgagatagggctttgtgtgtgaatatttgtgtttggggagctgacgcagcctctatgctgaagagcaagctccttgtcaagcttccctgtggacgagctcattctctacgtgctgcacctgtgtgtgggtggctgtacacagctgcgggtccactctgaggatggggcttgggaggtccatcctctgcctttttctctccacttccacttcttccccttccccttgggctgtcagttcagaatgcgccagggccgctggcaggcccagagatccgggtgttcagagcctcagctccacctcctccctccatcctgttcaggaagccactgtcagcccaagataataacagttatgatacagttgccatttattgagtctttgctatgtgccaggtaatgattaaagatttttcatgcattaaccgatttaattgttataaccaccctttgaagtaggtacagttagtatgctcttatgcccattttacagatgagaaagcagaggcaagagtgtcgctaacacgtgtgtgttccaacaggatctgtccaaaaccctcctgatgtacacggtgcctgccgtccagggcttcttccgttccatctccttgtcacgaggcaacaacctccaggatacactcaggtatcagagaagggaaggatgcaactctggtaggccatgttaatggcaagacctagaagtcacacgtaaaagtcctctttcccttcctgaccctgatcaggacacccaagatcgatgtatgtgccttttttctgcactgcatttaaggagtaacagctgactgggccccacctgtgtgggtgaaacctacagagagtgaggaggagaagtggagtgagaactctccatgtgtggtttattatggagggattattaacccatctgttaatcacaatatttctttttttctgaccaccctgttgcctattgaagtcacagtatttctaaaatccctcagcaacttggagaggtctaaacaaatgactcaaatcagttaacccagagggtaaaggtgacaaggtccacatcctccttcatttgaggatctccagccagctaagagccaggtgtccctgttgcctctgccgtacagcgactcttacatgtgcagacttgtggctttctaaaggttatcctggctcgtctgtttgatgtttgcatacatgccatggtgacccctcggtgacctgggatgaaatgctcatttgctcagggtgactcttacggtgttcagtcaagagcactgccacccatcacagacacctgctcccatgggaggccaaacacatttgagagttactggttggagtccctgccagctctcttctcaggagccttagagatgaaaaacaggcaggcaaaaactgggaaactaaattttctgtgactttctcatttctttttcagagttctcaccttatggtttgattatggtcactggccagatgtcaatgaggccttagtggagggggtgaaagccatccagattgatacctggctacaggtgaggatacttggttacaggtgaaggtggctccaagtctctcttctgtgtgtctcctcttacaagcatgctgtgttcagtgtcacaaggcagtgtgtgttaatacagtgctaaggaagtagggctcggtcccagtgtcaagtgtccatattttctttattttcttttagaaactaaagggaagggaatgaaccatttcagagcatcaaccgaaacaagttaaaagaattgatctttgcctagaagaataactagttgtttcaagtctcatatgctacatactgtgtctttttgaataccaggttatacctcagctcattgcaagaattgatacgcccagacccttggtgggacgtctcattcaccagcttctcacagacattggtcggtaccacccccaggtatgtggagactctgggcagtttctcatctaaccactggtttggtggtcagcctttccaaaagctgccctggcgacacaagcgcaggaactgggagccatgtgttccatcctggcccaggagggtctgtccagccagccgtcccagagggcccgggagccttgctaaaaagaaagcgttccctcgaagactgagccccttcctggtagtctcaagcagatgttaatgtcacactcaccacttgttttgttattctccttaaaattcataccagctcttccccaacccacatttcctttatagatgtttcttctgtttttccctcaggccctcatctacccactgacagtggcttctaagtctaccacgacagcccggcacaatgcagccaacaagattctgaagaacatgtgtgagcacagcaacaccctggtccagcaggccatgatggtgggtcggagccactgtggggcttcatagaccctggtcccttagctggtgggcgcaagtgggattgtttttcttcctcgcattggtgctgtgcacttcctctgactgctggaaatagtacctcctgtgtctccaaaacagacctttctgaggttagctgattcttggtgcttctctccttcttctcttggcttcaggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggtatggggtaaaaaacacgaaaggacataaccctgtagaaatattctgccactaaaaaaaaatgaaatgagaaaagtttttatagaatgaaaggacgtgacccaaggcctttgtcagatttcttttcctctggcctttccactgactttaataaaacgagctctgatggaggtcacagagcataaaacatcagaaattagttacagggacccttctgaattttaactggaaaagcccaagatttctcaagaggtcatctcgtctctcctctcacccttccttccctataagccatgctgctggtttggaagctccagggttggaggcctgcacctatgctcttgctttctccagccccctgccagtgttttcaggccacagcgggctcctgaggaatatctgcagtcagcctggggattttgcctcctgggttggttgagactttgataacttgaaaacgtgcctgctttctctctcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcaggtaggatcttcaggctcctggcagggttaactgtcattatagtcctttctgttttactgtctatgaatgttctaacactcattccaaagcatctggttttacttctgctttgggacaagtaattgttattagcaatccactgaaaaatacttaaattgcgtttaaattcttccctggaggcagaacactaaatcctttggtaattatttacagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggtaaggaccattgtgcacttctgtcacccacttctccctcctacactggctgagaccccttccctcttctgaaattactgcttgccattcccactactcacctatcatagctacatctctcccatgctcattgagaggaaaatagagggcaagcaaatttctcattatgtcctcaggacttagttcattcatgtagttgggcttatgtgaagcatgatcacacataaagggaatgacaaaggcatgcaaggcagagaagtaacagtggaaggcaggtgttggagactgatgaggccagggaggaggcagctgggtgcaagcagggaaggtgctagctcctctgaaacgggggcttctggctcttgaaatttttttctttttttttttaccatcatagtctctgtggtaaatgattgtgtaaaatgaacaagtggattctcacagtgagatttgttaagcaagtgggctctggaatttcccttggggtagagtgttacttatgggggatgttttagtgaggcctgagtgctgtggtggcactttgaggcctctcgctttttttttttttttttttttttttgagccagagttttgctcttgttgcccaggctggagtataatggcgcaatcttggctcactgcaacctccacctcccaggttcaagcaattctcctgtctcagcctcccgcgtagctgggattacaggcacgcaccaccacacctagctaatttttgtatttttaatagagttggggtttcaccatgttggccaggctggtctcgaactctgacctcaagtgatcagcctgtctcagccttccaaagtgctgggattacaggtgtgaaccactgcgcccagccacctcttgctcttttttttttttttttccccaagacagagtctcactctgttgcccaggctggagtgaggtggtgtgctctcggctcactgcaaccccacctcctgagttcaagcgattctcgtgcctcagcctccctaatagctgagattacaggcgcatgccacacaatcagctaatttttatatttttagtagagatgggatttcaccacgttggccaggctggtctcaaactcccgacctgaggtgatccgcccagcttggcctcccacaatgttaggattacaggtgtgagccaccgcgcccagcctcacctctcgctcttaataatgctcaatgtttcttaaatgcagtgattattcaccaacaccaattaatcatggtccacaggtgattatctctgcatgagctgttgtcttctgatacaaaatgtgggtcaggctggttcttggggtgtttaattaaagagagtttaagaaaggaattgtttccagaggtgtaagcaaagctaagagaatcaacaaggagcgctcatgaacaagcacaagtgagaaattgttactcagccctcacccacccccacactccagaactgaaagagcaaggagcccagctagaaccgtcaccatgccagagaggccatctagcagagtctacagtccagagagagtggtagcttctagaactggggccaggctggtgatgggggacacataccctgacctctccctctacccatcctctgacctcctgccagtacccttccaccattggccacgcccaagtgggatcccaggtgatgcggcttgtaggagtcaggcttctcagaacagaggaggacagagtgggtcggaaaacaggaatgatcatttccatgcctaaccgttcctggtcctcaaaaacagattttgttttgttttaatttgaacaacactggtcattgagaaccataaaaggcaaagccactcttttcattaattctaaagattgttttttctttttgtgaggaacgtgtgattaggtaaggcatatgtagtctgtgggatctcttgaatgcagtggtgctctcagctgaagagctgaggacctctgatgtacactcaccgctcccactgttccttacaggcagcaacggacatgagtttgttttccttctaaaaggccatgaagatctgcgccaggatgagcgtgtgatgcagctcttcggcctggttaacacccttctggccaatgacccaacatctcttcggaaaaacctcaggtattcagaaaccctgaaatggcaacaatttgagaagtcttctggttttttcctacatttgtctcgtgtagtcatgtattatatcttaacaaaaaactataaaattagggagccaggcatggtaactcatgcctgtagtcccagaaactccagaggttgaggcagggggatggcttgagcccaggagttcaaggctgcagtgagctgtgattgtgccactgccctccagcctgggtaatagagcaagactgtctctttagaagaaaaaggctgggcatggtggctcgcacctataatcctaatattttgtaatgccaaggtaggaggatcacttgagcccaggaattcaagaccagcctaaacaacatagagagaccccatcactatttatttaaaaaaattaaaaaggtgaccgggcacggtggcccatgcctataatcccagcactttgggaggcccaggcaggtggatcacttgaggtcaggagttcgagaccagcctggccaacatggtgaaaccctgtgtctactaaaaatacaaaaattagctgggcgtggtggcggccacctgtaatcccggctactcaggaggctgaggcacgagaattgcttgaacctgggaggcggaggttgcagtgagccaagattgcaccattgtactccaggctgggcaacaagagtgaaactccatctcaaaaataaataactaaagtaaggaaaaaaaaattaagtggccaggcatggtggctcacatgtaatcccgacactttggaaggctacagcaggaggattgcttgagaccaggagttcaagaccatcctggacaaaaaagtgagaccctgtctctacaaaaaataaaaaaatcagctgggcatggtggctcatgcctgttgtcccagctccttgggagatggaggcagaagaatcatcttagcccagttggttgaggctgcagtgagacaaggttgtgcctctacactctagcctgggcagcagagcaagaccctttctctcaaaaaataaagataggctgggcacagtgactcacgcctgtaatccctgtctctacaaaaaaaaaaaaaaaaaaaagctgggcacagtgtagtcccagctactcagggggctgaggcaggagaatcacttgagcccaggaggtcgaggctacagtgagctgtgatggggcaactgtgctcgagcctaggtaacagcgagaccctatctcaaaaagtaaataatattttttaaatgttttaaaaatgaaaaattaagttataaaattttataatttataaccaagttcttccagagtttttagggtattttcattgggaaatgcctttaacaacctccaaagaatccagcagggagcaatttgtggcgggtagactggagagtctacagatgggatgggtctgaccccttgtgggatgaaagccaaacctttcccatcgtccgtattctggcactcctcttcctgttaaaaccatgagaattcacttgagaggtattttagtcacttgattgttcccccaaagccatgagtttcttgggcaggttgaggagacctgtgttgctttcactgcaccatcagtgcactgtctttctgtgatgccttattcttcacaaagcatccctcaacacacacttcacaccagcctgctgcggcgggggctcattaaaaatagtcagggccgccgggcgcggtggctcacgcctgtaatcccagcactttgggaggccaaggagggtggatcacgaggtcaggagttcgagaccagtctggccaacatagtgaaaccccgtctctactaaaaatacaaaaaattagccgggtgtggtgttgtgcatctgtaatcccagctactcgggaggctgacgcaggagaatcgcgtgaacccaggaggcagaggttgcagtgaaccaaaatagtgacactgcattccagcctgggcaacagaacaagactccatctaaaaaaaaaaaaaaaaaaaaaaaatagggctgggtgcagtggcttaggcctgcaatccagcactttgggaggccgaggcaggcggatcatgaggtcaagagattgagaccatcctggccaacatggtgaaatccgtctctaccaaaaataaaaagattagttgggcatggtggcacacgcctgtagtcccagctactcgggaggctgaggcaggaggatcacttgaacccaggaggcagaggttgcagtgagccaagattgtgccactgcactccagcctgggcaacagagcaagactctgtctcaaaaaagaaaaaaaaaacagtctgcctgtgttctgagctgctcaagggtatactctctttacggtacactaaccctgcttttctgtgggcgccagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcgggtatgtgatgcggccacgagagctagtgccccttccgtggcagggaatctccgtagcgctgcttttctcattcctctctgtatgtctgtcactgaaaaatctctttgagagaatcagctttgaagaaggtttaataaagtgagtcctaaagcagataagcttgtaagaaactgaaggacccttaagctgagaaattgttttcaccatcctagggaagactagacagataaatattcggcaccatatatttactaatgtatacaaagcactggccatatggagaaataatgtttagtagatgtgtaagtaataagaaagagaattgcttgttttccaaaaccttgaaacttccagtactctcatctgcacagaaggcctataactgaggtgaagtctcgtgtttttcccttatgccttggggttccagtggtcatcaggttagagtggtcacttcgtttctccttttgccatgttcttatttcccttctcctttggctatgatggggaaattagaactcagctctgcctggaccccaagccttgtttcttcctggacccaaactacatgtcttaggctgctctcttactgaacagttgtgtcctgatgcagatggctccggactatgaccacttgactctgatgcagaaggtggaggtgtttgagcatgccgtcaataatacagctggggacgacctggccaagctgctgtggctgaaaagccccagctccgaggtaggccactgggccctgcagacctgcgctctcctggaacccccactcgcaataggatggccctcccatctgttcatgtgcacacagcggctcttctttgctgtgattggctgtagagcgtgtccagacttttctaacaaaaatgaaatgggtgagcaagacaagttcacagagttagaatgagtagtttaatatttcctccagaactctttatatattaaagaattaaagatagttgtcttttttatatatgttacaaatttcctattaacttagtttttaaattttgctaatggtgtgttctttggtttggagtttttgtttggtttggtttggtttttgatacacagtcagccctccatatccgtagcttctgcatctgtggattcagccaactgtggatagaatattttttaaaaatatatataacaataagaaatgtaaatttttaaaaatatagtagaatgactgtttacattgtataacattcacattgtattaggtattatatgtacccaagatgatttgaaatataagggaggttgtgcataggttacatacaatactatgccattttattaaaaagttgtttttggctgggtgcagtggctcacacttgtaatcccagcactttgagaggccaaggcaggaggatcacttgagcccaggagttcaataccagcctgggcaacatagtgagactccatctctttttttttttttttccccgcccaggctggagtgcagtggcaagatctcggctcactgcaacctctgccccctgggttcaagcgattctcctgcctcagcctccccagtagctgggattacaggcacgtaccaccatgtgggttaatttttgtattcttagtagagacagggtttcaccatgttgtccaggctagtctcaaactcctgacctcaagtgatccacccaccttggcctcccaaagtgctgggattacaggtatgagccaccacacctagcctgtgagaccccatttctacaaaaaaattagccgggcatggtggtacacacctgtaagcccagctactcggaaggatcatttgaatccaggagaatgaggctgcagtgagccataccatgccactgcactccgtcctgggtgacagagcgagaccttgtctcaaagcaattttatatatatatatataaatttttttttttttttttagagacaaagtctcactgtgtcacccagcctggtcttaagctatcctcctgccttggcctcctaaagtgctgggattagagacatgagccaccacgcccggcctacaccattttatataaggcacttgagtattgcagattttgggatccgatgggggccctaacttagagatatgactgtacaggcattttttaaagttagaagttaccaaatttttaatccttttctttaaagtttcttcctttggtttgtttttgttttttttgtttgtttgtttgtgtgttttgttttgttttttttttttgagacaaggtcttactctgttacccaggctggagtgcagcagcacgatctcggctcactacatactccgtctcccaggttgaagtgattctcctgcctcagcctccagagtacctggaattacaggcgcgtgccaccatgcccggcttttttttttttttttttttttttttctcgagacggaatctcagtctgtcacccaggctggagtgcagtggcgcgatctcggctcactgcaagctccgcctcccgggttcacaccattcttctgcctcagcctcccaagtagttgggactacaggcacccgcctccatgcccggctaatttttttttttgtatttttaatagagacggggtttcaccatgttagccaggatggtctcaatctcctgacctcatgatccgcccgcctcagcctctcaaagtgctgggattacaggcgggagccaccgttcccggccactcttttgtatttttagtagagacagggtttcactgtgttggccaggctggtctcaaactcctagcctcgagttatccgcccttctcagcctcccaaagtgctgggattacaggcatgagccacggtgcctggcctcttcctttggttttatatttagaaaggccctctccaccttgaggttatttttttacctatattttcttatactagttacagggttttttttacatttaagtcttaacccaagtcagacactatggtacacacctgtagtctcagctacttgggaggctgaggcaggaggattgcttgagcccaggagttcaaggctgttgcacattaagaccacacctatgggcggggtgcagtggctcacgtctataatcccaacacttggggaggccaaggcaggtggaatgcttgaagctcaggcgtttgagaccagcctgggcagcgtcgcaaaaccccatctctacaaaaaataaaaaattagccgggcatgatggcacttgcccattgtcccagctacttaggaggatgtggcgggaggatcacttgagccaggaggcaagggttgcagttagctgagattgtgccactgcacaatctgtaactcagcctgagtgacagagccagaccctgtctcaaaaaaaaaaaaaaaaaagaagaagaaaaagaccacacctatgaaaagccattacactccagcctgggtaatatagtgagatcgtctcttaaaaataaacaagaccaggcacggtggttcacgcctgtaatcccagcactttaggaggccgaggcgggcggatcacgaggtcaggagttcaagaccagcctgaccaacgtggtgaaaccctgtctctactaaaaatacaaaaattagctgggcatggtggcacgtgcctgttagctactcaggaggctgaggcaggagaatcgcttgaaccagggaggcagaggttacagtgagccaagattgtgccattgcactccagcctgggcaatagagcaagactctgtccaaaaaaaaaaaaaaaaaaaaaaaaaaattaactaagtttggaatttaaggcgtaactttatttttttaaacatgactagccatgaccacactgttggccaaataattcatcctttccctgctatttagaagattttgtttttattgaacactgaattttttttaattttattttttgagagagagtttcgctcttgttgcccaggctggagtgcagtggcatgattttggctcacttcaacctctgcctcctgggttcagtgattctcctgcctcagcctcctgagtagctgggattacaggcacgcaccaccacacccggctaatttttgcatttttagtagaaacgggatttcaccatgttggtcaggctggtctcaaactcctgatctcaggtgatccacccacctcggcctcccaaagtgctgggattacaggcatgagctaccgtgcccagcctaaacactaaattctacgtgtccttggatttctttctagggctcctcttctgtttcattgctctttcggcctgtttctcaagttccatggtgttaatacaagtcccttctcaggggctatcgtcatctattttttttcttgaggctgttaacatctttatactcataaggggatatccttaaactgatatttttcatttactcagatctttaagtctaacacatttctaattaagtttaattcaaggcatagttcattgttagaattgtgaatgaggtctttataatgttatacattctaaccagttattgatggactgtaagaaaacaactgattaggccaggcacagtggctcaggcctgtgatcccagcattttgggaggccgaggcaagcggatcacttgaggttaggagctcaagaccagtctggccaacatagtgaaaccccgtctctactaaaactacaaaaataagctgggcatggtggcgggtgcctgtaatctcagctactcaggaggctgaggcatgagaaccgcttgaacccgggaggtggaggctgcagtgagccaagatagcaccactgccttccagcctgggcgacagagcgagactcggtctcaaaagtacaaaccaaagacagcttattagagtataattatgttgaaattaaagtttccagaaccgtagttcacatgcactcctgtgttctaggtgtggtttgaccgaagaaccaattatacccgttctttagcggtcatgtcaatggttgggtatattttaggcctgggagataggtgagtaatttaatttggtttttttagtcttctttctccattgtagttttcctgaatggtttcatttggttttccaattaaatatatggctttttggtaaataaatattggtattgtatatgtaaggtctcttttacaacattagccttagttccctattgattgtgatgccatcagaagaatacatcaaactaaagaaaaggaaaaatagttcaagctgggtgcagtggctcatgcctgtcatcctgggaggccagggtgagaggatcacttgagcccaggagtatgagaccaacttgggcaatagcaagaccccatctcaataaagccccacatagttcaaggatactactttctccttagtctggcttaatgtattaaaagctgtattgcagggcaggctcattggctcatgcctataattccagcactttgggaggctgaggtgggaggatcacttgagcctaggaatttgagaccagcctgggcagcatagcaagatcccgtctctacaaaaaataattagccaagcatggtggcatacacctgtagtcccagctctttgggaggctgaggtaggaggatcacttaagtccagaaggtcaaagctgtagtgagccgtgattgcaccactgtgttccagcctggtcaacagagtaagactctgtctcaaagaaaaaaacaaaaatactaaatcatattgattttattgattcaagaaacatttgtcagtcaccactgtgctaagataaatcattttatttctgtaattgaaaccaaccaaagtagatccttctgatatttttgcataataagttttgtccaagtgtactgactgaacatgtaatttacgaatgttcagaaacggactcacaagaatgtaaaaaagactggttctctgatgtctactgtttttctcctggaatcatgtctcatgcaactatttgagagtaaaaataattttaccccacaaaaatagtagatttttgtttttaaaagtctagcagaatatctgttgataaaagccaggtggttgccgggattggctcagggacttaaggagatgagaccctgttacggctgctcagtaaaaatgatagagccttgtcaccagaaggtgccagtgctgccagaaatgacttattaggtcaccaaagacctcagaaaagcacagtatctcagtacagtgggacaacctgtgattcacacataagcccacatttcagcaggagttggcaaactgtttctgtaaaggaccagttaataggtcgttttaggctttgtgggccctttggtctctgtcacaactagtcagctctgctgtcgtagcatggaagcagcctggaacagtacttaaacaagggagcgtgctgtgtgttccagtaaaactggacttgcagaagtggaggtggaggggctggattggctgagggctatcgtttgccaactcctagcttacagtatcacgtacttattgattttttcatccgttatctctgttgatccctccctgatctgtcttctgtttctcaaagacacccatccaacctgatgctggaccgtctgagtgggaagatcctgcacattgactttggggactgctttgaggtgaacacatgttctagaaccccaacctcatcttcccgggtgatcacttttccccctcctctgacactgtaggcagacttaagcccaaactgccttactcttaacccctgctggccctaccaaggctgtagttaagtcagtctaagaaatgaaatctgggctcttagttggactctaacccccttggagcaagggctgctgttcccatgccctctgagtagagtaggcccctaccctccataccacctgttgcccaagagcctggacacgatgcacatttgtcttttttcctttttgttttctcttcttttctgttgttcgtttctttttttttttaagttgtctttcaaatccctgtgacaagtcctctcactaaacccaagctgcttcctttccctgctataattaaaatcagtgcaggtgatgcagaggaaagccacctgctccacctggctccaggtaaagaaaataaacattgatttggcttttcccatttattattctgtaggttgctatgacccgagagaagtttccagagaagattccatttagactaacaagaatgttgaccaatgctatggaggtgagtggatatcgggaacgagctgcttccaaatgggatcaggacagttacagccttctgagaacacgcttgttagagcccatcagttctccaaagtgcctttgtgatttttgtagcagttttctgttatttcctattgtgttagaaatgacctatctatgaaaggcttaccacttcacttctgacctggtttcctgtggatcacagtcctgccctgattccttctcctaagacattctcaccctgatacgtcaacatggcctgtgtctgcttcctaagtgagggtaacagaccccctcggcttgctttgggtggagagttagtaactcctgtggtgagtggctctgtcccatttctaggttacaggcctggatggcaactacagaatcacatgccacacagtgatggaggtgctgcgagagcacaaggacagtgtcatggccgtgctggaagcctttgtctatgaccccttgctgaactggaggctgatggacagtgagtatcatcaagtgcctgggagctgagctcagtggctcacacctgtaatcctaacattttgggaggccaaggcagaggagttgcttgaggccaggagttcgagaccagcctgggcaacatagtaagacccctttctgcaaaaactgaaaaaattaggcatgtattagtctgttctcacgctgttataaagaactgcctgagactgggtaatttataaaggaaagaggtttaattgactcacagttctgcttggctggggagaactcaggaaacttacaatcatggtgggaggggaagcaaacacatccttcttcacttgggggcagaagagagaagtacagagtgaaggggagaaaagccccttataaaaccaccagatctcatgagaactcagtcactatcacgagaacagcatggaggaaccatccccatgatctaatcacctcccatgaggtccctcccacaacacatggggattacaattcgaattgcagttcaagatgagattttgggtggggacacagccaaaccatattaaggtgggtacagtggcacatgccggtggtcctacctgctcaggaggcagaggcaggaggatcacctgagcctgggaggttgaggcacagtgagctatgatcatgccactgctgcactctagcctaggtgacagcgtgagaccttgtctcaaaaaaataaaaaaataaaaaatttaattttaaaaataaaagaaaacaaataaaaaataaaatcaagtgtgtggaagctggggttggcagcctcccaaattagcaatatccagcacataacattttacaaacctatgccccttcaagcctgcagcctgggatacattgcagagctattgcattacatttgcacagagtaactctgacacctggaaaagaacttcaagtatttttattaactaaaacagaaaatgccattatcaatttagatactaaaatattcttcagtattaaccaagtatcctagtgatttttctctgggctttatatagagtagtaagctgaaattttaataagaaacgcaaacagttatgatttgggacagcagtatcttcatctaccctttgttctgccaccttaggggatgttcaccaaaagagcttctaatccattgaaattaaatcatactttgaccttatattatctgtattacattgtctaagtccaaatcaacagtatagagtgtccccctgggtttcacatcccatgctaatacccacccacttattcctgagtaatatgtctgtcatctctttttttggggctatagctttacgaacaattatatttttatgactggaagaaaataaccaagtttctttcaagtcaaaatttgaagcatgtttcaatactctttatttctctccctagcaaataccaaaggcaacaagcgatcccgaacgaggacggattcctactctgctggccagtcagtcggtaggtgcatccacgggaggtcgcaaaggctctcccccttgtgcagagtgtttgtagagtggggtgggcttcagtcggtgggtgcatcccgcaggacgttacagaggctctcccccttgtgcagagtgtttctagagtggggtgggcttcagtcagtgggtgcatcccgtgggaggctgcagaggctctcccccttgtccagagtgtttctagaatgggatgggctttgttattgacagtaggaggcataacttaaagtggtaatggctactgaacatgaaggaagtaaatctagttttctcgtggttcttgacagtgatagttttgcaaaggtgctattactgctagcttatcacctgataagcatttaattgaacttcaaatacttggtctagaaatatttactgagcaccaagcagctaatatgttttttatttactgtttcacacatggagtgggtacctgaagctctgagatttttatcaaactatctgattttaatctatctgtaaaaacacagtttaaagtatgtctgaatatcagctcactaatggtgtctgggttggaataattattaacagtattaccttggtcctcaagcattgataatagctcagaaatgggaagatggaagcagcagaaatttatttgcgttgctgggaggaaccctggaaccacatggaacagtgtttctaggagcgcgactcacagagcaggggtctagaagacttgtgtccctctgagagccagagtcctttttgtgtgtggaaacctctcaggagtgtttgagtcaagctgtttaacttttattttatttgtattagtttccagcacacacagcattgaagttactggttttggggggtttttttgtttgtttgtttgtttgtttgtttttgagtaaaactgtttaactttgtttagccctcccctcttccccgcactccccatcccaccccttttttccttcgtgacatttagcaacaccctacatagttcatactttgggaattactgttagggtgtaaaaaagtatatcttttctacaaatgtttacagagcacttacaactagttaataaactaagccaaataatgtctaggggtgcaaaaagaaaatgtgaggtacagtggtcgcctgaagaagcacagaaagcattacagaattgaccataacctgcgtgaaatagtcagagagcaggagactctgccgtggagcctgcgggtgctttcgtgtggagtagggctgtggagattcagaaaaggggacttcactgtgaaccgtagctgcgaagagagcacttgggttggtggcatctaaccatcacttcacctgacaaagggtaatttttctttcttttttttttttttttcttgagacagagtctcgctttgtcacccaggctggagtatggtggcgcagtctcggctcgctgcaacctctgcctcccgagttcaagcaattctcctgcctcagtctcccaagtagctgggattacagacgcatgccaccatgctcagctaatttttttgaatttttagtagagatagggtttcaccacgttggccaggctggtttcgaactcctgacctcaagtgatctgcccgcctcggcctcccaaagtgctgggattacaggcatgagccaccccaccttgccaaagggtaatttatccttattggatgggtggaatctgatgggtagaaaggaaaagggtgtttcaggcaagaaattgggatactggcttataatgtcatacatggacactgtgacaggatttgtgaatgcctgaatcaccaggctcataggacacacagtctctgggggagcttatactggtggctggtctcaaacgaagtgtgctgagacttactggcttcattctcagggcccacctccctaacaattctcaagtggctactatatgctgtctgtagcatacagaagggaactaggacagccagttctgctggcaccagatggtggtggatttggttgtttagcttaaaagttaaattccagctgggtgttgtggtgcacacctgtaagcccaggaggagcacttgagcccaggagtttgagactagcctgggcaacacagcaagaccctgtctcaaaaaaaagaacttccaatggatcattaatagaagtataactatcacccgggtgcggtggttcatgcctataatcccagtactttgggaggcccaggcaggcggatcacctgaggtcaagagtttgagaccagcttgaccgacatggagaaaccccatctgtactaaaaatacaaaataagccaggcatggtagcgcatgcctgtaatcccagctactcgggaggcaggagaatctcttgaacctgagaggcagaggttgcagtgagccgatatcatgccactgcactccagcctgggcaacaagagcgaaactccgtctcaaaaaaaaaagaagtataattatcactaccttcattcagaaggtctgtgatgtacaaggacagcattcaaaaaacttcataattctgatttcagactcttctctgctaaaagccataatcagtggagggtgaacctaacacctgaggactttttctacccagagctgatatgaaaattcctccaaggaataacatttcaaccttgtgtgtgacacattccgaagttaattttctttatcagtttttgtccaaacacattttgtcacgaggcttttgacctgttcttattcctatgagtttattttgttaatgcaatttgcctgaaaatccatgtttcaattctgataagcaccaaattttttcaataattattaactcacatttgaaaatggctttacagatttaaaaattttttttttttttttttgcaaatggagtctcaggctggtcttgaactcagctactcaagtgatccttccacctcagcctcttgagtagctgagattacagctatgtccagcttaaaactttgaaatacataaagagtaacataaaactttccttctcttttcccctttagggtaggtagggcaggcgttaaaggaatagagtgcgtagagaattagatgctaacaccaacagtggctttttggtgtttgaattttctgttaattgatttcttttcccatagaaattttggacggtgtggaacttggagagccagcccataagaaaacggggaccacagtgccagaatctattcattctttcagtaagttcagcctctgaggaaccgcaccagtgactagctcattaagaaaatagcagctgtgttataccctgagaggggtcaacaagatgaagcaacaaaactgcctttgagcagaaaaggttccatgaatttctcattatattctgaggacaaagacggacatagaggaaggattgcttaacacttacaaaagtgaatatttgagaaaaacagggcacccattgaacctgttgtattgctcccattcttacagttatttctacttttgtgtattccagttggagacggtttggtgaaaccagaggccctaaataagaaagctatccagattattaacagggttcgagataagctcactggtgagtgtgtcatgtgtttacttaaaagggacataaaatctgagcacactttcctctctgagtggtggtcagccccatgtccagtggtgttagtgacgagctttggcaccatgcagctgacaaagagtgtctttgaggtcatcagttaaacattgtctctgattcttctttctgatgactgataacagtacttaatgttagtttaatctcatttaactcaggaggtgaataaatttcttttgggtccaaaatcagccaaattcagagaagtgttttttaatcatgtcttttttttgtttgtttgagacagttttgctcttattgcccagtctggagttcagtggctccatcttggctcactgcaacctctgcctcccaggttcaaacaattctcctgcctcagcctcccgagtagctgggattacaggtgcacgcccagctaattttttgtgtttttagtagagatggggtttcaccatgttgggcaggctggtctcaaactcctgacctcaagtgattcacccaccgcacccggccgaatttttctttttttcttttcttttttttttttttttttgagacagggtcttgctctgtcacccaggctggagtgcagtggtgcgatcttggcccactgcaacctccaccttccaggttcaagtgattctcctgcctcaggctcccaagtagctgggactacaggcatgtgccaccacactcggctaattttgtatttttagtaaagacagggtttcaccatgttggccaggctggtgttgaactcctgacctcaggtgatctgcctgcctcagcctcctaaagtgctgggattacaggcgtgagccaccgcacctggccaaacttttcaaatccaactatgatggtatccttcatcttcatgtctgacgataagctgttggcatagacagttaagcccacagggaacaagaagtgcatcgattgccaggaagagagtgaaatgtttttgttcctcctgtgctaggtcgggacttctctcatgatgacactttggatgttccaacgcaagttgagctgctcatcaaacaagcgacatcccatgaaaacctctgccagtgctatattggctggtgagtggggctctcaaagtgactttgttaaaataagcaatcaggtcccaagcctaggccccaaagccagagtagcaaaaagagatttggtgaggtatctgtaaagggcagttagagctcagatctctttaaaaattcatatttactgcatgtgcccattgttataaaaaaagaaactgagaaatatggatgcatacttggaaggcaaacactaaaattaaaattacattaagataagtggttcaggagaataggcaaggcttgtttgtttgtgaggggttccttttgggttttgctgtcagtccagtgcagagatacaggaagggcgaaggaaagaaaaagctagagcagtgacagagagaaggagataaaaagacagatttatgatctgggagtctaacctcaagggccactctggggtgtgctttgattaattgcccaaggcatgcttgaaggcagaaacttgagagagcgggcgctggggaagtgtccttgcgggacctcggtgggcattagccttgactggaaatgatgagtgtgtcccatgcaattagctgtgggagagctcagggaataccctagggttgtcagaccttggccttttcattttcaagttatctgtgtaaacctttgaagaagctcaaattattaaaatattccttttctttctgccttcttaggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacatatgtatatgagtggcgttttagtcataattttgatcagttcaaaaaggaagcatttactctcttcagcactcagccttcagtaaacactctgtagtagggatgacagaggacgtaagggtgtacgtgacatggtccctttcctcagactgttcccaggccagacaggtggagacagcatgccactgaagtgaacagaacttaccccggccaagtgctgagaagaggcatgtatgggccacaggtaggagcgtgtattccaccgggtgagcctggaaagccccatagaaagagggacatttggcatgggtcttaaagaggggtgggagtctgtcagatgaaccaaggggggggcattctcagcagaaaaggaagtgtgagg

SEQ ID NO: 13871 - DNA, 38575 bp, Human; identical to SEQ ID NO: 12876

SEQ ID NO: 13872 - DNA, 137394 bp, Human
  misc_feature (1)...(137394): n = A,T,C or G
tagttttgtttgtcagtttatttctttgttatttactctacaaatagtccttgaacttgaggaagaaaaatgggaatggtttgtgttttacttaaattataagatcaaagatggcagatgatttatccaaagcccaggcaagtaggaaaagcccccccttcccttccccttttccaggatagaagagagttggctggttactttgcaggacttaagatgatcttcattttaaagaatctgtatcagcctccactgtggtaagatgtgactgggatttcaaggtttcccctgtctctactgatttacctaagtaggacagagatttctggggcatgcctgccggtggagggcagtaggtcactcaactaagagcacagtattgttgagaaaatgacactaaagtggtcatctgggatgctacttcgcttttggtaaataactttgcatcaacttctcaagttccacctctcagtggagacggatgctagacaaaggtaccagacaccgcagcctggtcggctgaacaaatggagttatagccttagattttgttttcgtgatgactaagctgaccaggtttcttctttgtccttgcacactttatgcttgacgagatgcttaagcaaatagaataggcgaccgctaggaggtacccgagctatgcgtcggccgccggggcgagcagaaatggctaacagcgactctctcggctcggtgggtcaaggcgggtggtgcttttccaaggtcggggttgcgataagcttatcgcttatcacaagcaagaagggcaagaaggacgtctaagaaccaacggtcctttaatctaaaaggccgcgcgcctccaaggcaatgtgacatcttgaggtctagtgtttgggcaccagctgcctgcacatctggatgcagcacttcctttcagggaggaggcgaggcggaggaccccggagtgcacgcacctcctcgtgcgcgcgctcgcttgcgcccgtgaacgtgtgtgtgtgtgtgtgtgtgtgtgtgtgtgtgtgtgtgcgggcgcgcgcgcacacacacgggccgcggctccgggaccggctaatgggggtgggggcccaggaaggaataaatctccgccagcctcctcgcgcctggctgcgggttaatatccaaccagctagagaaagactagggtgacggcagcagggtgacagcctgggcacaccggccgcttgtcgaaggatcaggatattagccagtctccgccacactcagggactgatatatttctattggcggggggctgttggtttttattgtctgccgttatctccaaagaacaagggcacgagtgaggggtgcgcgctctgggcgagtgtcgcggctcggatcgggtcgaaggaggcaattttgcgggtgggggagggagggggagaccttgatttccaccaatccccgggcgtttgtctgcgaagtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggtgggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggtactcctgccctcgcggctcctcccctctagcgtcctttcctccccgagtgcagaggacagggtcaccggcgaggaccgccttgcaccgtctcgcagaggcatccctttcatccgctcttccatgtcctttccctccatttgtgccattcccaacctggagactttagtcagggttccttccccacccctgatccccagagatgtgcagacacctgctttgcgcatgtaaagactcgacgcatttcttcccaaagcggagttttatttaacaatttacggataaacaaaacagagggaaggagaacccaggataacttagtctcttgcacttaataagaatttacctcttgggctctgcagacatttgaagctgtagggaacaagaagcaggtaaaaggcatctccccgaggtggagtgcacagtcggtaacataagtccccaacgtcggagtgatgggcagtggaaacatggacggatcccgcagctttgcgcagtgtgcccacagcaagtgcatagtactgactgacgtctactaagagacgatactgtgcaatttttgtgttgaaatctcgaacagctttctagtattattatctcatcttgttgaccacaaattgattctttagaaggatgagtaacttccccaaggtcattacttttgacctgtgggtgctggatttttcatcacttaaagctccaaagctcccagctctttttattggcttaggctgtggatgcctctggaagatgggagatgtactttaagtaggcacctgaagtcagaaaacaaacaaaatgcccaagccaggttggaaatcagaactctgaggatcactcagaggttgtagatccgcttcctttctgggaattttagattaaatgtctaaaaataagttacggcagcaggggttgtgtagttagattggagggaaggcagagctgcttccccttcctctccacctccccaggcatgttgagggaacacacgggtgcttccaccactgcgaggtgcccctttcacctttagtctctggggctgaagatgctgctgttggcttcttcctgtgattgtagtggtctgggtggttggaaatgatctcctctgctctgtagaggatctttctaatcagtgcaagggcaggtgagttctaatgtaaacatttttcactgcagttatttacaaatattcaggagcatctatacatttttaaaaactttttaaacatatggtttccatctccttctcaggcctcctcctggaaagaggattaaaaagataacagagccaatttgtttagaggaaggcaactgcattctccttggaagggaggactttccttctccctttttagaactctaccatcattgaatttaaaaataacctcactcttcctaaaagtatctaagggttaattttttctttccttcacagtattgattgtgggactcaagagcaggcaaaaggcatcacatccagcaattattttccctaaagacagaaagcactttcatttcaagtgatctaaggaaatgagttaagaacttcccattggtttgcaatgaaagagtccatttttttaatataggaggaggaataatgaagccctcttagaggatagatttcttgttggaggatacagtcaagtggaaaatgcttcaaattctgagacacacaggctgatagtttctgagacacatttgttccttgctttctgtagcctggagtaattttcagtgtgtttggctgttatctggtctggtctctatgtgcagagaattacttattaaaatccacacactatgaaaactacctaaacacatatccctcaaagttagtggctgtaaaaccatgtaaaaggcaccattgcttattgaaataagtttgagcttcagagtagaattctgaatttctacactgagtatgctgtgactagataaacagcagagaatctttggcaagttagtatattttttgagtcctggctttcttgtttatctacattgcagagttgttagaaggtttacatttttaataaaaactgatgccaagtatctggtacattgtgtacccagaaaatggttgccttataattgttataaattatatttctggtatatgttacaacttaaataaggaaatctgggcaacccatgagaatttggaatgtttctcctgccagatttacaggtaaacattattggtccctacccctctccccagccatgtacacttaacgctaatgaacagggacaagacattttgaaaggtaggagaagtttcatggtttgagttaattattttttacctgcacatttaatgttctttaacatttggattgtcagtatatggcagtagtgtttatttgttaaatattagaccagtcagtcagaagccattatcatgttaaggagacacaactttgacaaacaagcatctgtttttctccagtctgaaacatcttctgcataaatacagatatatgcacacaaatgcacaaggtgcacttatatgttgagatataggtgcatttattcacaaatcatggaatggtgtcatgtatgtataaaaatatagatgtgtatacatacataaatacaaacatttgcaatcagtcaattaaacaatatttcatgagtgactactctacatcagatatgtgttaggccctgggggatagcagtgaataggatggatagattgcctcctctaagagctttcctcctagtagaggatgattgacacacaaataaatacgatgacttaacatacggttaaattctgtgaagagaaaagggagtgtttcactatgtttataaacaccaaaatttaagattttattttgccctctgtgcttccatttacttttgtaattttcttcttctagctcagtacttgatatgtactgaattctcagagaagaaccttgtcaaactgcgaaggagatggcaggaagaaagtaagaaagctgtaagagttttgaatagaacaggaagttttcctaatgtttatgtggtgatagaaagataaaggaatcaatagatcctattatagaaactttcttaattcttgttgcttttgattaagtgatactgtgggaaatgccaaaccaaagcagtgtttgtttcttccatcagatcctcacccatttcatttgctcctcagaaatgaacctgaattcagaatttatgtgcaaggctttattcatggcacctgacatggtaacaataatagtaacaattaagctaacaagttattaggtgcttattatctgcctgacactatgctagtatgtattgtctcatttaatcctcataagaatcttgtataaattgatatatcattatccacatttatgaaaatgaacatgccctggtcttcaagggagttgctataatcccatggaaaagacagataatgtatataattaactaactggaaatagggccatcaaagacaggaaacatagcagagtgaaaaccttatggattttgggagctgtcagaacatggttggaattctggctgtatccctttctagttgtgcaatcattggtaagtccaatctcagagcttcagttcctccatttgtaaattggggcttgtaagaatgtcttacaagtttgtggtgaaaattacatgatagcatatagacagcgcctggaatgatgcttgccacatagctctgtttaatacgtgattgttataacaatagaaacaccagtggaagtgctggggatnnnnnnnnnnnnnnnnnnnntgaagtgctggggatgttcccagaacatgacatttaattctactgaagggagggaaatcgggtttcagagaggaggtggtgtttggagtaagcctccaaggatggtagggtggcatagtggtaagaggtgaggatagaagtatatgccaggcagagagaacagcaaagatcaaggcggagagatttggaagtgcctgatgtgtttactgtatggaaagttattaagtcacccatggagaccaccatagaaaagtgggctgggtggtaggacgaagccaggagtctttgaatgtatttaaggtatggctcattagaaatggacaaacatcaaggatctaatggtactggctgcatgttagctatcagcagaggtggcacatcactgttaccagtgggtttgggaagtagaatagaggttaatacagtgaagtggttgttttgaaaattctgtcgactcattgggtggtaaccgttactctaagcagtcaagtcctttctttttcaaaattttgaacaaacgactgttttcagcagttccacctttatgtggcctctttatttccctatttttgaatccagggatgttaaaagctcaatttccataattgtcctggtggcaggaaaagggcattgggagtggaggggaggagcataggtgcagccatctgtacaggtaaaatataagtttagtgtttgtaagttgggggtttatggaattcactttgaaaaggtagtttgggaaaaagagggtttaataagttttgatgcttaagaaaatatgctacagttatgttgcaaatttacaaatgtggaaaaaaatctcatcagcaataatcacaatagcaaaaatcaatcactaacccttactggatacgtaaaatataccaggcctagttcttagcacttatatatgtttttttttccccaaagcaaccttataaagtaggtttgtgtatgttccttgttttatagatgaggatatggaggtttagacagatccatgaacaaaatgatggagtttgatttccaacctggagctatttaattctaaacctcatgcttgttccctgctcatttgggataaatgaagcaatgctgtatacatctctctcatgatttggctctgattacttctccaatgtcatctttcatcagtttttgtttttattctttgctaatattggaataattaaaaataggccaggctatattggttttgctcgagccacccactccacctggaatgacttgacttgaaggccacatcttcctgccttttacctggccagttccttctcatctcttgacagtgcattatagtgggtaagagcaaaggttctgaagtcagctgtgttcaaattctgattccatcacttgctgtgttcttgagcaaatcagccttcattgctcatttctctatccataaaatggggcttcttataggactgttgtaagaattagattagataatgtgtttaaaatgtttagaactatttccagtatataattaatgctcagtccttgttagttcgcctcaaggtggcttcccttactccttcttcccttcccaggctgtgcttagaactcctcctctctgttttctttataccatgcatgtatgattgtaatcctttcagttattcaaaatacctactactctgtgtctaccactattactgtaggataggagatgctgggtctgtagctgtgaactgaataaaatttttgttttcttggaatttataggataatgatgagagacagaaaataaacagagaaatatacaaataactggtagcgacaggtgcattagtgatgatgtattaaaaatatgagtgcacttgcctgccttccctgctaaattttaagtttctcacagacaggaactgtgcctcattcttagttgcattcccagagcccagcatggtccctggcacactaaattttgcttagatatcatgtgaatgaatgtttaggaaggtgtggaaccagatagccacccaattggtcaacaaatatttaatgagacctactgtgtgtccagcactctggcagtgtagcagatcagaggagtaagcatcctttgtattctcaaagagctcttactctagagcagaggttcttaatttcaaccctcctgacattttaggctgcatactgctttgctgtggagtgctgtccggtacattgtagaatgttcagcagcatccctggcctctgtccactaaatgagacaaccaaatatgtctccagacttggcaaaatacctcctggggggaaaattgcccctgactgagaaccattgatttgcagaaacaaaacctgccctatcgacaggatttaagaaaccttgaaagtatgcgtaattaagaactaaatttggaaactacaatataaatgctttgactgtttagagaaaggaggtgtctctgtgggctcaagttgttggagaaggcctcctggaagaggcctgaatgaactgtacttgatagacaggtcttggttagggagggtcaggagaggggaggcgttttaggatatttatataagcaaccgtctctgttgaaagtaatataacagctgtttaagattttcactaatgttccccttaatccctggtgagaggggtccatgctctgtgccctatactttaaggggccacatccttctttttctctggtttcaccctttctcagtgaggcagggtgttaatgggatctttctagactctggaatttcctgcccaaatgacccaactctacttctgcagcctgcctgcctgcgtggggcattttccccaatcttcttcctgagagtggcttgcccccctggtatgtacaatcctagtccacacatcagagggggcaaggaacggctaagggacagctctttgagggagacattgtggaaggatctttgatttggttctgtggggcccacatatgcaagtggtataggcttgccctgtgtccccagattgcaggaccaaacttcctggagtttcaggagtctaaatttgaatttggcattccagattgttatgcagatttgtttgtccagggaggagaatagaacatgttttatcggtttgttggtttgatgataacttctcaatattagatacagttgtacttttgttctctgccttgcaaatggaggtggttggagagtttttggtctgtactgtataatcaatactcgagtgaaaaattatagtgggttttttgtaacttgggagtctatcagtcttctttgagagcaaagtgttttaggaaactagttggatcaattgaataattatgtaagttagtatagaatgtggtcagttagtcttttgacaaagttgtgagtcatcttggaaataatgatactatgtatcattaatgcactcttcatgatggatttgatagatttctggtaaaataatctattttagcttctcattctgacctggctctatcaggagctgtgtgaccttgggcaagttacttaacctctctgtacctttgttgcatcatctgaaaaatgagtataatgtgctaatctacttcataggtttgtgatgataattaaatcagataaagaatgtagactccataaccatcctcacttggctgggtgggatgataggaagtttgttcccacctggaaaatgtctggactttggagtcccagagataaggatctaatcctggttctgtcatttatcaactttgtgacattgaaaaatttacttggtcttgctgagccttagccgcaggtggcaatagttaccttgagaggattagttgctggataagtgctaattattagtccataatgaggagannnnnnnnnnnnnnnnnnnnnnnnnnnnnnnnnnnnnnnnnnnnnnnnnnnnnnnnnnnncttgtgacacacgctcttttttcacagtattagtgctgagggtgctgtactatggccggcaaaattttatggaagacagcagcagcccagcaataaatcaactgatttcaatcattcattcaaccacatttgctgaatgtctaccatgtaccagttaggtgctggcaatacagtgatgaatacaagaacgtggtccctgatttgttaatctaattaacaaattttataatctaattaacagcagttctcccatatctgtggttttgttttccatggcttcagttgtctatggttaatttggtccaaaatattaaatggaaattccagaaataaacaattcataagttttaaattgtgctctgttttgagtagcgtgatgagatttcactttgtcccactatgtcttgcctgggatgcgaatcttccctttgttcagcgtctccacactgttgacacttgctgcccatgagtcacttaatatccatcttggtggtgggatcaccgtgcttgtgttcaaggaacaccgattttattttaccagtggccccaaaatgcaagactgatgatgcaggtatattgttataattgttctattttattattatttattattgttcatctcttactgtgcctaatttataaatcaaattttatcataggcatgtatgtataggaaaaaataggaaaaaacggtatatagggcttggtaccatctgaagtttcagacatccactgggggtcttggaatgtatcctccacagataagaggagattcctagtttcattccttaaatcagtaagaaaccaagtaacatggggttccaaggcttacagtttgactgttttggataatgataatgagttttgaaggaatcgacttttatccctttctgttgaactgtcttctagctgtggcattgcatgagagggaagcagccaagaccgtaagagctgtgtcgctctaattaggtgccaggaggaagtggaaatgaattcagagccacacattctccatttttcagatcttaaacacagaagacactatcagagatttccaggtgaccacaatgagaaaagggcctttcgtcccactacatcttgcctgggatgcaaaatctttagtttgtttccattattgataaaataaacatatatagtacatgattttatgtcccccatgttcatttaaacaatttatagtgtttattatttgtctgattttggaaagaatacatatttactatagaaaacttttaaatgtagtaaaaaagaagaaaaagcctgctgaaattccctcactcggaagtacttattgtaaacagtctcttttgtgtatgtttgtttgtgtgtattactaaattgtatgtattttgtatatttaattttatatcctcttttattcactcaaaattatacctttagaattttctcatataattaaataacttttaatttataaacttgtgaaaaaatagctttataattttttattttggaaaaataattatttattgtccaagtattaccataaaaatactttaaaaaaagattatgctgctgacaaatttatgttagacttttttctttaatgatttcttcatatgtagttgttgtatagctgagcataggaaattaaaaagcctctttaaagatctgtactgtcttgaggttgatatttaaaggataaaagcaacactattttcatttgtaaaagtaattgacatttaacaaacatcgctaatattttggtttatattcttctggatcattcaatgccaatgtgtgtataaatgaaacaaaaatataatgaattcaacagtacattgcaaatatttttctagtaatagtatatgcagtctacatcatctcttctaatggctgtaagattttccattgttaggatagatacaaatgtatttaattaatatactgttattggatatttatgttgtaatttctcacttttatgaataaagatgtggtgatcatccttttgtatacatcttaaacacttacctgcttataaatttctagaattaatcttttcacactttttagtttgaagcgccagttctttttttaaaatctttttaaaatttttgttccttgagtttattaacttaaaacgaatgctactacaagcatttcttccatgccactaaactttagcccagacatacattttaacgcttgcataattttctgtcatatgaatatcattaaatgtatttaaccaatgatctttgttggaaatttagtttatctactatttttatgatcatgaataacactgtcatttgatgactttaagttgtcttaattctatattggttttttctttctttttttttcaacttgtattttaagttcaggggtacatgtgcagtatatgcaggtttgtttcacaggtaaacatgtgccgtagtggtttactccacagatcatcccattacccaggtattaagcccagcattcgttagctatccttcctgatgctctttcttccctcaccccaaccctgacaggtgtgttgttgttccccacaatgtgtccatgtgttctcatcgatcagctctcacttataagtgagaacatacagtgtttggttttctgttcctgggttactttgctgagaataatggtttccgactccatccatgtccctgcaaaggacaccatctcattcctttttatggctgcatagtattccatggtgtatacgtaccacattttctttatccagtctgtcattgatgggcatttaggttgattccatgactttgctattgtgaatagtgctgcagtgaacatatgtgtgcctatatctttataatagaatgatttatatttctttgggtgtatacccagtaatgggattactgggtcaattggtatttctgcctctaggtctttgaggaattgtcacactgtcttccacaatggttgaactagtttacactccctccatcagtaaacaccaattcttatatctggcatctttgattgttcatagaaaatctttggctttggctaagtgcagatttggggtgttgcctctttcagtgtgcaaagtgattgcataaatagatatactatgattgttagattaaattataaaatttcccttaggtggatttacaataggtcaggcaatgaaaaaagatccccatacaactggatatgtacagtggcaggtaaacccttcatttgggattgcagagacccagctatgaggaatttatgtagtgcagtggtacatgtgcttttatttttcatggttatcagctccattacagtacagctgataattagcatggtgttttatctccatttaaaaagcaatagctttctttcttctaggacttaagcaattaaataaaactgtgatttaaaaaggaaaatgaacttttacttcatgataaggtagagatttcaaggaaaaagaaaagtgtcctggataaaatagaaatactatgtttcacaactctaattttaagagtcattttcctatttactaaaattaaacgtcttcagcatgaatctgcagcagatcatacccacctggtgaagggtggaggtgtcataaaaaggcacaaaaattccatgatgatattttgttgggtcagtgttttggtggtgaagtgttggtgactgtgacattgctcgatatcatctgtattgtgtccttctactcccttgcacttgtgtgaaatggctccacatactgttgctttggtgctttggggctagaaatgaagtcttgttgatatatgtctgtctcaagtccctggtcacagccttactaaatgtctaatgagtattggatgaataaaaacatcagattatctgaaaggctggtagacagctgtctgaataccttttagggacagtttcatttattgtctattattaagactctaggctctaaatattcactgctaattcatgtattcactccttcattcctttattcaacaaatatatattcgatgccttctatgtgccaggcacaatgctaattactgagaacagagcgataggccaagaggacgcaggccttcccccatacagcaaacaagcacgcagcacacaatgggaaaggagcagcaacattctccagtctctccacttctttatatgggaggaaaaacaaacacaggtttgccgtagctttcagaacttagctgtgtctgcctgtatttgattcagtccataaagggcccaaatctccactctggtccattcagtgtggtgcctgaatcgtgattgcgatggcagaggtctccgtctagttcagtggtatgatatctttggactcttgctaacctatgcaacatgtgaaatgctggagaggaaaagcactttaaaaccttgctgaaagatacatgagcccatggggaaacacaaagctcaattactggtagaatcaaagagacagaggcaggctggcttggaaggggattgctcactttgtaagcaactgttctcaactcaacctgccaccctgcaatagcaaagaagaggaagtggaggggccggcagcaagactctggtgagctgagtcagtaggcagtgagctgagtctcaatttggggtaaaaacacagtcactttattgtttcctaataactgctccaactatggcatgtgaaatctacctcctgacctccaccccgcaccccagttagctggctctaatgggtctctgaacaacttggccaggttttattaattttttattcactttgattcttgggacagtctcactctggtatttagctcagttttgtttattttaaagcacaatgaaaattctggcgtctaccagctccgcctgctcaggctctagaacctctaggcgcttgcggcagaaggcaagaagagcaatcgctgaggtggagcccactccaccctcctctaggagctgctgcttcagtttgggcagggaggaggggaatattcatagtccctttctctgttgggggtggctgcttccgcgtgaaccctgcttggctgcccagccttctaatggcaaagtgttctggttctttcacctggcgggcagccctcttaggtggggtcctgataaacactccatccacagggagatcccctatccttgccacgccaaagggctctttctctcccacccctctcagcctcaccatctatctttccgtctccctttccgctttctccatggctcagggacagccagagaaaacatccaggagtgcagtgcctggtgtgtctagtgcctggtgtgtctggtgcctggtgtgtctggtgtctggttgattctgcagactcttccttttcttttctttctctttctctttctttctttctttctttctttctttcttctttctttctttctttctttctttctttctttctttctttctttctctttctttctttctttctttctttctttcttcctttctttcctttcttctctctttccttctcctttctttctttctctttctttctttctttctttttttcttctctctctctttcttttcttttcttttttttaggtctttctctgcacccaggctggagtgcagtggtgcaatcatagctcactgcagccctgctgggctcaaggaaacctcctgactcagcctcccaagtacctgggactgtaggcccagcaaatttttaatttttatctttgtagagaagggatctccctatgttgcccgggctggtctcgaactcctgggctgaagcgatcctcccgcctcggcctcacaaagtgctgggattacaggcgtaagccaccgctcccggcttcacttctttacaggtgatttgtttggagattcctctacccctcttctgtgttggcagggagggaaagcccttgtctcccctctccgtgggggtggaaaggctgtggcctcaccacaaaagcatgccactcccaaggcagctccttccctagtataaatcagctgggtggtgccaggactggtcctcttagaaaacctgtggagtggtaaacataaaagatggggtacttagcctattttggcctcagggtggggccttgactgtaattcccagataagagggaaaaatcctcacactttgttatacttattccccggataagtctttgaaccttcatgaagcttagttattgtacaccagctaagttccttttctttctttaaatagatgcattatagatgtacatagctttggggtacatgtgataatttaatatattcatataatttgtaaagatccaatctgttgtgtactgtttcttaaaggatctctgcaggtctatgtcatatggaaatgctcaactgagtccattctgtttcatcttaagcaagaaatcaaggtttcccattacaaatgagatgcccaagcccctcacctcctttttatggggcttaccgtgaatgtcttgaactgtttcttcaccatttagaatcactcttcactgcctttttaaaaatttccttttcttcttgcttaggaagctcgtggtcagatcaacacacctcctagctaagcagactccaaatggggaatgatgaatgatgcccctctggctaggtacccccaactttgattctcttggggcctccctcttcttcaggggagggaagaatccccattctcaataggtttttcttgctcccaattttcccttcatgttcgccaaggtgaagggcaattatagtgggggcgctggattgccagtcagactcttcccccagccctgctgagggccatatgtccaggggctctcccaactcatgcagcatactcagaagctgcatctccagccttggactgaaactataattctggcataaaatcccactgagcattctgttacaaaaggaaagaaccaattaagaagccagaagattgctcctcgtgtatcaggtgtcaaggtttataacttataagtagtccaaaaaattctctttggacttttaaaacagagatgcaatatggaaaattaagttcagatttaatgaacatttattgagtaccaactgtatgcaagcacagtgctagatgctttaatgcagattttatcagtcaatttaaccctagatcagctccatttttgagacaataatgatagtattttcagtaatagagttgctatttattttgtgtctgccatatgccaggcactattttcagcactctacacagtcttatcatttaacattcgcaaatgcaaaatgaagaagatattattatacttattttacaaagaaacaggctgtgaacaattatttacctaagggcagttaggcagtcagtaatgcccagagctagcatttaatgaatgcttactatgcatcagctcctcttttaaggatgtttgtggatgttaagatcatcattttcttgatggagaaactgagccacaaagagcttaaggaccttggttagggttacatagttagaaaatggtctgtctggctctgggactcgcaaacttccttactgtgctgaacctttgtggtaagatccacatttgcattcagggcttcaagtcaaagcctgatagtcccttatattgcagtgtcttactgcaaaggaatgaatcgcaaatgataaaatttcattttgtataggtgaattaacactttattctattttgatattgttaaaatcaaaggctgtttgtatcacccattcctcaagagccgtacaaataaagcagtgaggaaggaggatgtctctttttttcctctctctgcctgacatctctgattcatcccagtggcttagcttgagaaggaggcagggaaaagagggggaaggaggatgtctctttttttcctttttctgcctaacatctctgattcatcccagtggcttagctttaggattctttgctctcttaactatctagctctcacagcccacttgcttaattcccccttttatctgtaagaggtggaagcctagaaaagatgccagccataccatagtaagggagactatggcctgtacaactgagaaacaggagtggagcaatgaatcgtgtggagacttctgcgcacccaaaaagggaagtgattctttcatttctctccattgctgaaatctccatggactttcctttcggctacagtcactgtctctgaagtggaatctatgtgataatgttttgagttattgagagagaatccaatgtgtattttttttattaaaataattcacttgttgccttatgcaagtgtattaatcaaacataaaggtcttatcagtttcatttcctagagataaataatgttaacattttgatgtctattcttccagatgttttcctatttagagtataattcattatttaaactgggatacctgagataaaatgccataattatgccgggacaacaggcacaaactaagactatttccaacaaactgagatatataatctccttactgtgtatgaatttttacagctgtgtctacagaaatatctagatacactcaacatgtgttatacatggtgatgcacaacctctaagatgggtcccagtgatccccactcctggtattcatgcccttgtgtcatctgtctccgagtggaggctgcgtttagtgactcactactagaatagaataggatactatggaagagatggcacgccacttcagagattaggttatgaaaagaccatggcttccattttgagtgccctcgttctctccctatgggatcactcgctctgggggaaaccagctgccatgctatgaggccactcaggcagtctatggagagacccttgtgcgaaaaaactgcagttctggttgatagccagtgaggaactgaggccaccaacaaccacgtaagtgaactaggaagcgtatcctttagcttccgatgaccgcagccccagcagacagcttgactacacttcatgagagaccttgagctagagccctccagctgagatactcctggctctcataaactgtgtgagaaagtaagtcttggctgttttaagctgctaagtttgtggtaatttgttatatcataatagataacccatccacatttattaaataaaaaatcaaatcacgtaataaattgtttttaacaatatcctctttcccacccacaacgtctatcagtagataccccacttagtatgtgtaggacaaagcaatactgttttattttttaaagtagataaaatgtaaaatgattttagagttgaccataatgtttctccttttctttttttaaataaaaaaaatgccttaaaaatccttggaaacatgttttttgctcctgcaattatctccacagagtagcttcttaaaggaaagatttctgggtcatgagacagcacatttagatttacactgatatttatgaattgtgttccaattgaagtcatctgttttgtgaccaagagtgtatgagaaagcctgtttttttttcccgatactgaatgttatcaactttaaacaattttgccaatatataggtgaaaaattataattgtattgatgagtgagactcagctctcttttcctgcgaggggcacattcatgtgtcttagccactttcttcttgggtggttcatcttttcttttttgatactaagtgttctttatttgttaagggaatgtagtagacgtttttgtcacatctgttgcaaatatttttctcaatttgtcttatgactgcttacgtttatgtttgaattttttttccataacgactttaaaaattatcaggcaatcaacctcatcagttttttcttttatagcttttgagccttcgagtcatgaatcgtgcagcccaaaacattttcatctggtatttttatgatttaactttttgcatgtaaatttgagatctatctgtgatttgttttagtatagtgaggtagagatccaactttttccacaagatgttactgaaacaaaaacaaaaacaaaaattcacctctccccactaatttgtaatgccaagtccatccattctagataatccaatatgtgtgggtctatttcagaagtcccacttttcttccatagttgtgtctcacttgttcttttctaaagccataccatagctttatagtacattttaatatatgctgggccaatcactgtttctttgtcagaattttctgtgctattgtgtcatatttttctctcagatacaattaagattgttttgcaagttcaaatgattcttgttgagattttttatttgaatttcactcatttatatgttattattaagaactgaaacttcttgtttaagaatatttacttgtatatttaattcttattttattttcctaaacagagtatttagtttttttagaattctatcttttttaaatatttaatttaattttattttaagttctgggctacatgtacaggatgtgcaggtttgttacacaggtaaacgtgtgccatagtggtttgctgtacctatcaacccatcatctaagttttaagcccctcaggcattatctgtttatcccgatggacttttgactctaagaacaatgatttcaccatacagcattgcctgtctgtgaggggaatttttttttttttttttttacattaaggggtttgtgaatgtgaatttatttgcttgccctaactactcttatctcttctggattgttcagaggtgtttagttccctcattacttcaaggtttgctgctgcatattctcctcttgcccttcactataggttctcggtttgaaaggaaacacagctcactgtgagatgcttaaatcaaaagaatctggtttctggaaatgtcattattttaggagggagcacgggaggtagagaaggaaaatagtttagattcttgtggggaaatggaaagcaagaggaaaaatagatgttctgctcagaaaggaaacttctctaggttttaaaaatcagtacgtgttaattttgctatattttctctagcagtgggattactgcatgaatcttactgggagaaagaacggttgctctaaaccaagtcctctgtcagtgaagcacaggtctgtgatgggtggttgggatggggatgaataaggagtaggaaaaatgacagaaatagacgcttcttatttgcaagtgatagaatttacaactctgtttagcactttttttttttaaattcaacgagtcattattgagtttctactatgaggacagcttcaagggagaatataaagaaagtgtaaggcatagtctctgatctccaggtaattgtaactagtgggtcagacaattaaatgctggtacttggtagcagagaggagtgctgaacttaatcttgagggtgagtgggatttgaattggcagagaaacagtcatgcatattctgagcctgagaaaaatctgagaaatggtttttggttgagagttagctgaatggttggtttgagcagcattatgtgagtgggagaaatgaaagaaaaccttgggcggttaggatgagcttcagttggagtttgagagttatcgtcagctctggagtatgtaagtaacatggtaactgtgattaggagcatgaatctgggagaagtacgcctggagccagggatgtgagttaagaaacagtcatgccgagagcccagtctagagtacaaacaatgggaatggcatagaatgggcagatctaacagacacaacagaaaatcctccagaataaggaaatgattttgtaaagtttgtggaagagaaggaagatacacaattcaatactggacaggtttgacactacttgggtcctcttgctctatatcatggaatgtggaccagaactgagttttcttctgctaattgagccagttattccatttttttctttaaatttttctttaaattgttagataggattcttgttgtgttcctgtaggttttatcagttatgcactgaattgtcttcaagtgatcctcccagtagatgctctggtgactgaaaagttaaagctatcaccatgatggcatacgttgaggaggaggttaaacactgtgttaggaggcatactggctggctttcttctctctgggttaacatattttggccttgtgggataatcatgtttgagagttctttgatggctaaaaacataccgtgaagggtagtactagtgagcatggaggaaggagggggagagtgcagggtttcatgtagccatgttgtcagtttctctgtcctgtcccattttgcagcagctgtttgtacatgtggtgggattaagctagcaggagtctggatggatggggaaaacagcttccttgacatccttaattgcctcctttatccctcctcagacaaagcaactcacggttttaaggaccacaaaatgcttattccaaatgcaccccttaccctacaacaaacccaaacatagacacacctacatggaacaaatgcaaccaaaatattttttaaagagatagacattttaaagaatgaaaatttctacatttgcattatgagcaaataccagggcataagttgaacatatctgctggtgtcaggtatctggacactgattggtcagtccatatggcctggggcaccttcctgctggcaacacatgctcatggctccatagacattcctggcatgttccagatatagcagtacctgtgtgaaagttaaaatcattagcgtaaaaattggtaaattggctttatgcataaattcatcaatatgagtgcaattaagtatacgttccagtgattcttttttgttgttgaacatcgagggtatccagcttagttgtctagattcactgaaataggtgacatttgtggacaaatgtttatccaggccctttggcacaggctagaatcctcttgcttctcattttgagtgtatttggccattatcccattttctatgcctcatggtttctgtgtggagataactcctccaacatttgttctgttcctttcctatttccttcattggcaaaactcaagtgtgtttatttggtagcttgactgcgctgagctttcttgcccttttatcttacctgtttttactgttgttgaaaaaaaatgaacttaaataatactactgctgctaatgcctaagtggttgagaaatgtgacagtttccatgcaaaggggtttatatgtatgagctttattagttctctctactaatgtatgagggaggtactatttaatttctattgtgcagttgcgaaaactaaggcttagagaggctatggaacatactcaaggtctcatatgtagtaggagatagggccagaattcacatttggtatggcctgcctccatgagctcggactctaccagcgcatttatagatgattcatatttaaactgtaaattttacagatatgtctcaaatttaaaagttattccaaaattatggcataaaatatcaatgtaaattatcatctctgtataccaaagggttagaccagtaattcacaagaaatgaaagttttttgctaagctaactaaaagttctgattaaaacttttagaagacttcggcattgaaaagaatatggtatactcagtttagtaaagttttgcttgtgtccatcgggaccactttaatgcttttaggaatttaaataccaaattatttttacaaatttattgtttttttttttttttcatttccgtgacgcccctacttggttgccacaccaaatacaaacaatctgcttttgcttaatccagcaatgactaatttatatttaccaacaagagcaatagcaattgaaaatcgtagccaagtccccataacactaatgatgcactgaaaaaacatgtcttttccgacaattgtgggaatttccaaaccgtgcatgtgtctgtgcacaaaggaagcattgttctgttgccaactgctgctcagcagccaggcttctttggagaatgttgaatgagaatccttggtaaactctcacatgtggcagttctggtgtttgaatactgaattttaataactcttaaaattaacttagtagattgctactaggtggtcctccatcacaaataaaaatcaaagtctggggaaagatgtgccattcatttattagaacctaagaagtgtcttttggttttcttcacttcatgtcctattctaggaccctggtaggcagtatcctggccaaaggtgatccaggagaaagagccaggaggggagattttaacagctggttagtttatacgtttatttagaggagagggagggttttattaatgttaaccctctacctttggggcaacacactagaatttatggggaacatcatcagctcatctcagttgtggtttatgtacccacaaagcctggtaggttgggtgcttatcagcatcaacattttagaaaggagcaccagagaaaaagtgtaggggacttgcccactgactaattcctcaattttgacagtcaccttcatcctttttgactatgggatgaagcctaaatttcctagccagccatttaaagtcctttgcaatggaggtcttgcctactttatgcaattaatctcctacataaactattattgtttatttgcttgctgtgtgtactctgctgattgatcgtgccaagtactggtgattctgttgatgcatcatgcacagtttcccaaatttaggatttaatgggctagagaattgccaaataaataaaaacatgaatagtgttgatgattttgtattacagcaataaggaaattataaaataccaccatttcattgaagcctttatatgttaacattttaaaaagtagaaaggacatcatctcagaataaagaccactaattaaaataaactatgaaaacctcacacattgcctatattttcctcattttgccagagacaattgaagaaatagctgtggactggcactggcctgtggtgtttgggaatgatgttgcttagccttttgcttgtctgaataaatccttctagtccttcgattctcagtttacaccttgaccttagaaattcttctatccccctctacctgctgtcttgcaccccacccacccttccaattatctctctaggtggcagtctgtgtgtcctcttccaagtactgataagatgtgctgggataatttgctgctgtctcttgccacaagaccatgagattcttatggacagaaactgcatcttattcaccttcattcccaaagtttagcacgtagtctttgacacacactcagtgcataataagtagtaggtgaatgaatgaatgagtgattacctggatgccctgcctgttctttgtgttttgcatgtcttctgtgacctgcagttttgagcacatgggatttattgaaacaaacactaatattcattaaattgaattaacttatgggttttgacctcatcagttcttctatttttctttgctgaagaaaactaattatgttctccattatcagagtgtctgggaacagtctgcagctgctgtctgaaacacttacaggggctataatgcgtgtctcagctcttctgttcagcttgtgtttttctttagtcaattcattttgggttgccatgttgatttatcatatttttatttatttttatgggaaaaggaatgtacgatattgtaagacatgctatctagtgagtgtagagaaaagtcagcattttttgtagtctgatttttctaaatccaccgaggcgtatatgctttgcttttatgttgttattgtttcttttttaaaaaccacacttgtatttgccttaaacattttttgaaatcaaaacaacatatccagaaagcatagatgcagcttctcttaagattcagtggtgatctgagctgtctcatttggggacatatggtctctaggcaatcgagttactgtattgagcattttcccagctcacaagatgactgtgacgagttattgcactgactcttgctcagtcacagggggaacctgccactttgtctttagcacagacaggccccttatagacacaaggttgtgcagccactagagacctgggcttcagctgggcttggatctatgccttgaaagaaacagatcttctttttgaaactctcttgccttccttctcctagtgttttattcttttgttaatgaaaataacccatattcatagagtcagaataacaattattgatgggcacttcctatgtactaggtactttatacaccttatttataagcctttcatttgtaatcagctaattttgtccttattttataaatgagaaaactgaagaccagagagttgtatttgaccgatgccatagagcagtaagtggtagcatcaaagctgtgtaatctccaagcctctgttttttccatcacatcagtctggcttccttcttttataacctggatcatagctgtgtcattttgtgcagctgcttaactcttgtaaagataaataaaagtacctaattcataggattgttttgagaatgaaatgaaggtaatatatatgaaaggacatggcatagcatctgtgcatagtaagaacgaaatatattttttaaatttcttcttctttttcctgtaggccctcctttcttcactgatccagacctacctttctactgccaactaaagaatgatgagattcaaaaatttggaaaggagagctttatttctcataaagtgttgcagcctgaaagtggccattcttctaggtttggaagcatagcctcccaccagaagccagaaacagatactttgagagaggggcaaagggatcaagaatttatactgagcagagtggccaaatctacatattcaataagctacagaaagactcatgaatattaatgaaaggagaaacatgtacatgtacaattgagcttcatgccccttcttgggtctcatgtgcaaaaagcagtggtgttagcatgatctgagggtggagtgtttggccctctgatgtcaaaaggtgaagcagaggacacaaagacccttactgtgcattctccatagactggccaaaaccactctgtagtcggtggtgtctcatcaggcaaaaaggaggggcagcgtcagatggatgttggacatcagtggtggagttctttgaaagggccggtttctctttagtctttagggaagaaaagctaatggtagttagcgagggaggaggtctagcaaggtgtgtccaacttcctatccctcgtcatggccaagaacttagttttcaagattatcttggggtccccttcgccaggagagtgtccattcagttgcttggggggcttaggatttcatttttagtttacaatactttagacatctcctgatggtccatcgtaggtctgttctcttttgtatctcttttagagatattagttttcttgggatggatataaggaatgtggctgtgactcaatccttcattatgattagaataataaatgctgaggatcaaggtgtaagccttgggacaatcatatttaggtgatgggaggaaaaagtgctgttttatcaggggagagagaaaaagcacttagagaggagttgatgatatgtaggatgtgagactgccgtggatatcagggaagggagacttataagaaggagaaatttggtcaactgtgtcaaatgcttcagcgatcaggatgagtaatgaggaacggccatttgatttgatttgatcattcagatatctttaaagacctttaagagggcagtttcagtagaggtaatggactggaggaaagtaataaggatggtgaagaaatagaggcggtaattattttgagatatttggtttgtcaaaatcagagagattttatcatatcttgaagagatgtcatatttgaaagaatttttctttaatttagttgagaaataagtatttttatgggcaaaaattaaagatctagttaagaaggagattttgaagatgtcagagagcagagataattgataggtaagtgtgtaccgattttgaagaaaggctgagaatctaatgtcaagatcacactgagaaaactgttaatagtatttttctttgtatggttatgttcttttttaacttttaatttcttctttgttatcttttatatcttctagattttctataacaagcatctataactttcaaatttttaatagctcttaaaagttaagcagatttaaaatgataaaacatgttcatgacactaagaaactataaaaacatataagatgaaaattataacttcccacatgccctaatattttatttccatttctttaaagcaaccaccatcaaaaatttacttggtaatctgggtgtggtggcacatgcctgtagtcccagttactcaggaggctgaggcgggagtatcacttgagcccaggaatttgagacaagcctgggcaacatattgtgacctctcatctcaaaataaatttttttttcttggtagcccttcagtaattttttatacacgtatgttttaaaatcagaaaactgtattgaaaactcattagtaaagaagttaagcttgaaaaggataataccacctggcttatgattttctgatccctcttgaaagactaataacatgagaagagaagaatgtaaataggcataaacttgtaagaatgaagatagtggaagagaagaaaatagcagacgaaagacatcaacaaaatattaggaggtgaaaaacagatggcctagtgatatctgattaggagagtacagaaatctacaacttcagtactcacaacacgggaagcagtaaaaggaagtcagttctgttgcaaattcagtgctgatgtcactaaaaccaggaagatgggctggaagtgtgtctgctctccccctacccacaggtgcaaggagttgccctttcccatctgttagaagactggagatgaaacagagaggcactggacttgggacattagctgaagacaggaaaggtcgtatcctgaagagagagacctcagaccatcttatcacccggctggcagaatgttagcaactaggcttaaaccataccaagatattggagggtttctttctggggagattgactaggccaagagaaaagactgctgttatgtggagactgacatttgtgaaatggctgagtccccgtggatcaacctctgatgaagcccagcgcttggtaattaccacccaagcataaagatctttcagtcagctgtgtagtgcctcattctcaaatgtaaatggacagctatggatcagtaaatatttctagaaagcctctcacataaaaaaacagagaccaaacaaagcattagaaaaaacacagaaaacagacaagcaggaggcagaagaatacacaacaaatgatatagttatgatccttccaaagaaaatatactgctttcacaaagggtaggaatctgtgcaaatagaaccctttgaagccaagaaagactttttgttcttaaaaaatgtgatagtagaaattaaaacatcaacaaatggattagcaaaataatgtttaggaaatcactcctgaaaggacagaaaggaaaaaaagtgataaaaatgtgagaagtatggataataggagttccagggagagaaatataaaagagagggcagaagttattaaagaaacaataaaaggctgtttccagagctgaaggacctgttttctggttgcaagggaacaccaagtgtccagcacaatgaatataaaaagacatatccaaggcatattagtgacatttcagaatccttaagttaacatcttacaaacatttaaagaagaaaaatcattataataaaatggttacttctaagaatgatgtcagattactgaatagaaacactgaaagtcagaaaacaatgaataatggcttcaaaatctaagggaaattatttctaaacattctggaattttgttacccagccaaactaggaagtggtttcaacatccaaagcctcaaaaattgtactttgcttgtaccctttctcaagaaagaaatagattgtaagctattccaaaatgagggcatactaaaaaaaagaaagaaagaataaggtgtgaaccctgaatatgtgagacaggtctcagttaacttagaaagttgattttgccaagattgaggacgtgcccatgacacagcctcaggaggtcctgacgacatgtgcccaaggtggtcagagcacagcttggttttatacattttagggagacataagacatcaatcaacatatgtaagatgtaaattggttccatccagaaaggcaggagaactcaagcagggaaggggcttccaggtcacaggtaggtgaaagacagtgaaaaagatatgacctaactgattccatcttgcttctaacctccaagctgtctttgttcattcctggactttcggaggaacttagtttatagtttagttttgaaacaaagatgatgatagtcctttcccaaaacaaaccttcttactgcctgtggactagactgcccaaaaccacaagattagaagttatggtaattttactaaataattcaagatgtagctattttcattaaaccaatattaatgtcttatttattaaaaattacccaagcaaagatcattctgttttgggctgggtttatagttaggtaaccccaatgccaaattttgacaccttatagaatttgccagggataagtatgagattgcttggtcaataaatgcaaacaaaaatgtatgctaggctgggcatggtggctcatgcctgtaatcccagcactttgggaggccgaggcaggtgggtcacctgaggtcaggagttcgaggacagcctgaccaacatggtgaaaccctgtctctactaaaaatacaaaaattatctgggcatagtagtgggcgcctgtgatcccagctacttgggaggctgaggcaggagaatagcttgaagccgggaagtggaggttacagtgagctgagagcacgccattgcactccagcctgggagacagagcaaaactccatctcaaaaaaaaaaaaaaaaaaagtatgctggaaattcttaagacaattctaatattaccgtacctgtaattttaaagctagcttatttattaaagattctacttaagtcatgtacacttgaaaaagcatttgactagtctatccttttttctgataaaatgtttgatttaagcacttttatttttctttaagcccattcattagagctcttttatatatttttagcagtgaaacattgtgtacacagcacataaataaagagatatattaggcataccgatagaagtacatttatagattcctaagacctcttcttttgtgtttttcctatcttagacttgcaaactcttgataatctgtttcatcactctggcagttgtcagctaaatagccctaaatctgcatattgaaggaaacaactcttagtgaaaaatcagatagcaaaatttacatctcaaggtactgaaagaaaaagtctggtagagctggagagagattaaagatggatgtcaagcacaaaattatacaaatctaccataggactgtaagaggagaccagttttatttagatagggactacttgtcttttaactggatctgagctctgggcagagcccacattgaatcctgggtctccaaaaaaggagaattattatgaggctagaccatgtgatgcttttacagtgcactttaaaaaaggtttttttaaacaaagacttttctgagtgtctaaactacactctccctaaaaacctgagagtagcctctgttgcaataattattttagtcaataaatcagataacaaaatacaaaagcaaatagtttaagagttgagatgaactggtctgtttatgctcttgggattccataaggaaaaaccggtttctcccccaaagggagtctggcactttctctgttttctttaaggctgttataaactattttaggttcctcattcagcagagggtgcaagagaaagaagagacagaagaagtaaatgaagaaaacagaattcagtcaactgagaagaaaaaaacttttgctcaaaaaaaaaaaaaaaaaaaaagaaaaagaaaaagacaaggtcctaggagaaaaaaaatgccaacatgaaggccttttaaatacaaacacatagacacacatgcatacatttttggatgttagcttgtaattaagctgacttttaaccactgagctccttaaaaaaaatctttttaaatcttatgaccgtagttcagctggaacaaattgctgttattttagaagtaccaagtatcaaaccagaaagggcttgatttaggaaacaaacccaggctattgtggtggaaaaaaagatggcagaacccttagctatggaacagcagcgtgagacgacagccattgctcttttggttggcctgactagcaaaaaggtggccttgttatgtaaataaagccttttaagtagtcaaaaatgaaagtcttttctgttttttgctgttcgtttttctccctgtaccacaccacttttgtgtgtgtgtgtgtgtgtgtgtgtgtgtgtgtgtgtgtgtggcagggtggtggtggtggtggcggggcggatttagccacttcagaggccttttcccataatttggaactttccttctaatttgattaagtcggatggagttgatcaaacccaatgggaaaaagacggaaacaaccacaaaaacagaaacaaacaacaaaaacaacaacaacaaaaaaagttaagcaaaacaaacaaaaaacagttaagcaaaacaaaacaaacagttaagcaaaacaacttatacaactattgagcattctaatgataaggagcaattaaaaccagctggttgttaatcttaactttagccaaaaacaaaccccgattcagttacttacctaggaatgggtctcaggctgaagactgctctctaccatcctagaagcaggaaaaatctcaaattcatcttccctgttggaagagagttcagacatcataaaatagttacctctgccttccattgccaaggaagcaggaaacctgctttccctgtgtgggaagcaagccaaattccaaaaaaaaaaaggagttgtatggcaatataaactttagatcttgacctaattttgggagatcagggattctctggagggggctctttcaggcttcagcaaattgtcctaatggcctgagccttaaagctacctctagctggtaccaagcaccaacagaagatttggcaaaggtcagaggcacctccacttagaatctctttgtggttaccaaaatgtgaaccctgaatatctgagacaggtttcatttaattcagaaagtttattttgtcaaagttgagcacgtgtgtccatgacacagcctcaggaattcctgacaacatgtgcccaaggtggttggggcacagcttggttttatacacattttagggagacataagacatccattgatatatgtaagatgtacattggttccatcaagaaaggtgggacagctcaagcagggagggggcttcaggtcacaggtaggtgagagacaaatggttgcaccctttttgagttctgattagcctttccaagggtgtcaatcagacatgcatttatctcagtgaggggagggatgactttgaatagaatgggaggcagctttgccctaagcagttcccagcttgacttttccctttagcttagtaatttttagggccccaggatttattttcctttgacattttcccccttttcttttctaaaatttttggagaaaacattttacaagaaaattagcctttggtctcaggttttatctgatctctcatgtctgggatggtttattcctatataggtaggtcccgagttattaggaaagctcatttttagcaggttgagaagtctcatgctctatgaagagaaaataggggaggaagggagaaaaacaataacaaaagaacaatcctggaaaattggtataggccacattactctgaagtccatacatcagtaggcaggtatgaaagtggcttatgtgtgtaaataggttgctgttattttcttctgaagtttatttaagttgtctaaattcagttagcagggctttaagaaagcaaaggttagtttttagtgatttcaaattaggaaaattggggggaaaaaggaaaagaaagaaaaaaatcgaaaacatcatttttggatacttgcagccaggaaaaattagaattcagtctaaacttagaaaataataaaaattgaaaaaccttaggcaaaactggaatctaacatcagatgtactatagtttttgaaacataatttttctgtctccagtttcctatttttactaaagacaaatcatggtaggactgatttgctttattatattgcccagattatttgtataaagtacagcaagaataattatctttcacataggctttttatattggctttgatggaactttgttccataaaaggaatctcagataagatttttttaaagctgagcccagccatggatttgtaccatcaaatacctatgagttggatgaattactctcttcttgaggttccaaggtattaaaaggctggggctcctgagcctgccagaaagtgacattctttacttaacacaggtcaggaaccctgtacaggaactgcatagacaaggtatgaggccagctttcccaaaaggcttttattggctttctaagccaacttcgattccttaaaggaaagcacaccatgccagtcaaagccgtggtaaaataatcagtttctccaactgtgtcctgttacaaatgaaaacatattcttattgaacttatgcaaataactatattgccataagttaagaatattcacaaatagtttctgaattctggagaaatcaggtggagagaaataaatatgctccaaattttatttataggagtatacttaattgttaaaagctgtcaatagctcaaaaaaaaagtttcctttactctgaaaaacaaaacaaaggatcagcaacattttaagcaaaaagtcaaaaatattactccagtcttctattagtttagtctgtgcagttaatacctattctgcttgatattcataaacatttcagctctccatgggtcctgaaagttttaccactattctgatgtcacaatctccagagttatcagacaccttcattcaagagcacttgttagagttttacagctgattataaaaccaccttctaaggaggatcaaaacaagacaataattgtccatggatgacaaaaagttttagggcagccatagtcaaagacacaattgacaaagaaatttattacctctgtggcacacaataatttattataacaattataattattactgaaaatgtacactaagtcatatcagaatgataggagtgtctcataattttggaacacataccaataacatatttatacaaatacaacccaaagaaaaccaaacaccatttcagatttgacgatgcttcctatataatttttataccaaatacgtcaaatatgtcaactttggactttaggaagcctaacatcttaaaggattaattaagtcagaaaaatacaaaatttataatttgattttgagaagtttgtcaaatatcaaaggttaagacatttgctatcacaaaattggatcacaagtcattgtaaaataagtcattcacttaaacaaaatgataactcaaggatttcaacaaaaggcaaaaaccttcagtcttcgagagaggagacttagttttccaaacaataagccctaataaaaacagcacgaagccaatgaaacttgtttttcaaaattttataaacaatctataaaattgtaatcttgaccatgagatataacttcaataagccttttataacctttctaagttttattaaagagtcagttaatgcttcaagaaaaccttgctaatctgatacaggggcccatatgttggtcttgcattagtgtgcctttgacgttaatggttaatttactgaggaattgaacttatttcatctctcaatattggccttacaatctcacatacccacctcttctgcaatagtccctggaccttgaggagttgaatagctttaatttctggccttgtgtctcaggaatgcagtttattttggattggcattttatagtgggcctggagatgaggctttaattgctttcagtttttaagatttagcaggacttggtgtcctttttagacccaggagtcaaagccctgtaactcaatttcacgaggactttaaaagcacataaagatacacagatgtaataaccttaattaaaaaataattcttttaaatcttagttttatttctaagcaaaccaaaacttaataataatggcataggaataattttgataaaatgtaaaatctgttaggcctgttaccaaaaggcaaaagaaaagactttctgtagtgcacagaatatattatgttggaagaaatcatttccttcagacctttaagaaaacattgttagcatcaggccacaacaaacagaacttgaggggaaaaaccttatatgagctgaaaatgagttgaaggagagtgtcagtattttgtggcttttaaaaggggagagaaaactgaaaatggccagatgcaataaaagttgaactttgggttaaaaaaattaaaatctcctataatttgttaagagtaagtcaatcccttaagaaaattttattgttctaatcaattttttagtgtattagtgttcttttacatcaaacccaatctctagaaagaccattataatttccctttaattatagacaacttgatcatataaaaatttttttaataaatcatcttattggatttatactctatacattttttaatacagcctcttattggacttacacagactattcatgacatgcttggactttctggtttgtcctgaacatccctctttcataaacaaccagaccttttattctaagactaaatttactatataagattccttctcatataaaatgatttctctttaagctttcttaccagaaaatacctctttatttctataactttctttacatctgtcttatttcctggttctttttaccttgttttatatacaacagttaaataagctttgaattagacaaaaattgttcacctctttaaaaaggacactttttttagaaagaatgttttcctacaatatatttttattggaaaatacccaaataatgaaatatctattatttaatctaatataccttcagattctaaattatgacaagtttgtctacaagtatttatcccattacatttacctcattatcttctcagcaaactgaaaaaaaaactccatttcgtttctcattttccttcccttttgccagttgtcgcttctttattcactccttgtcaaatgattcattccgtctacatttgtaatatcctttattttctcaatgcttccaagtttaaaaaaaaatctctacttttgtttttgtttctaagcctatgcttctccttaactgttgctttcaagtctctcaatacctttgcacttttctatcaagatggccagtgatattcacaaaacaatattaagtacaaatgcagtgaacacagcaacaagttgagggataatgggtggatgaggtggcagtgcctgcctgactgttttcacaatatgttggtgtggagctgagttgacccactggaagtagaaaatagctttgtttatgtctatgatcatttatagggctgatgtttaaaaagaattacctttatgtgatataaatagcttacttcctcatgatttgacttgatatagagaaagaatattgagagtaggaaaaaaccatgcacaaactccactcaacaacaatcaacacagacttctgtgaccaaatgtgtggggatttctccctaccaataagaaagcaattgattctgtggtggacccagctgggtgtcttccaattcaatttcaacactgtctacctagagatagagtcatatcccacaggatgagggtttagtccctgagactgcccccgactttagatgccagtgacaagccccaggttgttttaccagtgcatctgactgactggctataaattggggattccacaacctcctccttgggttcgattaatttgctagagcagttcacagaactcagggaaacacatttactgtttattatacaggatattatgaaggatgcagatgaagagatgcatgcagtgagatatggaggaaggggtgcagaatttccatgccctcatgaggcacatcacccttcaggaacctccaggtgttcagctatacagaagctattcaaatcctgccaatttgggtttttatggaggctccattatgtaggcatgattgattaaaccattagccactggtgatcaacttaaacttcagccaccctttcctccccacagtttggggaatgcagcttaaagttctaatcctgtaatcccgctttggccttttaaatgatcagcccccatcctgaatctacctaggggtctctagccaccagtcaactcattagcatacaaaaagacatcatttttgagtttccgaggattttaagacttgtatgccaggaaacggggtcaaagagcaaatttatatttcataatttcacaaatataaagattctagctcccagaataagattcagctagcatgttccttaatggaaagtggatgacagtcagttaaaggttgttgacaacctgaaatgctgatattctgtgctgagtaaagagagacccatatgttttagacaagcaggtggcacagttaatactctgtaaagaaagttgggaatctttgacttgtgtttacacggaattccattctgtgaaaatggttcatagcacaaagccaaagtttttctcagaaaataattttgaatcttacccacagaaataccagaagtgtatgccatgaatcatgaaagagacaattaggatctggaaaaatttcaggacagacgctactgtccagtcctgtatctagtaggcagtgcagctgggatgagtccatggagctgactccagggtcttaccctctgaaatatgtcacttcccttatcatcttaatgtttgctggttcagttccctgacttaaaaaatctgtataattcagaaatttataatgctgtttctgtatcttttttctcttcctttaatttgctttgcctttcacaaacttctccccatctttcacagacataatctcagatctaggtgtcattacaacaagaaagaaaaagtgtttctgaatggagttcttatatctattatataatgtctggcctccccagtgctattcaggagcaccgtgggccatgattggataaagacatccccgctgcatcccaccctgctgtgtaaacacgtatattcgagaaatggttcaattataagtcactgcctgcagtttggagcatctgctacttgcgcacatgtctaaaagcccagtggagtataggtgttcatgtggtgactggtacttgtgatctggaccgtattttcagctgttcttacgatgactgcccaactactgcctctctctgagtggatggacctgcccacccctatgctcctgctcaagcctccagaagtgaattcattgcatctctccaaacatatgttttaaacttcagaccactgaaacacactctccagatgtgatagatacccacttccctgtttttctgtgatgccattaacagacgaacagaattttattcataaagatacgaattcatgtataacagaaatattttcttgggtgggttttctcatatctgagcatggtgttaaatgattatgaggggaatcaaaattgaagagtctaatagagggatactttgctgtggataggacagagacaagagtgagagagggtgggcttgacggggctggttagagaaaatgttagaaatatgtccaggagagaaacaggcatccactggaagattttgtgaagtttctgttgtgcagtggccccacaccctccattgcaacttctagtcaaattcaaatgtcttgctgtgcttttggagttggatttattcttgaggatctgtaagggagggcagattcttctccttttcacttagagtaagtgccgcatgcacccaaccctgtgtgagcctctcccccaatacaccagtccgtcccatgctcactttattctagattcgctggtttccttgatggcctttcagcataccaggcatgctcctctttaaggcctctgcacttgttctttgatctatctggaatgattttgaaggacagcagattatgccccccaaaacagaccactatcacacggggatgacttcaagctaaagacacttgaagaacagcagatgtgagaaggacattcttatcttccctttttcttcctgaaggcaggagattaaaaactcccaggtgaaagctgccctccatatgctaggaagaaagaaacattctttgatggggagtcatagccaagagaattctgtacaagcagactttgttaaaataaatcgtcttcctttagccttgccatagtttagttacttttccacaaatgggtctctttgttcagccttatacaaaatcaagtaggttctttttgttggttggttctgaaacagggtctcactttgttgcccaggctggagtgcagtagtgtgatcatggcttactgcaaccttgaactcctgggctcaagcaatcctccaaacagcttcccaagtagctggaaccacaggcatgcatcgccacatcaggctaattaaaaattttttttgtagaaacagggtttcaccatgttgcccaggctggtctcaaactcctgggctcaagctgtcttcccgccttggcttcctaaagtgctgggattacaggtgtgaaccacagtgcctggcctgcatgtaggttttgccatgtctttgagtcctacttttcttatgagggctcccatatcctgtaaaacttacattaaataaattttaaaacttttctcctgttaatctatcatgtatcaatttaattctcagacccagccaggaccctacgaggagacagagagttttgactccactatactcttctttcagatattcacatggctttcttcttcacctccttcaggtctttactcaaatatcacccggtgaggactgacttagccaccctgttaaaaattgcatctttcccaattcacccaagtaaattatttattttgttttcctgatttctccattagaattagaaggcaaggtgtcccccctacctctgcccctggtttattcactgccttatcctcagtgcctagaacagcactaggcacatagaagttgctcagcaaatgtttgttgattgactgaatgagtgaggtctgaatgggtccagtcacttccagctactaaaataacaaataagtggttctcaaaagataatactagaatctttctagctgtatagatcagtaagcctgagtaggaagactgaaaataagtattcattgaaatccttcctagaaacattgatattctttaatccacataattttgtgtacttgttcaataaattataaaacaaatatgtattagaaaaaacaaatcctccttaaaatatttatatttcaaaagttccttctttcaattttctctgcccttactagagaaacacaaattacacatggcactaatctgcctttctttggaacacatttcctttatcatgcagtcatttcaaatgtgaaaaataaaatactgctaaatacaagattactttctggcttaagtagtggataagagttgtttttctctgtgtttgtagttctggcaaattatccagaagattaatctttgaaaagactttttattatatctgtagaaaacattattttgaagcaataatctaatgaaagtacttctccttcatacaatttaagagattttgatagaaaaataagatgaatacaaatctctgctctatatggagtgtgtatttcggcctattaggtcaatgatgttacctactgcagggaaccaatacagttgccccaatacctggggcaaaggtattgtctttgccccagaggcagtattatcaccacttgcctccattccccctccatgagcaagaccctgctgcttgattctcaaaacacaatattagaatctttctagctacatagactagtaggtataaacagggagactgaaaataaacattcactgaaattcttcagagcagcttctgccacttcttgttctagatcatatagaaaatatgtctgggccatcagccagcagtgacccttaaaaaaaaaaatacctgcttcaaaattgattatttcagacagatttctttaagtcaggggaaaaaattagcatatgctggcccaaactctactttcatgtgaaatctgccgcttagtttttagaataagaaacttctctgatttctatgtaggctactaggttcttcacttaaagaaaagcccccttttgttagatgcttaacttttcagcttctactctttatatggtgaacgtacaacttattattcagaaagggacatgtttgagaatagaaggagtaactattaaaaattatggccagaaaaaatttataaactgatattgtgtgaagcaaacaaagttgtattgtctctaactattaagaaggagaatgaaattacttactgaggctatataatgtgctaagtgatttatatcttttacctcaatttcaaaaccgtcctctaatagaggcttgggaacattttcagtcatgaatcaggctctgtgacattaacccaaggagtcaacaatattgtagtctaaaagaaattttaggaactcagctcaggacactttacaataaggactattgatttagctgtctgcaggaaatgcattagatacacattttggctgaaagccaaatgttaaaatcaataattgacaagtcagatatcattagaataggaagaactttggggagacaagattaaatttgaaaccttaccaaacattttcaaagtcaacatttggatgtttgacaatatagtgaaggaaaaataatttctcagcaccatccactggtggattattcctgtagtctctgtgctgcgtgtctgcagtcctacagacatgcctactttaaccagactaacatttagcatacagtggcaggaaatgggattcgctgctcagcaaataccccaaatcctggatcttctactactgaaaatgtttgtcagtctaaagcaattattttgacaagtgtttgtttcttagtctcgaaacagacaacacagaagaaaactataaggaattgacttcttcaatttgaattttgattgtggaagcaaaatgcacattgcaattctctgctttctctaacactgtcttttttcttcctatttgttatttattcattcattcagatttattcatttattttaattatggcttttagattcagagggtacatgtgcaggtttggatatattgtgcgatgctgaggtttggggtacaaatgattcaattattcaggtagtgagcatagtacccaataggtcgtttttcagttcttttctcccattctttctcccgctgctagtgctccccaatgtgtattgttctcatctttatgtccctgtgtacccagtgtttagcttccacttataagtgagaacatgcagtatttgttttctgttcatccattaactcacctgggataatggcctccagctgcatccatgttgcaaaggacatgatttcctccttttttatggctgcataatattccatccatatatatgccacattttgtttatccaatccactgttgatgagcatctaggttttcaataaatatttattaagcacctttataatgtctcagtcagcatttcaggaaatggggatacaacagtgaacagaagatagaagtctctgcctttatggagtttatattctgggtcttagggatatagacaataaacaagactataaattaaatatatagcatataaatagttttaagtgctagagagaagaataaagcagggaagagggatatgaggaattctctattgtgattggatcaaagatgatttctcatgatattatttttggagtatttattcctcatggaactttttgagggcagatttaacatttaactttcagttcttcataacaagatgtgaagagttccaatttagcatttttttttccttgaaaatctcattgtctaaatggaattaaataactgaaaattaaatatagttcttcaaagttattttgtctaatgttttgagtgtcagtatgtaaaataattctatgaagacctgacttatttaatctcaactctgttattctgctttatattatttaaaattttataaatattcgttggcagaataattatgtggtatttttcctaaggttatattccagacacgctctgacttaatatttcctttaactgacaatttactctcctaggtagtaaataattcctcataatttttttgtacataaaactaacagctttcataataaatttattattgcagcattttcttcttgcaatattaaatattcacttacacttcacctgactgatagaatttcaacatagaaagcacataaagagattgtcactgtttacccctatattgcgtataagaattttagattgcatacttggttacaaacagtaaactctgatgacactccctgtttgtgctgctcacattgataccctgattagatatgaaggggacatgcaagatcaaatgatcatttgtcacatgcatgttcagggatgccagcactggcattgatttggatgtttgtatatctgactatttaaccttccaaaagctaagtctaaatagctacagtgtaacagtagattttggccagatactgaaactgaggtaaattcttgcccacccctcctgtctcaaattcagtcatctcttggaagggacacaaaagtatcagtcattggagtggcagcctcccaaccttcttcctgcctggtgaccaaagtgttgaacatggcatctgaaagcgtcataacaaggttcactctgatcctaggcataattaatggagtggttggattttcatccttctttgcctgttaagtgtcctcagtatctgtcttcctagtcggtaggcacagtcaacagatgagggcttcttggcttaattgatcttatgaattccattaggagggataagaacctgagtgatgttctagccagtggctcccaggcttcgtaagtatttacctttatgttgcggttatagcgtcattagctacaactattactgaagcttgaattcaaataaaaagcaattagatgtaattccagtactcaactcacacgcaactgaaacttaatgatctggcaatttgaacatgaatatgaaaaaggaattcctttagcttttttgatcctcttattttattgtctgccacaaaagaaaagcaaataatacacagcatcagcgcaaagcatgaaaaaggagataggagccaaattcgctaaaaattctaaaagctggtctatagctgtgctccagaattacctgaaggttagacggacgtgaagtccattatttaatctgacaatttcctagacatcaaaaacaacaggctgcaaatctcagatcaggaaacccttcctgcaaccctggatatgacttaatgtcctcctttttccaaacaaccacagatgtctgtgcacatctctgctgtgactttggtcacatctccctgcatacacaggaagtcacttgcttgttggtgccccttttcttgattatgttttcagaaggaagatctggttttaaattccattttatatcccaagaacctagcacagctttaggtaagaactcagtaaaaatcactactactacttctaatatgactactactattagtactgcagctggtagtactatagtactagtactattcctgtttttgctgctgctgccatatccagtgtagctggtgagctaatgaggaccccactcaggcacatgggatatgcatacacatttccacattgtggtttctttttagccaccctccagagatggtcatggcagagggaagatgtggagatctggatgaagggaaaagtttaagagtttatgacagaaaaaccactcatattgcaaatagtggtatgatcgctgtgaatttgctatacctcttggatttaaaaatatttctacacatgtgaaactttgtattttctatggcgtatttgttttcccccactaaaggtatgagtgccctagcatggtgatgctgtaggaggagatgtgaatgtgattcaacataatctaatacatattttatcaataattaagaaaacatttgctaagctaatgaacttaaacaagtctctgggtctcagcgtcagtttcactgtccataaattcagaataatgtaacctgtcttcttaggctattttgaggatgcaaagaggaaacaaatatgaaagcgatttgcaagttgccaggtactaggcaacgtaaggtgctatatggctgtgacaaattttccttctgaacctcctgtagcactttgtacagaatggcaagttcagcttggttggaggccagagccatggtcttgttggaaataagtacctgatgtgaggtacaaagacctggaagcaaagccctgccccaccgtttccctagttacgtgacctgagataaattacttgagaaaagaatattaaagtcatccagctcatgggttactgtgagaattcagtagaaaaatacctatgaaggcacctggtgtactgcggcagttggccagtgtttacacagcattttttttagggcagagaaagatacaaatgaatcaaaatggttctgagcaggtagctcgcaaagaggagaaagcctggactctgcggacctggcttcctgttctgccctgtgtggcctgagcaagtcctggaaccgctctaagcttgtttcctcagatgagaattgggaggaatcatgatgataataataataataaccatacccttaattatctcttagggttgctctgaggactaaaaaatataagatatcagcagacatgggataggaactaaaaatttagcctatcctccccccagatttagcatcgtgctggtgataatgctccttatttttaaagatagtcttaaaccatgtccaggtgttttctgttgactcaataagagcctaggatgcacttctgacaaaatgtttgcagtccagtataaaactttaccttagccaggcatggtggcacatgcctgttatcccaaccatttgagaggctgaggcaggaggatcgcttgagcccaggagtttgaggttgcagtgactgcattccagcctgggcaatagagtgagaccctgtttcaaaaaacaaggacaacaacaacaaacaacaaagaaaacctttaccatctctggaagccaccttttgggtggcaaaacaccaataaaaatgaatgagggtggagaagaagaggaaagagaagcagctaatgagaaacggagggccagcgtaggagcaagaagagacactcggtctaccaagtttgataagatgaaagctttcttcccgagctcttctccccttgtctgccttgagcccttctcttctgtccttctttccattgaaaccttcacgaaggcaaagccaacgaagatctcagagagtgcaaggggaggcacagtgtggcaggaagagcacctcccccgcaggctgaggaagcttgcccacaccgcggggctcctgcagctgcagccttactgactaggctgattcctggcaacaatgaggctgggacggtgtgacaataagaaggagaacacctaccacgtattgaactttcagtgtttgctctaccagtacgttctcagtgaactctcaacgaaagtctcatagggcagttctgcagccccttctctttgcccagtcatggagttagtaagctgcagaggcaggacttgaagtcaagtctcccactccaccgtcccctttcagctaaagatgtctgagcaagcgtttctgggtgaggtcattcagaagtggtttatgccagcaatttgttttattcatcttcctagaggaggaagtggtgaataagctcttttactcatgagtaagtggaatttatttctgacagattgttaattggagggtcgtataaagatttccccatagaacaaacatggcttagacttgaggggctagctggggagtagcctgcaagtcagcccagaagggtgaggttaccccagtgatgctggtgcttcagacactgagggagctgggagaaacttctgtcaaagtcatagagctcatcacggtgtcaaacacttctgagaggccaaagtgagaaccaaaaaggcccatgaggtttagcagtgagaaggtaggttgctctccagtgtctgagatcacatcattcatttcattctatttctactcaaaagattttcaagggattgttctctatcttgtcaccagttttggggagtgcactctctttagggtcactctgtgtattcccctgccatacagcttgctggaagtctcttttcactgaatttaaccacctgattgttaatgaagatagagatgcacctctgctgtagctgaatagctcaacagtctccaaagttagctatccaagtcttttctggacctggatgtttaaatcaatcagtacatctgcaactgtaatggttatttttatcttttgacatatctcacctgaatctgaacacaatctaatgaatctgatgtatttttcttaaactttttttttttttttttgctgtgaaatagtctagtcacgcattttggtggctagaagagtgaattaatagtagtctaatcaccctggagatgctatgcttctgtgagctggcactgaggtaaggcggcacatctctgtgggaatgacaagtgaatgaatctgctcctcatttaacctgctgttcttttctctctctctgttttctctcctaggaaacaaatggaagactgctgcgaccctgcccatctctttgctatgactaaaatgaattcccctatggggaagagcatgtggtatgacggggagtttttatactcattcaccattgacaattcaacttactctctcttcccacaggttagtatagagttggttgccttcagtatggtttcttaaatttcttgctgtcatagaaaagggataattgagtttgccttactcatcagattgactttttgttttctttcttctctctttaaatgtttttctttatatctgtcatctgtgtgtgtgaataaatcacagtgttttgatgcaagggtggaagcaggatgttacagagttacagttttcctagcctttctgatttgagtcctatgagactgaaggaagcaagaaatgaatgatcagggacttgtggaattctagtgttctgaggttggctgtggaatgaccatgaggatttgtgtgatactggaatgttttcttaggactgatgttgctcagggagtggggaccatatggtgagaagtttgcttcttagagctcttgaatgttaaccctgtggttagattaccactgtgaaatggaggagtggtggatatggagaggaataattcaacttgaccacttttgaagtggtctaaatcaagctttgcttacttaatatttattcttggttttctgggcattgaaataaaatgtttttctaatatacatgtaggcagcaagaggggggaaaagggaaattttattttagggaaccctagttttggggaggggagatcttaggcaaaattgcaattagggaaaaattcagaaatgaatcatggcctccccaagacatcttttagccacccttggtttgctcagatgattgtacagaaagagaatttttaagccttagaaagtgggactgaatctttcatgtgtctctgttaatagcccatgagactttaaaggaggaatcccacaaagctgaggcacaggttctaccagatccaaagtcacactctctataaaacagccatgctgactagctcatccttagatattttagtctagtttaatggtcttaaaatgcagtgataaggtttttcttttaatttttgaaataagaagtagaagctttagtttattgccagcatctacatgttttctctcttcatctgcccttgggaggcttccaggtgtcaaaggaaataactaagagctatgatatatggaactgaattttgtctccatctcttactaactaaattccttggatgattacctaagtcgtctgagatttagctgtcttgtctctatgatggctagagcagcacttgccctatttaccttacagagctgtggaaaagatcaacttagataatgcatggaaatgtcctttttttttttttttttttgtttttgacagagtcttacttactctgttgcctgggcttgagtgcagtagcatgatcttgggtcactgcaacctccacctttcaggttcaagcagttctcctgcctcagcctcctgagtagctgggatcacagacatgtgccaccatacccagctgttttgtatttttagtagagaccatgtttcaccgtgctggccaggctggtctcgaactccggacctcaagtgatctgcccacctcggcctcccaaagtgctgggattacaggcgtgagccaccgcgcccgactgtaaaacataataaatgtactttataaatacaaagcattatatgtttggtattaatgtgctgattcatacttagtatcttgaggctgaggcatgaaaagcagaattgtattggtgagggtttaggcaaggtacagaaatctctttaggtacttttagcagaaagatatttcatatagggaatttggcatttaaaaaaatcattggaagaatggagaaatgggagccaaagggtggttcctagaattactgagtacaagaacctactactgtaactgtggtctagggactgggaagccccaacttggcattgctgttagtgtggccacaactgcttctgttagaaataggggaaagaatatgagttccaattctcctcctcatttcaaatcttcctcaaatgcttctaatggagaaatgatttgcatccagaacactagttgtgaagaagtccaggaaaggcagtttttaactgtcatgcttcagcaggaagctggaaagagagtggtacagaggttaagcaagccaatccacaggatagtctatgtatgaaaactgctacaaactagttgtggcatgaggaagagataaggaagcaatctcctttaacagctcctcacatagaaacattttaaatgaaatccaaagtagcttttttttatagatgaggacttttagttttaccaaatgaattctaactttgtattagaaaatagatttaaaaggatgattaaagaaatataaactagcctcctatattatctatcggttgcagcaatagggttataagaaacatttactttgtaaagtctgtgcaaatgaattctgtgcctctttgtgccagttgcaagaccaaggaaacatccttgaataataaaggaagaatacttttttcttgggaatcagaagtcatgacatcattgtgtatgggcatagccattgcaaaaggcagaaccaattcaatgagtagattttttttaattgcatatgtatgtattttcctgctaagaatctgaaatgactaattaattcatagaaatcttggtaaaccagtttgcatcactggaaaaaatggtattttccctctgctctcatccattattatttcttagcaaaatgtttctagtttgttatcagccaaaaagggttgccagttaattgatacgcttcatttatgttcccagtgggaagaaaatagcgtgtgcaggtgaggtagaaatgcaggtgagtgggccaggctcagcgttttcagcatgaacaaagcttcactcctttcccagagtttcagtgaaataatgctaagtcactcatttctaacttcgattccatgtctgtacctttacacttgccccttaaatactccgtatatgttagccatcattatcaatgttattcgtttgcctacttttgtttttttgtcgttggtacaaagatgcagtgtaagaagggagatgctctggtacattagggaatggcaacaggtcctataatggctggggcagtgtatcctcaggaggtaactattgaaatgtctgtgaattgagatgccacatcaaactccttttagttagttagttctatgctatttgaaccttccacaactttctgtaactttctgttcaaatttattcaattctgccacataatgcggtgtacataacttcatatctccatatgacagtgttctgtgttctaaaagtccttatctgctatctcagtaccatcttgtgagctcttgagaacaagagggttttcccttttgtgcccactgcagtgcttcccactcagtataaatagtcattcccaaccactcatgtctgtcaagggcgttcctgtctgtgtctcacttgggctggacccctgcagtacccttgcttgaactataggaaaccaagcaggaaattcagaggtagctgtttccaaagggctctataaatgtattttggtgaaatatttgttgaatattattaggcatgaagggcagaatttttaaccttcacacaggatttttaaaacatgcgatgtatgtgtgcgtgtttgtatttggggaggacggtgtgatggtatcagccttcccactttgagaatagctgctcccaatcccctgggttgggaccagctctttcctgcttagccaggaactgccccttttaagcctgcatggtccagtgtttacaggaattattgaatgaaccctattttgacctaagatatcttgccaaggaaggacacaaatttccatggaaatgagtgaggcagtagcaggaatgttagaaaccacaactgtgctgatacaatctgaaaaatatttccttttggtattataaaaacacggttggctgtccattctcttacattgtgatataaattacatttctcctcagcacgttcacccagggccatatgtaaagcatcacaaaacatccttaatgcaccccacatagacactcatttccagcttcctaggttggctgtaggctcctgtcatgttccactgagcctggacctgcagcgttcttggcctgtgggaaacccagcaggatattttggagtagtttgtcaaaatagccttgttaaaatgaaaatacacattttttttccttcacagtagtgtgcttaatagaattctctgagctcccggatatccctgagtttcacagcaatttttttttcttttaataaaatttggactatactacataatctacagaatttggtagttttttccacttattcatattattgtaatcatttcccgtgacatatatctttttggctggaaggaaactaaggggtctaatgtctggtggggatggatctttgctggacttttgttaggttctattgttaggcttccatctggctgctttataacagaaacctgatggggggcagaaccaaataattgcttatttatctcaagcaataaagaattagagggtaggtagtttagggctcagtgatggctacgtagtgtgccatcaagctcccagacccctgtcttcctactcaaacctccttagctgatggccaaggaacttcgcagtttcggttcaggatcccagcaaaaagaaggagtaaacagaagaggaaagctggacagattcctgctcatgtatcattaatcaggactgagtcacatgggcatgtctaactgcaagaaagcctgggaagttcagttttccagctttaggcaaatgccttgcgtttgtcaactatacgggctgcctcagtttcttcacatgttatctcgctcagcccttacagcgactctgtgtggctgttattattgcctccatttcatggatgaagctaagactgagaggggttaaataccttattgagggtcccagagctggtaggtggaagggctgggatgtgaaacctggcctgtctgatttcaaaggtattagtgtttactctatggtttatttccttagaagacatggattctagtggattagttcattcttatcactcagtcaccttgaaactgttttaaggtttttcacttctaagaatacctttataagaaatggagaaatttcattttttaaatttatttttattttattttattttgagacagggtcttgctctgtttgataaactaaaaatgcagtggcacgatcatggctcactgcaagcctccaccttctgggctcaagtgatcctcccacctccgcctcccaagtagctgggattataggcgtgtgctaccacacccggctaatctttgtattttttttattgtattttttttttttttttttgtagagacaaggttttgttatgttgaccaggctggtctaggaatgctgggctcaactaatccacccatcttggcctcctaaaatgctgaaattgcaggcatgaaccactacacctggccaagaaatttcttttgcagctttttgggagaaaaagtagagtgtagctatacaggatatggaatcctatacaacaccatagtttcccatacaatactctagtctctttttggctttgagctccccggtatcccctgttgaaaggagaaataagagcatttacattattttgagttttataaaggggaaaccttgcattgcttctttgttataggaatctagaacatggttccactactattgaataattaaggtaattggccctgccattcttggcctaatgctaacactagagtactgtttagggtatgcagtctaaaaatctggatcctaagcctggcctttctatgatgacgcttatgatcccagacaagtcatggaaccattctcagcatgaattttataatttgcacattgggacaaataatacctggtctttatatttcagtatcattattatgagtaacaaagttaaaatgagataatgggtttaaaagtgctttgtaatgaatgcaccataaaaacatatgataatattattactgttattttctctcaaagtgtttacggactttagcattgccttggcatttgggtaatgccaggaacccatgaagcaaaacaaaaactaaaacaccactaaaaaaagggtgaaatcaattttacaggacagtgaaaagaaataaaggtgttgaagctgggatttcgggaaacataaagtagtaacagagaatgttacagtctttgtttcattatatttggataataattacagtaaagtaaaagagcaaggtgaaataaatcattaacttctagtgaattaagattgtgatctgaacaatgaattgatatccactgttcttcaaattgctgtgtaactgagaagagcaggaaaatggatcatcactggatgtccaaatatctgttatcttcatagggaaaggaaaacaatcgattagaagtgaggtagtgcaatggagttgctcagaagaatagctgatgggaactttaagatgtcttgtttttcaaatttagaaataattgaaaattaagacctttctttaatgaaaatttgcaggttgtctatggttgagaacaaaatgaaaaataaaggaatgctctatcttgccatggtgtagatctttctaaattacttgacaatgtgtaaaatttcatacaaagaccgattatggctcaggattctagcttcctgggaataattgaaaagaattcatgacaccaattaccactgagtcacatctcatcccgtaggcctgacgggagtgatagcttttcttaggaggtgttactgttccatataacattttcttcttaggtgtggtgacatgacagggtgtttccctgcaggagaacctggtatacctttagttttttttctttgattagtttcttaatcttggttgctcttacaaaggtccaagtgtagaaaggaatttgcctccgattttaatttagttttgagcatttgtttggatactaggaagcctctgtttcatttctattaatatgctcatttgtacttttaaactctattaggagtcgcttaaatgcatagacatatttgattaacttatagagaggtatcatttcaaccctgaattttctctggcttaattaatttggtcaaataatcaagaggtatgactatgcacagagaacgttttcagagtgtttgtctatgttcagatcaattcactatcttccttctaattcactgtcttccttccattgatggccaaacattcttagatcacaggtgagctagcacaacattttttaatcacttatggcctgactagctctaccctgttatcttcagtgttcagaacttctgagtagattgaagagaccgaccctgaagcttgacttgcccaacacaatggggaaaggggttggctagggataggatagggagtgaacatagctttgggggctaaaaggaagtccagccagtagccagaaaggggtattgcagttcttactgtggaacactgttggcaataaccagaagataataaggagtaacatgatgtgctgctagtatgcagaatgcagagatgaaaatggggtggatggagctatacccagagatccgtttaaaacaattgacttcaagttcccagtctctacgctggaggttttgacaactggcagcttccaagggtactggtcagaagaagccagagcctctgacttctagaggtttgggaactgatcatttatcacagcaggaacacaagtgaaccaggtgagcatcctagcactggggccaaaattagggactgtttttgtaagcaaggctgaagcacagttactggaacttggtatgggctgggaggcagggacctggaagggcagcctggggttatgttttgaaattaagtcataaaccaagttactagagccatacctcaaagccagggccagaacacaagtgtaacttggtagtgattcccatagcttcaggtgaccatgcccaatcattcccctaaaggccaagattgacccacattgctcagggctcagtctgaaccccagctgtaggttcaggtgtatatagagattgagaagtaggctggataaatgagtagaatttttcagacaaaaacatttaggttcttactgtcttcaatgtctagctctgtggaggctgacaatacagagagagcaaaaactaagtgtaaggagaggatttgggaaaattgttaggtaattaagaaattatattagcagtttgtcagaaaaataggtaagtggataagtgtggtgagaaaatttaggatagatgggcatgggtcaacatctgctgattgtaaaggaaacaaaagtgctttttgagggtaagacaacattttatactctgaaaattattatgcataggttttttttcttgccaagttttatttttcctgtctattcagactctattcttgagatttcagaattttaactctttgctaagaaaaagaaaataagtgctgagagaaatgcaattgtaaattaatttgataatcacttcacctggggtgtctgcagttaatgaagcactggctaacagccccatatacaatatgtatcatctgattattttgtttacatttttctgtttctagagttcaatccactctgattttatatacatcttgggtctaatatactattcagaggatagtatattcacaaagtatggttagttctgtagccataatttataaatttcctgattgtcttttcttgttatactcttacatagtctttgactatgacacccaaggtcagtaagaactgaagttgctacagtttgtaggtgcttccagatgcctgacatggagattgtttgaggatattttaaaatccaaaaaagttcagtgatatttctggactcaagaaaaaaacacagtatttctacacaaactataaaatttaatgtaaatcaaaaatctacaaaataacatcaaggttagaattaaatttaaagcaaggatttgatgcatagaagattgccttacacattgattggacttgtcacctaaataaatatgccctgctgccagcacaactatgctttcctgaaattttcatgattctatgtaagtaaaataagtgttcgaccactcattcatgaagtacttattgagcaactactgctgtgtggtagggactgtgctagttcctggggaaataatagtgagtaaaaatagatccggttctgcacctattggatactgtcctcaatgttccataggttccttaccttttacatgctcacaattctgtccctttctcctgcttcttttcttctattcctgatctcaggtaatgacactatcgtctactcagtcacttgagctggacaccagggtcttatgtttgaatttcactgtccaaatccaagtttatttcataaatatttcctgaatcaatcccctcttttcttacctcactgccactgggttaagtcaaggtttatcatctgttatctatactaattcaagaactttcaaaaaagtttcacagacaggcgcggtggctcatgcctgtaatcccagcactttaggagactgaggcaggcagatcatttgaggtctggagtttgagaccagcctggccaacatgatgacaccctgtctctactaaaaatacaaaaattatctgggcgtagtggcaggcacctgtaatccctgctattcaggaggctggggcaggagaattgcttgaacccaggaggcagaggttgcagtgagccaaaatcacaccactgcactccagcctgggcaagagtgagactccatctcaaaaaaaaaaaaaaaaaaaagttcactattatgaatttgcctttctgtgacatcctccaccctctgccaattttgttgttataaaatgtaaactggtgtgtgtgacatctcttaactcactcttcactacttgccatgcagatgagcaagtggctaaacggcagactaagtcagctggagcagcattcacagagaaaactcatgaaggacaaggagcagctagtagatatgctgttgcgttttattattaaaaataaggaaattctaccctctaagaaagggaacctgaaactacactgggctttgtagttctgtaattagggatgcaccaaccattcccctggggtgattgagagactgagatataacatacttactaagatagggcagaaccctggctttggcctcttttatcaacttagtgtttgtagggaatagaaagccaatgtagctatgatgggtgactcaggtacaagtcttgcagatacagttgaatgacatagatggccagaaacggtggccttttttttttccattttattttattttgtcatgtgttcaacagcatctctttttctctctctctcccctcttcctggcaggtcacagacataaattaaaaataaaatctacaagaaaaataatttataaaagcactcccaggctcacaccttctatccctactgctcagttaggaacaccccaactgagaatcagtgctttcccccctccacttcactcctgcttgtctggggaagacagtactccagagtcgggcaggggtgggggtggcagtggcaaacagttaaaaataaagacactgtggtcctggaaccatctggccaccttggcacttccatgactgcctcccccaggcagccctccaggagcttgtgctaagctggggctgtggagaagctgcccatggctgagagcttgcgtgtttggggggtgctctcagcccctgtcacttgcacttctccatcttctagaaagaaacccaaaaaagaaagcagacgacaacctcgggacagaggagaaaaatcccgagtgttcacacagttagttacatgggtctttatggcaaagaggacgtttagctgctttgaatattaggacatctcctttttactcaatacaagcattctacaagtgaaacagggcacaagccctaaaaaaatcaaagtgcatgaaattctaagaggactagtttttttgttgttgctgggttgtgtaatgttttgtgttttcccagtgacaagcccagtccttggtaggcagaggcctgagggaaagatcactccccagtgttgtgctgaatcctgcctggaggctgctgcgctagatcctccctccatatcattcccctgactcacagcagtactggaataggaaggctgcaggcccagttcccggagcactgccagcacctcaccccagctacagaagagctcaggcagtgggtgagggatggggaacacaaatgggatttattgcatcagcttatagttgcagaagagctagtttcttccttggcttgctgagagtagtgggaatccaagccttgctactgatcaggatagagggccttgggcactgagccccatctggtttccatgcagctctacaggagcccacatctttttcctgttgacaggggatcaatcttgagcaggttcatccttcctggttacaacctgtatgataaaattcaaatcccttagagtgtcacacaaggtcttcacgatatgaactctctgagaatgtcagctaatataagcttaccaattgccatccatctgcttcctccagctcctcattgcttttttttttgacacggagtctcactctgtcatccaggctggagtgcagtggtgtgacctctgctcactgcaacctctgcccccggggctcaagtgattctcctgcctcagcctccgagtagctgggactataggtgtgcaccaccatgcctggctaatttttgtatttctcatagagatggggtttcaccatgttggccaggctggtcttgaacttctgacctcaagtgatacacccgcccttggcctctcaaattgttgggattacaggcgtgagccaccatgcccagccccagcccctcattactttttacttttactaagtgacttgcatttcccagaacaattcgttttttcgttttgtcttcacatttgtacatgttgttccttctgcccaaaatgcccttcctatccttatctgatgaattcttgtttatttttcaagatccagccaaagcatcatttctgcaaaccttcccagttccctctcccaagtctcaaccacctggcagtgttgattaaaaatctattttctcccccccaaatttgtatatatctctcttaatacaactgaataacaattattgtataacaattcaataactgaattgtcaacattgttattgaataacagttactggctcacatgctttctgctgaccacactgtgagccctttgaaggcagcacatagacagggtctggcacataacatagcaggtggtaaattaaaatgtgctgaatgaatgatgaaatggatggttgcttttcccaaaacctttgcacccacatggcatcaagttacgtcaacctaggtcaatccaggcaacagcgatggaagaaggaaaggtcctggatgctcacgatagagcgtggcgtgtgtgatggtgtgtggacagtcaccctctaagtgtgcaggacttcatcctaatcttgaaataacaagatcgtacattttaaaagtcaagccacaatattggttctgggcatgtagttattttgtttttatttcttttcgctattcttattctcttttaagacatatattattcttaagaaattgttattggatggagctgatggacattttgatacttgtgaagataatttctttttctcacatccacttcttattttctctcattgtctttaccatctcatttcaaatgacaatggcctcttgtctagaattctgcaaaagttatcttctgggctttttgtatctaatctggcctcttctccagtccattaccacgctgtagcttgagttagctttttaaaatgcaaatcagatcatgcaatcattttgcttaaaacccttgattgtcttcccattgatttttaggataaagataaaccccttaaggcttgatctcttcctgtggctccagcatcaatttccacaatgttgcttctcatcctcataccttgctttactggccttctttcatatcctcacaaacactgtgctgtcttcttctgtagaggttttccacatgctatccattttcctggaagactgttgcctcctcttacctaattaacttacattgatcccttacatcttgtttgagaaccatttcctggggaggagggggctggtccccagagcaccaggtacctttcatttgcaacttcatattcaattctataagtatttgattgaagttgccttctcttaccagctggaaacctctccagggatagtgtttaattctggatgatagggagttatgtgtctcagtttgtagcatagtgcttgagacatggtagagattcaataaattttagtggaatgatgaatgaatgaatgaatgagttcagctgcttagttttggtggatacaatcaccaagtgtatcctggtgtacctagagcctatgttttggtataaatataaagagacttggagttcattaatagagagtggaggggaaaatcctcacattggaagcagtcaacataatgatgagggatttttttgctcgttagctcagctaggtctgggttcttgtctcatgaccaggaagaagtaggcacacagaaatttgaagagtgagcaaggcggggagtttcattgaatgatgaaacagcttttagcaggggtggtccccctacccaaaggcagtaaagttctcaatatggctgagcctggggctttttatgggctcagaataggtagcttgtattgattgatttgtgactgtgcaaaaaggtcaaagcaaagatgccactcaaaggtggacacgacagtgtagaaagccaattaggaaagtgtgggtatatgaaaaataggtgaacggtggggatcaatcagaggaaagtgtgccaaacgggcaggtggggtctcaatccagtccgaggatttaacttgtagcttggctttcaggctttaaactgtctgcagcttggaggtggggtttcgccaggacctgcccgtgtctatctaggcatttgtctgcctcctgtcattatcggtaagaaacctcagaataactgtcccagactgaagcctttaaggctaactgtgaagatagtcaaacagggtgaccccgagcgcttttgttaccatgttactcttgtgtcattagataatacaagtctcagatgttgcaatgaaatcaatcttaaaggacaccataatggagaaattgctgctgtttttgaagatgtaaaaatcacagtcagagatgtcagctcagtcagtctctgccttctccccaaccagaactaaatggcagagtgcagtgacagagcaaaaagctgaactggttccgaggtctcttccctgccaggagctggcatctccagactgtcggttcttgtgttggagccttggtgctcttcagtcttttagccatcaaatattcttgtaccaattttcccacaaagcgaatgactgggatttgtattttaaaaccacagctattataataccagtatctttgaaattgacatactgtctccctgttagttttcaatttatcttggcccagctgctggaggaaaatacttttcagtctttgtagcgccgtggagccaatatgtttaggaaacaagccagtcaatatagttcccaaacaacctcttgccagagacagtaataattttttaaccccttgaactctaaataagaaaatggtttcatccagattatgaacactaaaccttggttggtgtgggcagtttgaacaatcatccttcgagttgaaaactttttgactgtccttggaattagtaaaggacatacattaagtaatcccctaggactgctttttcagcttgtaattacatttcaaggaaatggccctgtaaaacaagtagcaaagtgctctctgcaatatttgaaagtaagaccatagcaggtcaaaaattataaagtaaattatagtcattcacttaaaacgttcacttaaggcattttgtaatttcattggtgaccttttattgcatcatgaacaaataggggcaagaaaggatttagaagataaagatttgggcttaggaaaataagcattcagtggtaaggatttataagatgtaagatagattaagtaagggccaggaaacctttggggaaaaaggcaaagtgttatcatatgaataaaaataatggtaataaaatgtcatagattatgtcatgtctttaaaaagagggtacctgaaggaaatttaaatttcatgttttaggttatgtcataccatggggatcttgatatgtagaaatttcctttcacttttgcagatggttgagagatctaagaacagtggagggatgcagagaacaaggagacaggaaaggctgatgtaggacacagaacatcagaatgactacttggagcagggaagccaccagagcaatgtgatgattggcgctctcgtattttacagctattaataggtcatattgactgaatgatttctaagttccagacctggcactttttataattatcattttatttaattctttcaataactgtagaggtaatttcttacgtttcccttcaccccattttatagatgaggaagctgaggctaagaaaggttcagtacccatcacaaagtacattggaagtggcagaatcctctgatgctgtaattgtgtaaataaccattttattctccatgacctgggcacttagaagatgactgaggagtgatttagatatgttatgtatattcatatagagtttatatatgctatcgttccatctgtctgtgaagttttcctcaattaagttgtgcttgagaagcattgaggattaaattggccaactctgaactttctgttgccagtgcttcctgtgggcttggcattctgtttagtacacttataagaaagtcattccagccttgaaaacatccttaatgcagatgttttcttactgagtcagttaatggatatgtgagccaaaaggttcatcaaagccactgctgatgaaacaaccaaagcttcattttcttgaggctcctattggaaagaaaaaggaaatctatgtgcctgtgggaactgcagacgtaaactacctacctcatgtaaaaggctaccacgattgcaagtgacatggtaggtgcaagtatggccaaatacataggaaaaaaggcacaatgaactttttagtgtatttccatttactaattatgaatctgtgaccacctgtacaaataaagcaattaatgtcaactgtttacgactcctacaaaagtttcttcttttaaaatttcaattttctttttgttcctatttttaaaatttgtgtaaatttatggggtacaagtataattttgttccatggatatactgtgtagcagtgaagtcagggcttttagtgtatccatcaccagaatcacatacagcgtcctcattaaataatttctcattatccagccccctttcacccctttacctttctgagtctccattgtctatcattccacactctaggttcacgtaaaagtttatttgaaatagatttagaggaaaaattatattgaacatatttttgttttaattcagtattttaattttaaattggaaataattagtaagttaatttaaataaataaactcaattccgcaaaatgtgacactttaaggaaagtgcgtaggaaacattaatgaaactcaaatgtattagagaaaacctaccaaagagtaggttggttatattttctcaatttgattcaattttgtggctacactctacaactatagtttgttgaagactaactatgtgctagactctttgctaaatgttttgcatgcattatctgataatcccaacatatgatgctgatattattgtctccattttacatgtagaaattgaggctgagccaaaagtgtcctgcctgggatttcccagttagacactggttccatgctgtgattccaagtcaagattcaaactgaggcctgttgaagctaacatctacaaatttaaccctttaaactgccttgcatttcctttcaaattaggtaatatgctacaaaatgattacaacctaatgaagtctctctcctgatatgtctgaaatacctataatagtgtataaggagattcccattttgttttccttggaaacggatggagacttactcagttgctaatttctgtaatgtggtccaaattgtttaaacctaacaattccatatttaaggatttatcttaaagaattaactgtacaactgctccaggctatatgtatcagataagtaacagcaggaggacctctatatggaatgggttagtgatggtgaacttgttaaaagagggttctgtctcttcaagactccttttatgtgaggtgttttacatacaattaagcaaactttattgtccatataaaagaagagaatacagtgggctgatactcccgtttctcagctaccttcttagctctgccacaattcaaagatgtttataacagtattgtttatcatagtgaaaaaatgggaataacctaaaatattcaacattaagggattggttaaattatgaatcacctctacagttaaataccatgttgatattacaatcatgaagggaaggtatccataatatcttgttaaataaacatacacattacaatagtattcatatgggatcacctgatcccattttggttagaaaacaagccatttaggatgggaagtccacccaacagagggctgagaaatcactgcaggtaatatacaaatattacttaatgttattttgaaaagaagcaagggagacttttagaaacttttggacttctctttgtcagttagaatcctgaatttttcactaactgccttataaaaaaaaaacaaccctgtatttcatttaaatctggcacagagaaaagagtctttcccaatctttggctaaaattccctaaagcatgtattttcctactgtgtcttttggaataatttaagatatgcactcttctctaactgcctactcttggaataaatttatttattaagtctgccagggccctgcctgggtctatagtaggatatgcaaattggctaccagttaagataaatctggccttcaaattttggctttactttaaaaaaaaatcatttgaactatatgccaacttttaaaaatgaggagcttttacattaatacctggatttttagtatcacttgaaaaaaaatcagaatatctggcagtcctggctcccatgcccatgagtagggcatgagcagcttcttatcctgctgctttggtgatatggttttggtttggctgtgtccccacccagctcccatcttgaattgtagttcccataatccccacatgtaagggagggaccaggtggaatgtaatttaatcatgggggtggttaccctcatgctgttctcatgatagtgagtgagttctcacgatagtgagtgagttctcacgagatctgatgggtttataacgggcttccccccctcccctcaacttcgctctgcacttcttctcgctgctgccacgtgagaaaggatgtgtttgcttccccttctgccgtgattgtttcctgaggcctcccccgccatgctgaactgtgagtcagttaaacctctttctttataaattacccactctcaggtatgtctttattagtagtgtgaaaacagactaatacatttggccatgtgccctttgtttgccacagtctctagcacttcctattgccttccttccactcgtttatgttacccgcttgaattgtgtaggcatttcattttgcacctctggtgtgctagactttaaaataatctaaaaagctcgtctgtggatcatttagcaatttccttaacctttctgtcagtggtctgaaaaagggaacaggtttgctgcatttgcttagatagattcttggcatttctccagaaagtctggggctggattaaatcaattaattaatgaaaacatctgtatacctatgtggtaggctctggagacactaagagttacaaagacatggtttatacccttgaggggcttattcgctgttgtggaagatgggtgtacacaacagtagctagtcaagtgttacccagtgctaagggcctagaatgtctgcttagtgagacggacagtaagtgcagtaggtgtttctgtgggaatgggcaggatgtgcatgccaatcctggaagatgacataggtcagggaaggttctagggaaggaagacctcaggtcatatctgagagttggcagatcaggtggatcacaaacatcactgtgcatgtgaattgtatcgtgtagggcaacttcagattcctaagctctacccagagatcctatttctagagggctgaagtagaccaagaatatgcatctttaatatgaattccatgtgtctctgaaatatgtgagttacactgtgaaaaaagggtagacgataagccaagcaggtcaggagaaataagtaaaggtaggaatgtgtgaaggtaatttacaggctgcaaaactcagttgattggatgcttgtatgcagagtcctgagagataattaaggcaggaatactgggaagagaaggatgctctggaaatcacttattttcctttttatcagtaagaaaggatggcagatacattttattaaattggggaaataaagcatcagcagcagccagttattcccaaaaggaatattctctgcttggcttatttatcttttaatggaataaaatagttatatatgagacaatcaatcatggacatgcttttttttaaatgaaaataatagttaattagcaggcaattgatcctggtcctgatagttcaggtgcctagtcagttaaattggattaacagtttagcagtctgctgcattacttactaagtaattgcacactatttatagttgaaaacaaaatggatgccctaattgataccaccttttagtgtagcaaatactgaactgaagctcacagtttctgacccagcatctcatacagtgactggtatatggttagttggcactcaataaatacttgccaaatgttcttaactgaaacttgcttggtatttgtagttcttcatttctgaaaaaatggagttggattttattcatggttttctacaccatcaaattccttggggtgtctaagtgtcacttccagaaatagagagaccaagaaattggggaagggtgcccactttacctcatcttctcttttgtgtatatgtgtgtgtgtgtgtgtgtgtgtgtgtgtgtgtatacttttgtgtatgtgtgtgggtgtgagtatgtgtacacacattttttcaagagacagggtctcactcggtcacccaggctgcaatgcagtggcacaatcatagctcactgcagccttcaactcctaggttcaacagatcctcccacctcagcctcccgagtagctgggactacacgtccatgccatgatgctaggctaattaaaaaatatatatttttagtagagacagagttttactaggctggtctcaaactcctggcctcaagcaatcctcctgccatagccttctgaagttctgggattatagatgtgagccaccatgcctggcctatatatatatatatattttttttttaaataggggttttctggtataaccttgtctgagaaacaataaaggcttcgattttgaagcaaagaaaataacagtagcaacagtaataagtttggaagtctctgaagtattgaataaatgatttgtttcaattccacgtgcatttaccggccactgtgcacagctttaatacataatctcatgactcatggggcataaatgaattccggtgtgcctcttgtctgcttgagttttttttagcattccttgcacttgtagggaattttattggacactgtacctgcagacccttcatagatcttaaggttgaaaaataatttggaaggcaggtaatagagtagagaaagtaaggagaaggggtgagggcgagccattgaagcagctttaacagaggtagggagacaagaaattcaggctgtgtctgaggaaacacaggtgcgtaaaatggtgtggagggaatattgggtgtatgcatagataaccagctggtagaaaagaatgaacaggaagtttagggtgttgagaggtcctgggtgggtgcttcaatgaagatcggaagtgtttttgtctgtgggcaagggaaaacatggtacttttttttttattagaaaagtgatttgcactagcttttgttttagaagaattaggatatgagagtgaaggattgatgacaggcaagaactagaggccaatttacagcattaaaccattttaaacaatagttacagtgagagtggaaagaggagaagaacagaagagcctctgcagagggaggtgttacgtagatattaagagagaggtgagcaaaaatggctctgagatttctaggctgtgttgctgagaaaatgttgatctcttaaagataaaaataacaattattgatcatttaccttgtgccagacataagtcatttaattctcacaacaactgtaagaagtcagtacagttgttacaagtgagacaactaaggccctaaggttaaataacttgccaattgtcataggggaacattaacagcagggactggatgcaggcaggcgggctacaaggtgatgctcatcaacatgaagatgtgctttctgtatttggagaaaatgaatctttcagtggtatttccaatgaggggattgcaagtatgacgtctagcaatggcatgaagcttagtacttcctgctgctgcttattccgtgttttgctccactgctaagatgattggccctacctttgaaatgttgggcctgcccttcgtatttccttccctttccatcatgaaaagaaaacagttttgaggacttttaaaatgtggtcaacctctgccctgaagtatagacacagtctttgtcaccttatggttcagaaacaacatcagtaaaaaatttcaattcattgggacttgactatgaaatgtttaataaatctgctgcatgggcacatgaactgatgccacatgagttgtatccagaataacagatcatatgtgaaacatacaaaacactttttggaatgcttttgtgttattttttataatggattgagtaagaaattttaataggcaaatagcatccactatataaatattcacatcattcaatttccaaagaagcatcctgtgtagaaagcataacactgaagctatccttttaaaatcacaattttattaatagaatggggaatacaaatcttagcagctttctggaaatttgttttcatataattgaagaacagttaaaagtccttgagtggtaggaaactacaaatattctataattaacatgtacaaatatatatcttaagggaaaattatgtgtaacgttttttaaagggtttaataattaagtacctataatgagaagttttttttctctgaaataattgaactaattaccagatattttcatcataaaatgcttacgtatgcaaagtaagaaaacaactgaaattttaatttggactgccaaggggctagttaaatgactgaaaaagccaatacgtgttagtttacttactggaaagaaccaaaactgcttttgatttggctgcatcttgttattattttgtttgtttagctgggcaccatgctcgctaggaattcgcttgtgggaatttgccagtccttaactgaagtaataaagtgactggggtacagggataaagagatgttcatgtgaggagtattgttggagagttgggggcttgattggtgcactggttagaatgtaattaggtcctggagcagggcagtgcaattaaatatgttaaggagggcataattaggtgggaggctgaatgatgtaattacattcataagaggggggctataattaaatatgaggcaggggtgtgtatttagatgcctaagttgaggatataattaacatatgggcaagaaattaaattatgtgtgtggatgaagcataattgtgtgtgggagtccaggaggatacgtgggtgagggtatatagaaagaaaagggtcggaatgcaattagatgtgtgagttgagttcttatggtcaaaaacttgagattttcattaagaagggcaaacatatgttttgacatcatgactgatagcaggtggcatgtagtgacagcctttcagaccactctgaaggcttgcaaagcaaactctgtgcttttccaatatggtttgagacctgcagctaacactgctattgattcttcttgattgtggcacttggtgccacaattctaaatactgagtgtctggataatttttctagctttaaaacacaattacatgacaaggaagacctgctcccccttcctgtcaaagagaaaagagtttggcggggattactagggcaaataaacacacaaacaagaacaacaaaaccttcttgccaccaacaaccaaaacaccaatttttctttatattgccaagtgtgaaagtaagcatcactcttttagctaaaagagtatcacataaacataaatgtgtaacaaaatcaacaaaacttagttatgatagcctcattattttaaatttctaaaacaatacgctttcataaataattttggcatcctcccaacatataaaagcaacaaagcaacaaatgtaggctgcagataaaagaggaactagggagtggcagaagggagccaggagaagaatgatcacaagcaaagtaggtgaaaaattactcagcgcatctcagaaactaagcagtgaagtatggtaagagtgatcataataatctgatatatcctatattaaacttaaaacacggagactcctgttgtcgtcttcaaaagccagagaacatttcgaatatctgttcgttgcttagataattgttgaaattaaacatatttaattggccagtagtctgcttaaattgattcaatctagcactcaattctcataaataccagagcctcagagcctcctcatatctgttcaggccttaggtcagttctgacagaactccactattgataagattcctggtgagctggttgcttcggggattctgaagtttttagattcaaaaagaatccgaaaaggattcaagaaatctatatttaaggttagttattttttataacgtggaggtaaggacattgcagcctgcccgcaatctcttgttctgccctttagtggttttaaagaacttctttttaattcttagattttgatttcataccaatgcatgatgctgatttttaaaattgtagacatgcctcaaaggcagcctctcacaaaggctcttgtaacttaatttgtaatcagaagtgctcttaataaaatgttgtgcattcctgtgaaaattactgttgcatccaattctctatccactaagtggtttacattttctttttctccatgcacttcctactttttgccctgcctcccagaccagctcagactctgcaacaatgaatgatttatggtggttaactcatgtgcttctagaggtcacacaattatcattcaagacatctagttatgtctgtgggttggaagatgagtaggtgtaaagtctccttgtgccagtggtggaggtcagtgccggctctgctgttcagggttgggggtggagtcccagctggccagctctttgttgctttgtgtggattgcacaaggagaggaggaagaggtgggcttcgggctttgaaagtgactctggtaaatgatgctttgttaacttaattataaaaaccattctgagatgctccagtactatttacataaggcacaacaaacagggtttaaattcttcagacttgaatagcgtttttccataagtcattttgtcagctaggaatatgtttgcagctggcacttaacaagtcttttcactctcatgcatgctataaaacaccaaagatcctaatttttgtttgtctttttttcaccttcctaatattatctaatagaccagaaatctcaactactttcatatgcttaaagctatggatctcagcttaaatgttaattcctcagagaaatttttcctaaccttatagcacgctgcattttgctgtcatgtttgttaaattctgtttttctatttagcgtgtaagctgcatgagtggggtatatgtctattttgtccaccatcacattttcagcatccataacagctcctggcccatactaggtgctcaatgaaaagttgatgaatgaacagggaagttaggtattagggctgtttgagaagaggcacgagtgaggcagactgtggaaaatgaggataaggggtatctcagaagcaacacactggatgggcttactgaccggttcatatttagagtgatggggctcacggttgttcttcaaatttggagattaatttatatattcattacaatataaggaaatgccattttaggtccggaaactgctgagaatggattagatgctccaggaaaattttgtgattaaataactaattattgaacaatttgttgatcatctcatctgtacttagtccagatatgaggtgttgaaaaaaaagatatgatacctgcaatgatttctacacaaatatgttattaaaactcatggcttgatagaagttgtattcataagtacacccttggctgggcatggtggctcacgcctgtaatcccagcactttgggaggccgaggcaggcagatcacctgaagtctggccaacatggtgaaaccccgtctctactaaaaatacaaaaaaaagacccgagcgtggtggcgggcacctgtaatcccagctacacgggaggctgaggcaggagaattgcttgaacccaggaggctcaggttgcagtgagccaagattgcggcactgcactccagcctgggtgacagaacaagactctgtctcaaaacaaacaaatacaccctcaaaggaccaatgacaaaaaatattgatttgttcaaaatatatataaattagcttgggtaacatggtgaaacctcgtgtctacaaacaaaaaacaaaaattagccaggcatggtggtacatgcctgtagccccagctgttctggtggctgaggcaggaggattgcttgagcccaggaggttgaagctgctgtgagccgtgattggaccactgcactccagcctgggggacagagtgaaactgtgtctcaaaaaaaaaaaaaaaaaaaacaacaactatataaatctttgaaattgaaaatatctcacacaaatatagactaaatactacagtggtctagcaaaatactaactttcccctaaggaatgcaattttgttagtacataataatgaattaatataatatatttatatgggacttcagaggttactgataatggtaaatgcctcaccttattttaactctcgtaatagtcctggaagatggaacaaatggttttttatcatgccttgtttccagtgaggcactgaggggttgaagggcctgacaaatctgaatccagatgattcatataatatggtcactaataagatggccattaacagatggaacagttacagataaaaaactctggacaaagatccgtaggatggttagtggctgagcaagaatagaaaatctgtgaggctgggcgcggtggctcatgccttatctcaacactttaagacgctgaggcgagcagactgcttgaacctgagtttgagaccagcctgggcagcacggcgaaatctcgtctctacaaaaaatacaaaaaatagctgtgtgtggtggcatgcacctatagttccagctacttgggaagctgaggcaggaggattgcttgggcctgggagatcaaggctgcagtgagccgtgatggcaccattgtacttcagcatgggtgacacagaactagaccctttctaaaaaaaaaaaaaggaagaaaaaagaaaaaaacccttgagctcattactatagttaatctgtctaatctatccttgcatttagagtagatttttttaaggttagcaagagtgttatagtatattatattctcaaatccagtagattattttcttgcataggtacaaggagacacatttgaaaagacagtatgcaatgccttaataaaaatattctctgttaaaatagtaatattcatgtggcaatggataaccaaacttctttctatataagtatactcataaaggaaaacatcttgttcatacatcattctggaaaacatggaccattgccaaactgagaaattgaggaggtattctgtgagtattaatgagagtattatctcaattactttaaaaaatccatagtatttttggccgggcgcggtggctcatgcctgtaatcccagcactttgggaggccgaggcaggcggatcacaaggtcaggagatcgagaccatcctggctaacatggtgaaaccccatctctactaaaaatacaaaaaaattagccgggcatggtagcgggtgcctgtagtcccagctactcgggaggccgaggcaggagaatggcgtgaacctgggaggcggagcttgcagtgatcccagatcgcgccactgcattctggcctgggcgagagggagactctgtctcaaaaaaaaaaagaaaaaaaaatccatagtattttctcaattaagtttttttgtctgtaaagctttggtgtgctgttattgttcattgacgtattataagtgcccagagagtgcactcaggcactcaggaaatatttattgaaatgaaatgaaattgcttgtcaataaaaagtcaaaatggctttttttaaaaaaaacccctggacttttgtttgagggctttggggggtggtatttactagtgcatggatataatagctaagttttctgttaataaaaattattactaattgttaaggtagtgtgttaaattactgttttaccgtgttctacagaaaccgtgaaatctaggcatttcatggcttgaacaagccagggagactctgctagaaggaggaaagaaatgaaaaagggaaggaagatgagtggacttccatgccagtggcttggttagatgcttgacatccacaaactcatagaatttcatgaaagcctgtgtgaggttagaccccttccaggacaggaagcagaatacagaggggtttgacagcctaccttccaattccatagttccacagtttggaagttaggaggtaatgtttataactaggactatgttgctgcttccaagatctgtttgttttgcggccagattcctgacagaaaacctggaattgccagcctaataggctcaagcaagaaccactctttgacaacaattaaagggatttttagttggcttttatagagcaaactaaatattagttgaacatgagtgaacccagatttttcaaataagctatgtgaaaagaaatatgcaaatgtgcatgtataacttactcagatcaggtttttgttcttatcgctgaactaaatctacctttttcaaggtcaccagtgaccttcctgttgctaagttcagtggcaattttcagctgttgtcttacttaatctatcaatagcatttgatgtaatttttttcttttcttctttagacactttttttttttaacttggacaattcttagacctcttctcttttccatctgcactcattcaccatccagtctcctgactttaaatacccatgctgatcactctctattttctatctccaggaaagaccaactccctgactgcatagtcatgtattcacttccctacttgatattgccacctgggtatctaaaggacatcatgcacttgacatatttaagattgaactccaaatcgttccccagaaacctgctcctcctgtagtcttccatatgttggtaaatggcaagtctatctctacagttgttcaaggcagaactcttggcatcatcgctgatttctctctttttctcttgccctgttttcattgtatcagcaaatccaggcagctctttctccagaatatatccagcttctggctacttctcactaccccagtgatggtgataggggtagtgagaagcagccagattctggacatattctggagtcaccaaagtgaccaagagtcaccaaaatctcttatgaaagactcctatctggtctctctctttctgcccatgacattctacagcctgttctcatagcagtatagtgattgctccaaaatatgtcataatgtcactcctttgcacacccaacattgacttgattctcatcttagaataaaaacctatgtctttacaataccctataaggccctgcagaatgtatttcccaacctccctaatagtctactctctgatatccttcctacttctccctccctcttctgcctcgcttcttcatctccagacacaacaggctctttgctccccctttcccatcccaggaatgttttctccttagggtctctgcaccaggggttcccgcagagatctgtgaggctcactacctcatctcctgcaggaatttgctcacaaattgaactcctccctgatcaacctattaaaattgcagttcctggggccaggtgcggtggctcgctcctgtaatcccagcactttgggaggaagaggtaagctgatcacctgaagtcaggagtttgagattagcctagccaacatggtgaaaccctatctctactaaaaaaaaaaaaaaaaaaaaaaaattagctgggcatggtaacgtgtacctgtaatcctagctactgaagaggctgagtcaggagaatcgcttgaatcccggaggtgggagttgcagtgagccgagatcatgccactgtactccagcctgggtgactaagcgagactgtctcaaaagaaaataataataataataattgcagttcctctctgaaagcatctcctaatcctttcatggcaatgctttctttctttccaaagctcgtgtcaccatctgacccactgctcattttactcatttatctttacttatcatctgttttccacactagaatataacctctgggaacagaaatttttacttatgtccttgtcacccagggcagtgcctgacgcatagtaggcactttgtaaatacttgtggaataaacaaacagctactttgaatgtaagtatttaaatcttcatctgacaaattatagctctaactgatgtttttctagtgttgattccaagccctctgtttcttgcccgtctcttctctctggatctgttctgatgtttgttgggctggtctctggtgtagtaatgcaggaaattcttaactctctgctggcaaatgcttagacattacactttaagtactgtatttttatcaacaatatttccatagctctggctgttcctttgacaactagaaatcaaaggaataaaatcctcttcttatgctgcattaagtggccacctcagttaccaatgaatacagaaactcctggaattttatttctggtttaactacttcctgcctatatgaggcccttacagtgtatattcatatacttattggatttgttcttttggaataacccatattatttgcttgagattcatgtagggtggttatttttgatgccagttgtgtatatgaaaggtctttccctaaagaactccagctgctctgcgtcgtttcagcaagcaggaaattctgtacctggcagttcttgctgacccagctagaagtggccgaatgacgcatttcactttcaggggctattgctgggttttcatattcatactataaatagcacttcagggaacactcagatacactgaacattttctttacagtccagttcagtgttggcagaaagaaagtcacatgctgtgtggttctacacaagtcacttgccccttagtgggtcctaagctctagacagacccacccagagtgttcatttgctcataaacacagcatcactctcagcaaatacttctgtgtcgttgtttacgctgctttctgtgcctggaggaatcatacgtattctttaaggttcatcccaagtgagaaagctttccccgagttggctcagcagaaatgccttcttcctccttgtggattgccccatagcattcagtgtgcatctctttggcagcaacttcagcattataatagagtttgttacctaggtatatgttttcacactctcatcatccctttctctcctcacatcccaaattgtgaaccctcaggcctgtgacttctgtccacatgtatctctccccaacagttagcaaaggaaatgttcagaaacatttatcaagtgaatggctgattgtatgaatgaatgagattgcaatcacataggagaatggagctcatttgtttccagcttaatggctttaaaaataatcctgtgtttactttgtatttttttttttaattttccctagcaaacaccttctactatgtgcatggccaattggagaggaaaaaaataaatgttgttatatttaaatgcacttcagggaggctttttaaaaattttgctttttaaatttcaaggcaacagactagtttgttccttacaaacttcttggcatctttcttttcacatgctcttttttgctggactcagtcttcagtcaaattcctccaaagggtctgctgtaaacaatgattttgtgagcggttgtgtgttctttgcagtgaaaacccgccttgttttctgttgctaggcaaccccattccagctgccattgaagaaatgcgcggtggtgggaaatggtgggattctgaagaagagtggctgtggccgtcaaatagatgaagcaaattttgtcatgcggtaagagagagcacccacagcgcggcctctgccttctctccttttccccacccctcccataagccctggggcttttcaaaactagtcacttgtgatgaatcagttgtagcacgctccttagcttcacttccagctcatagacaagcgagtttaggagaggggtaaggggagcgagggaacatgccccgagaaaggacaaagccaagaaggctcaggcggaacagagatacccactctgctgtgaataaagggagcaggggaaagtggaaaatctcacatctcattttagattgtacagtcaggtgattttggctttttaaattgttcttttccttaaggaccactctctatgaataaatgctttaatggattcattttattctataccttattcttcttagtttttgatcaaatcatgtgtaagtagcaagtgggatctgaagacggattaaatctttgagtgagtgggaaaacgggaacaaaggagcaggggtaaatttcaaacgaggggacgcttggtaaagggactgagcagagtggtgatgtgcacgtcagttccaggaaaaacaggaggcccctgcgggagcatgaaaaggaattgctgagacatattcagccagggacagagactgccaaattgtaggggcagcagcctgcactgctgggtgattctgcccagacatgcttaccagccacgtatagaaggagagacagcaagtgattggataaggacaggtttgggattatctgggtgagagggaagaaggacaaagagtgacaacttggagggctctggctagagagggtgtaaagtaacacaccttgaaatcagggctgggcaggaagagcgctctgagatgagtgaaggagaaaggatggggtcagatgatggggtcattcagagcaggggtgaggtaagttgtggctcctggctatgaatgaaggagacgtggaataagaagaagctaaagtcaaagaatggctttctggagggcaagatttcagagctcagggtatctcggggatgagtggacatgttgtagaaaaagaaaacatttgttatggagcaaataaaggagccttgaggatagactctgagggacctttcaggtggaccctgaagcctcactgaggtggaaatgactatgaaccaagtgccagcagactctgtggccaggaagggtgaagactgcagcaacatcaaggacagaaagctgagcgagattttgtattcctgtttatttttaagtataaacgagtaacagtctaggagtggaaaaaaggtagccaagaagatgctaagtcacctctgagccctgagctaagtgggagagggaagagtaaaaactttatttgagagagtttcaagagaagccatgtacttgtgggggctaagttccctctcagagttggtctccttgaaagacatttttttttctcacttggtgaagcctgcaggagagtctagatccttctatacccacctttccttcatgcaggtaccctcagcatagtttttcctctgtattgcagtttttcttttcaacgtgaacaaacaacagaaaagtggaaaaagtacaaatgtagttcttttagttccagtcaatgcaacacctgctcattgagcacccatgacatatgggccttgagctggctctgggaatggtgcgttgaacaattctatagtggatttatatcctagagatgtgtttgctaccgtgggggaattcagacacacgggagcttctcaagagaagtggcgtgtgagctgagtcttctcttcgtttcaccctaagcagagaaacaacctttcccaagagtccaaggtgggaaagatagcaagtgctgttgcagtgtcatgaacagtggggaaaatggcttgagatggagccagagaggtattgaaggcattggagtggagaaaatcacctagagagcatgaataggtgagaagagcagggagtcctgaaccaccttcaggcaccctctccagtactttggcattaggtgaggctgaagagccagcaaagaacacagcgagataggagacaagtccttgctgttgttgactaggtctgtgacctacagtgcattattttacccttgctggggcccagctttctaatttgtaggaggaagcgggagtaggcaattcctcaggcccttcccattgtggcaactcttactctatctatgactgtatgaataccgtatcattgtaacaccgtttatgtagtttagtttaaattttcaaattgctcttgagtattattagtttttgtgctcttcccaaaaattatgtaaggaagaaggaatacgtagtattcaactcacagattcaaagaagtgatttcaagtggccttgatacacgtagaaatgtaaatacacttcgtgcagtacaataagtgtatttttgtattcatgagtgtgtatgtgtgtgtgtcatccatttgtgaagatggacgtttactaatgtgtagaagactaggcttaggcaccatagaatgttatctattgtttccagtgggccatatttatcacaagtaaacaagacttttttagccttatatgcaatctggtgttgatatagtcaagttcagaattaatgaacgcttctgattagagtgcctggcacagtattaagcataatgtttctaaaatatggggagatgagggttgaaagaactcaaagaaggtagcaccataactagaactatgtatgcgtatgcctttgatttaatttcaagaatagttctgttttatgacacattttaatgtttaaaagccttatgtatgttttaaattataggagtaataaaagttgataaattatttcaaaattatttgaccatttgcagatctattaataaatcattgcttaatatgcattttggggcatgcttaatgtatcgagatattatatattcaaaattaaacatttaatgaataaacgtagattagaaagcatgtcgtatgtctggtcctagactgtagggtgtgtaatggacagatacagtgagagagaacatccaaaaatagcactgcctgtacacagtgatataccagattacagttcaaagtgtcttctaggactaggatataacaatttcataattttctttgcttaaatgttttcaaacacatcttctagtgctgaaaatcaatttcccatttctcaaagtaaacatttgctctgtagccaaaagcagtactttaaaaaataatatcattgaattcaatttattgggaagatttgccagacaaaagttaacagggattgcatcctcaaaaggaactggttggcttggggacatgaatgagggaacataattttggtgccttttgaattatgctcaaatgtatgttttgcctgctcacatatacaaaaaaattaaagtaatttcatgatttttctgctttaagatttctttctctcaagcccatttcccacttacttccacatcccaattcaaagaatattcacttctcattaattctctgatcagatctcttttaggatcatgagcacagttgctaagacactttagtcattaatatttgttaattgtgccaacagcgataatgcaaactttgaaacattttacaccacaattatgccttattaaaacaatttgactgtattaaatgtgccttttgtgtacatctttgtaattatcaatttatgagttgaggaactaaaattattggtgtgcttttcctgagagaagagatacaggaaagtgtcacagatatttgcacttagagaaaaagtttacccagaagaacttacaccaaaatgtattgtcattattttctggaaatacatcaaaattcatataaaatgttatcttcatggttttaagcattcacctctgttctagaagataataaatacctgcaagtttttattgggctattactctgtggcagtaaatatgaaaagacccagacacatgagccatggaacacacaggaaaacaaagtatttactcatgaaaaccagtttgtttaataatgacaaaacatgttgacagtactctccagcaatactcagaatttacagttttagcgtaacatagctgattctcacctgcttccaagggcaattaagatcaaagcttctttaagagataagtatccaaattttagtctgtgttttatcctggaagtcatcttcctctttgcaaagatcaattaaatcacaagaccacaatcagttaccacagccggatgagcctggctgttaatgcataaactcactccctcatgagaatcctcaggaaaccacatgggatatggggcaaccacttgactgtggatacttcaagagtaggttctctgacttgggctccacccccaaggcccccataatgcccactgtgtttgctttcagtgggcattcagcaaaagccactgactggttaactgacctgttggtagctaccagaaaaaccagtatcttatcaccgaagagcagataaaaagaagattctaaatcaactgagacaagtttctgcctaggatgccttgatgtgttgatactcacagggtaaataagagacaaaatcagagaacttgagctgatcagctgagtgggtgcctggatactgagggtaatttgtagggaaaatttagtagttggggaactagcagagactgcaatatttgtaagatatctttacctacaagtaaatgatgctttggtttactgaagtaataaaaagttacagatgccctaatgtggtaggaatcaagttagacatatggttgaagaggagaaatgaggactcagtaataaaagaaagcataatggaaactataggcgcatttggcattttcatagataataaatacatatttaattatttttgtatgctatttctgacctgtgatatttttgaatatttactaagtgtacacatcaaggttggggaatttttatattacataccttttttagtccttaacaacaattcaagaaaagaggaaaaatcattatcctcattttgtataatggagaaactgaagtcaggcaaatgaattaacttgcctaatgttccacaggcagaaagccatgggatttgaattcgcagtggtcatatttcccattgtaagcattcataagacatggtggccaaggagagcaactggggcagggtggggttttgggagtgggagtggggtggctgttcccatcaccagggaaacatcacctgtactctttcctttggctgaactgggatggtggatcactgcatttctttggatgatgagccattataccttcaccagtaatcagcctacccattggccacacacacacaagtcagacatgctgtgatttaagtgaatagtacatggccctgaatgcactcttataattttgattttggaaaaagaaaaacacaagaaaatatattaattcctccttgtcttttgagatttatgggtgtgcagaggtactgtaggtcccatgtcctctagtgtatcacactgtcctgagctttaattcaggtctaagaatgtctgtcctaccctctcaaaaatattttgaatggaataaatacctcctagttactgtctctttctttttgtagataatttgcccctttggctgacattatctttcttactaaacaggagtagtttttatgacagcatttggaagatgctgatagttaattattcatccaatgtctattaaaagggagaggtggtaaaaaacaaaacaaaacaaaacaaaacaaaaaacagttactggctgggtgcagtggctcacgcctgtaatcccagtactttgggaggccaaggcgggcagatcacaaggtcaggagatcgagaccgtcctggataacacggtgaaactccgtctctactaaaaatacaaaaaaaattagccgggtgtggtggcaggtgcctgtagtcccagctactcgggaggctgaggcaggagaatggcgtgaacccggcaggtggagcttgcagtgagcggagatcacaccactgtactccagcctgggcgacagagcgagactccatctcaaaaaaaaaaaaaaaacaaaaaacaaaacagttactcgtgaattcagctagaattaataacatttctatttgtattattctaactgatgatttaaaactatgcaaattgttccaaaatgtttgttcttgtttctctagatgcaatctccctcctttgtcaagtgaatacactaaggatgttggatccaaaagtcagttagtgacagctaatcccagcataattcggcaaaggtaagagtttatgacttctgtttgtgacgaacgaagatgaagtcttctcaagtacttagcatttcaaaggcagtgagcataattcagtttgggaaatcaagaggaaaaccatctggacaggcaggaaggatgaagggaattgtaaataaagaaaacaggattatgggaatccaaacaatattttatgcttcctctgggattctgtttcttgcctttagagatgatagaaataacaagaagatcaattgttttgctcaaagaacagcacaatactctgtttactcattactgctacttttcaatttgttggcttcagtcccaatttattgattggcaactgtgaactgaattaatatcaagaataaaaacaaagcaatggccaatccattacattgctttggccaattcatacatgcattaaaatagcaatattgtcagaatggacaagaatatgtggttatagtatactgtattacattacattatattatattcaatcatatttgggagagcagatgtaaaattcttgttctaggatcaattccagaaatcttgaaattgcctggaatcttggaagctgctgtgggagctgcgggggtgggggagggggtcagtctctaattgatgaagtgcatcagcgagctatcagctgtttctccaaggactgttcattgtagagaaaggagtccgtctccaaggaaagaggaatcaagcattgctttaggtcctcctgtgtccctggcaattaggagggaaacatccagatgttctgggcccaggcgcttgtcatctaagtcccgtccaagtgaacagcatgtgtgttcacttattcacaacgtggcactacttgttttggttcataagtattcccataaaatagatatctagaaatgcaatcagcttttaattttgggagatattgttaaattaccctccccaaatgtaccatttatcttcaataatggataagactgcttgttacccatatgtaaaacaatactatttgtggaaaaaaaggatacattatattctacttaatttgcatttttctgaatataataagagctgagtggtattgactattagtattttttcttctgctcctttgtattttttgcctactttcgacttgctttaaaaaatatttttctattgatttataggaactctatattatggatattaagtctttgtatcaaatattttattctagcctgtcacatatattttaatttatattctattgcaatttaaaattttttatgcgatgagacttgttagtattttcctttatggcttcttttataaaaacaatctttctttggatgatctttcttactctgatgctcctcccttccctgaaaaaaatatcctgaatgtttctaatgcatttatagtatatatttagaaatgtaatccatgtaaatgtatttatttttgttcttataagagtaattttattatttttcaacacaaatgtatgttcattataataactcaaacagaaaagtacaaagaagaaataagagaacacttacaagaaatttttttattaaaacaatttatttttaaatacctgtagattcacagaaaattgcaaaaaacaatttacaagaaggctctacataatctttacccagtttcccccaaaggtgacatctttgactattattttgatttaggaataaaataacttttaagaaggaacacatgttcctttggagggaaatgaaacattcaatattgtattgaggaccagaagattctgtttttctacctgaatatgtggagttgatgtaagatttaaaaaggaatgtgaaaaagaatgttcagagcaagatttagaacaagctgagggagagagggagggaaggaaatgagggagggagggaaagagacgagggagggagggaaggagatgagggagggagggagggagagactgttttgggggaaaaaatataaatacaaatggaggaaggacagggtcaaaaattaaattttgaagaggaaagtagaactgttggttaagacttaagctcactatgaagaaaacacgcatggacaagcaagaatcattattactaacattggtaagtatttagttgacattgctgtgtgccaggttctgtgccctttataggcagttcctcacttcatccttgaaacaatcctaatagacagaagctattttaatttatgcatttgacagaagaagaaacctgtgatgtggtgaatctaggaacctgctcatgcacacagctgctaataatcgcctgggacttcaccaggcctctcttattccaaagcccgtgctctcaaccagtgaccatctctgagagaaaaaaaaaacccaaactgctttttcctctgttctcacactacaacacagaagactgtgacaaagaaccagggttggggggtctggctctttccagtgaccggtccccggcccccaccctgaagctgcataaggcctcaatcaactcattaacatgcaaaaagatagcactgtggagtttctaaagattttaggcattgtacgctacggaatgagatcgaagatctcaaatatctatttcataatattgcaccatcacaccctctgatctttttccaaaatccatgtgtcgcacaaggagacaatatagttttcccagaataatcaacatagaaaacttctgccaccaagtgtgtttgtgtttttcccccacacaccaagcaagcaatcaattctgcagcagacaccagcggggtatctccaactcaattccaacactatctacagatagtgtcagatcccacagattgagggctcagtcccacaagactaccccccacccccaccagtcacaagtctaggcctccggagcttctgactgactggcttcaagttggggttcccccaactctctttatgggtttgattaatttgctagggcagctcacagaactcaaggaaacgcttatttacgtttactggtttattatgttacaaaggattcagatgaaggagtgtgtaggatgagggatgggggaagggacatggagcttccatgccctccctgggcacaccacccccaagaaacctccaccttcttatctggaagctctccaagccctgtcctttcaggtttttatggaggcttcattagcaggcgtgattgatgaaaccattaaccactggtgatcaacttaacctgtaacccttttctcctccccagaggtcagggagtggggctgaagtcccagtcctagaatcctgccttgattctttgcagtgaccagccccccactctgaagctgcatagggctgccagccgtcagtcaactccttaagatgcaaaaaggtatcactgggagttgctaaagattttaggagttacgaagtcgaagatcaaatatatatttcacaacattacactatcacaccttctgatctttctccatgattcatgtgttgcacaaggagacagtagcattttcacaggttataaataattttgtaaaagtgaatgaaagtttcttcattttaaaaaatgtattcaatgtaacaaggtttctgttcaaatcaatatgtgtacaccaattccattttgtgacataagaaaaaattacatttacaatagcatcaaataatatgatacacttaattaaacaagaaagcaagtcctctttggaaaaaatatgaaattttattgagagacactttagacaacctgattagatgtactataataccatgtgcatgattgaaagactcagtatttaaaggcaccaggtctacccaaatctatctacagattcattgaaattccaatagaaatcctaatgatgcatgcatgtgtatgtgtgtgttaaacttaaaaagttatgtagaaatatgccgagaatagcaaagaagctcttgaagaaaaaatgatgggcagagttgctctataagatgttaagacttattaaaaagctattataattaagacaatgtggctctggtgcaaggataaaccaactgagcagtgaaagagaataggctactcccaaatatttccacatagatataaaccagtatatatgacagatgtcatatttatatgagtgatataaatatgaagagccgagaatagcaaagaagtataaacttttcaaaatgatgttgggataattagattacacatgggaaaaaaataaattaaacctctacctcataacttataccaaaaattattttcaggtggttaagacctaaaaatgaagttgctgggcctggtggctcacgcctgtaatctcagcactttgggaggccgaggctggtggactggctgaggagttgagaccagtccggacaacatggcaaaacctcgtctctaccaaaaaatacaaaagttagccaggtatggtggcacgtggctgtagtcccagctacttgggaggctgaggcaggagaattgcttgagtacaggaggtcgaggctgcagtgagccatgtttgtgccactgaaccgaagtctgtcgagtgagacagtaaaataataataattatttaaaataaaaaataaaaccaactaacaatatggctagggacaaagatgtagcaagtaaaactataaggaacaataagtagtcacttctcagggtaggaagagtattggttcaggtgtggaataatgggacctctggattgctagaagtgttctttttcttggccaggctggtgtaacatggatatacactttataatgattgcttaggctgcacatgtatgttagatgcactcttcaatagatatactttactaaaaacataagaaaaaagtatgctaagtgatggaggactatacaacttatagttaattttaaaggttctcagtttgcttttttgacataattgagttcgagacgtatactagagtgtaagttctatataaaaaggatctcagtgtcttgaacataaggattgataaaaacattttttttttttgagacagaatttcattcttgttgcccggactggagtacagtggtgcgatcttggctcactgcaacctctgcctcccggttcaagagattctcctgcttcaacctcccaagtagctgggattacaggcgtgtgccaccacacccgggtgattttgtattttttgtagagacggggtttcaccatgttggcaaggctggtcttgaactcctgacctcaggtgatccacctgcctcatcctcccaaagtgctggcattccaggtgtgagccactgcacccggccaataaaaatatttgaatagaaatatagttaaagccttatcagcaccactgtcagtgttgtgaagctctgtgctcaaattggaatacaatgttttaagccatcaattatcaactttccattttatagaagggatcaaacaggtagcaagtgctggaaacttttggttaaatacagctgagactgcattcatagcatcttgttcatgtggctagcagtatatgcaaacagggtggtaaacaaagtgcaaacacttgtatatagggattaaaatatagatgatgctatactctcatggcacagtaaaatggaggaaataatattgaagtgagaaaggcagtatgtatttctatattagaagattatcctatttatattagatattttattcatatctcgtagtcttctctcaaagctgtgcaaatccaagacatcagtagttatcttgtactttcatgtgatgaaaaattaaacttgttgggcagagatgtgcagtggaaatgctaattttcatagctgtctccaaaaccttgattctcctaaaaatattctatcagaagttataagcattaagagttttcactgtaaaattctgttagaaaatatcagtaacaagataaaacaggttttagaaaaattaagcatacatatgtgagaggcactcataattatagtgaaaaaaagaaagttagagaaggcaatacttattactctatctaaaagaaattctcagtaagaaggagctttgctacagtaagaaggagctttgctacagcctttgttaggatatcttgtttggagtgcattcttcttgacagtacccagaacaaaaagattagttagggtgcctgagacataagattagaaagggctttgcagtcacattcatcctctgattgaatttttatgggcagaagagaggtggttttaatctggcagctggatatttaaactccttactattatcctttttcttcctttgctggcctttgcaggtggaaggcagaggattcatacatatcattacccttcatcaatgcaccatctgtagcccttgttcttaaaacattttggttcaaatactctttattttatttgtatgaatttaagggatatagtgccattttgttacatggctatattgtgtagtggtgaagttaatgttcaaatatcctttaaaagattttttaaatccatcattcccttgattatttttaattaacctaatttttgtggcataggttaaattgttgccaagtacggacttttcagggcattatatacatatgctttaaatatatatattgtcagaatttcagaagtgcagatctagttcttccaatgttacatgtcctcttggcaaaatcagtctctttgtcaaattaatttattaactttttgtcagaaaagatggacgatggactactgtaattcaaataagtgttacagtataacccaatataatgattgggtttaattatattggatttaatataaacccacttctcaggcttaattattcaacatatacagtatggggaactgtcaagagtttgtcccctggataaaataagacacagctcctttctatttcttctaaatacatttttgcttttgttcaggggatattccctcagaaggtatgtattttggaaatgtttctttgtttggtggcttagtggcttttatcctttggggcaatgaatcattataatatttgggataataggaggcatgactttcttttatgaaatagaaaaagaaaaattatggaaatagaatttggaaaagagagttctttagactgtcagattggtcttgagcaaatatatttgagaaaaatatacatatggagtttgaaggtctggaagtttatgggggggaggaggaataaaatgagagccaacaaatatttcttgaaatctactctgggacatgacattacaaagttgaatgagatggcctcaaaccctgaagttgctcacagaagcagacatgtccatggttgtagtgtccatggaagggattttataaatttgagggaatccttctatattagtccattcccacattgcttgcagtgagcagagatcgcgccactgcactccagcctgggtgacagagtgagactccatctcaaaaaaaaaaaaaaaaaaaaataccggagtctgggtaattcttaaagaaaagaggtttaattggctcctggttccgcagactttacaggaagcatgatgttggcatctgcccagcaactggggaggcctctgtatactcacaatcatggcagaaggcaaagggggagcaggcatgtcacatggcccgagcaggagcaggagcaagagacagcgagtgagctgccacacttaaacagccaggtctcatgataagtcacttactattgcaaggaaagcaccaaggggatggtactaagccattgatgagaaatcgtccccataatccaatcacctcccattaggccccacctccaacattggggattacaattcaatatgagatttgggtgtggacacagatacaaaacatattaccttctgaaattatacaaaatgttctctacagaaaataataaaaacttggctgggcatggtggcatgttctggtagtcccaggtactcgggaggctgaggtgagaggattgcttgagcccagaaggttgcgttagggttagggttagggttagggttaaggttagccatgattgcagtcttgcctgggcaacagagcaagaccctgtctcaaaaaaaaaaaaaaaaaagagttggcatgaactaggaaacagaaatgtatttagaacaaatgtagtaaaaatcatggtggagttaaacttttaaaatttgtaaatgcataacttttaattcaataaggggacttgatatgagacctcaatatttattttgaggtataacctgagaaatatcttcccatacaagtagaagagattttatccaatggttagtgcctctaagtttaataaagggaattgagaatgtagagataatcgcagggggaacaattgtttatgttattagtgtgctttttaaataataacttgagctttgaggaaaataacttgggtccaagattacagcaatttatctttaaaattgtgtacaactcaatgtacacaaactatacatgcatgtttcaaactgtgttcctaaaacttccatatctcttttgctgtctgacttctttttttttttcctccaaactcagagcagcttatcattgtttgtatcaaggcttcaaagtcattgatagctatttattctaacatctgttctgaaataagggaattagaaggcagataataaaactgaaactagagatagcaagtaggagatagaaaagaaaagcccctaaaaatatggatacatggagttggtatctgagaggcaatattatatagcagtgaagaacacaagttttgattagaacggatttgttttcaaattatagtgctagtgctagtaagtgtttctgcctactagctatgtaaccttagttacttaatgtaccatatgtcaattgagtataaatattatttaccttggggactgttgagagatataaatgagataatgtaactgcatctagtagaagctattctgactgatatccaaattagctactcaagaggactctccagttgcaatacattttgttcttggataaaacatattatttaatacattattgtactcatcagatttagagaaatttccaagaatatctgcatgcccaccttccccacaaaaaaaacaaaaacagaaaatgagggaacaaaaaccagaccaaatggtgtgaattataaaagtcaggtaccaaaacttagaaaagagaccaatctctggactcaccatgttgagggtgtcccatattaagtcctgagaaggagcctattgtggttccaggtcagtagcagcccctggcttccaacagaagcacacaaatttcttctggaagaaagctcatagaattctcacatactatgttcaaacaaatgatagctcataagcaaacactcaaaatgcacacaagccatcaatagtgtaaattctcagagacaaaaatcaaacaaaaagtaccagatgaatttaatgcctgagaacttattggaattgtcagatgcagtagattactaaatatgtaatctttatagaaaataaaaagaatgagaagccaataagagaatatccaaattaaataggtagacttgaaaaagacctaaattgaacttttagaaatgaaaaatataattgttgaaatggaaagacatcaaattagacataactgaagagagaatttgtgaactggaatacagagcaaataattttccagataatgaggctatggaaaatacaaaggcaagacaaagaaacatggacgatagaatgagaaggagtatgttaaagtggaattgtggaagtataaaatagggataagaactctttttcagaattcatgattaatgtgatccataagtaaaaagtaatgtgatccaaaacacaaagtatcaagcagatcaattaaaatttttaaaaatgcaaacagacaattttagtgaaacagagctaaagataataagaagcttataaaagcagacagaaagaaaagacagatcacctgcaaaagaataattatactaaaaacgaacttcctctaacagtaaaaatggatgtcaggaagcagtggaagagtatcttcaaagtgctgagagagaaactatcaacatagaaatgtatattctgcaatctatttcttcaatagttgtttcaatagaaaatgttttctgaaaaacagacacagattttttacctccaaagatccttcattgagagaaaatctgaagaatatacctcagaaaaagagtatgttactccagaaaaaaaacctgggatgcaaatgaattgctaaacatatcaataaatctaaacaattttatctgtataaaacaataattattatcatacattatttttgcagatgatttgtgtgatcaaaacgaaagacaactaaaatactggaaaatgacattgcataagttaggagggggagattgaagtgtttttagctcttctttcagttttttacttcttagtgacaggtcatccttttgtcttaagcagcaacagcaataattttagtatctttcacgtttctgtgggtcaggaattcaggaagaactaggctgaacagatctgtctcatgatctctcacatggtggctggagttgaaatagcaaaggcttggagcagccggggctggccaaacatctcccttcctgtgtagtctcagggctttctgtgtggtttctccttgtgaattagtgtgggcaccctcacagcatgattgactccagaaagttggactgtttacatggcagctggctttccccaaagctagtgtccatagagaacaattggaattgcgtgatgttttaatagccttacatgggaagtgtgctagcatcactttcatcatactctattgcttgaagcaatcacaaagtcccacccaggtacaagagagaagagttctagcacagatccacctcttgttggggggggagttctcaagtcacattattagagtatgcatggtaggagagtttttgtggccatctctggaaaatataatctgccacagtctgcccttgggtcacaacaatttatatccctcacatatgcaaaataaactcattgccttcctgaagaccctcaagatctattccattacagcatcaatttaaaatccaggatctccaaaaggttgaaagaggaacagcaacaacaacaaaaaccagaaaagaataaactgaaaacaaaaatacagcagagtgggtccaaaaagccaaagttgatactttgaaaagtctaccacaattaacgaacctttagtaaagttgataaataaataataattattttaaaatagacttttcatgatttttctacaaatccatactaaaaaaacaagaaaaaactctactgtacacaaatatattacatacataataaatggataatgagaataaaatggtatctccaaacctaaaaaaaagccagtgattttgtaacttatgatatatccatattgatggtatactatacaaagatattatggattaatatacataaatggtttcaataaatggtgaaatgctcatgttctaatattaagtgaaaaaaataaatatataaatgtgtaaatatataaaattatatatatagttatgttcagagaaaatctctaaggaaaaaaaatcaacattttccaaagttgcaaaattttataatggggaaaaaaattatttaaaaagcagaccttggctgggcacagtggctcacacctgcaatcccagctctttgggaggtaggaggctgaggtgggaggactgcttgaggccaggggtttgagaccagcctgggccatatagtgagaccttatcactacaaatataaaaaataaaaaattagccagacatggcgtctatagtgctagttgcttaggaagctgacacaggaggattacttgagcctaggagttcaaggctgcagtgagctgtgatcatgccactgtactccagcctggatgacagagtgaggccccatctctttaaaaaaaggccttgttattttataatttttcctaatgttaacttattttgacaataccacagccctgtgagttggaggggcaaacaatatgaataaagccctgattttgtgtgtgggttcctgcccttccagatttaagtgagattaacttgaactccaaattttatgtacttaattcagagtcagaacgttctccacatctttccggtaaccttgtcctgagagcagctaaggtgagcatagcaccaagaacacaggacctgacacacaggagttactgcataaatgtccatttatcttctttctttctttccctctgtgaagctctagtcttcagtgttaatagcagatcagatcaaacattactctaaaagcaaaattagcacataattagtaaataaatatttgaatagcccaagttctcatggcactttcatgcaggcccactgagagtgggttgcacccagtggagaaacattaggggaggacccagcaagggtacgaggtggagaatctttacccaggatttatattgatatgccgatatgccactgggccaacaatttgtaccagctttctcccatccacccctcctcagccctctttttaaagtgtgcttcagttaaatatattttcaaatcagtaaaatgtcagtgagttgcaatttcagtgaaagaaaatgtgcggaggggtttctgtcagctaatagaacagcattggctgtgtgatgaaagatgagttgttcaaccactctctgcatggaatgtggcagaaaacatttaagtcagcaccagaattttgttttgaaggtgtgctgtctgtatatggaactgtttcttgctgaattctagggatcagggagaaactcaagggcctgtgttgtttcgggagtggaatctgagtaataggtgagtgtggaattgttgggataagcaaaagagaggggttgaggaagaaagaaggtctagagaagggagacgtggtaaaggagcaggagagaaatctttgggaaacttaggcatgttggctagaaacaaactgaaatgtctaaaatcaattgtaagttgtttttcagagagtgcgtgtcctgaaattatttccccttaattctctcttaagttctatgactcttcagatttctaatgtagccatgcatttttgtcagttttgtatgtgacattagcgtgtgtatgtgcacgtgtgtgtgtgtgtgtgtgtgtggtgaagggaatgtgcttcattcatttgggatcaacatggtttgttctcctgggtaatggcactgaggggacagagaggacctggagaatataaccctcctagggatgttcagatgcaaatcctgggaaacgccactttagcagttgactgcataccccttttggaacgtacagacaaccttttgacttacaaagctatttcattacagccaaggcatttgtgccccagcttaactgtggaaggcaaactttaagtgtaaagtgtgaaactggctaattatcttaccaattccatatatgccaagagcctctttgagcaagatggtaggggtccatctgtgaacaattcattgcacagagttgattatgtattccgtgatttcagattgtccagctactaatgaactttcttcattatcctcatgaaaacggatgacagtaacatttattagtatgtgaatatttctattactttattaaaataaaaatgactttattgctaaatttatatttgtaattcattttattggagaatagaaaccctgtagattaaatagaatatagtcccaatgattactaattgtattgcattggattatatattgtttaaaacaatatttttattttaaaaaagttttctttccaactggaattataaaaacatatctgtataagtttctgttactaagttgctttaatttgtttaatagaattttaaaaatcagagctttagtgttattgcatttataaatcatgatatgcatttttaaccgaagtttccactgtagctttcatatctgaatctctttggacacacacaccctgcgcacacacacaatacatgcgctcacacacgtgcacatacacacactaatgagacaaaggagaatcagaatcacaatgcaaattgttgacaaggtcagaatataaattagtgggacagatatcatatttgataaatattattgcaaatacaaatgaagggaaaggcagaaaaaggaagtgctacccacatggttaaattaccatattttattgattgtgagctgcacagtttttaatattttaacatctgtgaaacagctgcttcttacagcctctgttgtccagttggaagctgaggcatagttggcactgggagtacatagttgtcaccttgctcatagctgctcctatgctgtcctcctaattaaattatgcacattgttgtactgcacatgttgagtttgattggcatttaaaatatctccaaaaagattgaatatctattgtgtataaagatggaaacaaagcctgggatgtaaatttgatttgtaagcaaattacttcagagaaataatggaagcaattttatattttcttgtaaagcaacataaaaaaagaagaagaaaataaccaccagcggatgatggtttattttaagtagttactaagatgtgtgcaaaatgattgtctagacaaggcagatgaaagtaggaaaaattgttatgttccttagaatggatgaaaaatgccaaagcaagaagagactagtacaggactattcacaatactattatagaaacactgaggcatggttttattggcagtgtttttttctttatagttagtaaataatatctttttttttttttgagacagagttttgatctgtcactcaggctggagtgcagtggtgcgatctcagctcactgtaacctctgcctcctgggttcaagtgattctcctacctcagcctcccgagtagctggaattacaggcacccaccaccacgcccagctaacttttgcatttttagtagagacagggtttcaccatgttggccagactggtgtcgaactcctgacctgaagtgatccgcccaccttggcctctcaaagtgttgggattaaagtcgtgagccactgcacccagccaaataatatattatatttgataaaatataatttgttttaaacaaaaaaatctgccaattcctctgaaatacaaatgattagatagaaaataaaacagggaatatttggaggaagcatggcacataaaagaaaatactaagcactgcacaaccatgaggcacatagaactgatacgctgagaggtaagtaatgcatgtattagcattatcctgatttttcagtgaaaacttttgtgacagacaagttaggtgatttgcttcaatcagctattaagtggcagattaggcacttgaacctaggtctttggacccttttttttttgagaagtagtttgagagatactgtggaggggtttatggttggcatcgcagcttacccgtgttttactgcgagagaagagaaaacaagaaaattccaagaggtcaataatgagtttaccatttaaaagagaaaaggaggatttattgacttgagatacttgagtgaaactcctggggagacaaaaaagggtgatttatgattctgtactctgtatttcaaagattctgacagtaacagaatacatgaaaggtgaaagaatgcatgctcagtaaatgttaaaaaaaaaaatacaccaccacagtactctactcttaaacttgattgatatttttgctgggattttatttctactttggaaatccttttagcatttcgaagatgttcctccaatgtttcttcctagattcagtgttgcttctgagaaaactgatgtcattgtgattcctgatcttttgtgtatgacctgtacgtctacttacccctgcattctaatctggtcgtcttcctcgcctcatattttgaaatttcacagtgatacgcctagtgattggcttaatttcattcattgtgctggcacgcagtggaccttttcaatctgcaaggttatgtcctttcattttggatatttttcttgagttattgccttaattctgctttgccaattgcagtagtcagttgttagttctcttatttgacccaccgggaacatgtgacacattgatttttctctccttaaaccacttacttcacttagtttccaagtcaatgctgtttagattctcttgccattttattttttatttatttttatttttatttttttgaggcagagtctctgtcacctggctggagtgcagtggcgagatcttggctcactgcaacctccgcctcccgggttcaaaccattctcctgcctcagcctcctgagtagctgggattacaggcatgcgccaccatgtccggcctattttattcactttctacaggattttatccagtctcagggcttaaatactatatgtatatcctctgatgactcttaaatttgtactctgagacctattcttttatctccagactcatatacctaactcccagcttggctaatctatttggatatgtaatatgaatatcaaacttaaaataaccagtacagaactcctaattcccccttttctgcaaacctgtgtattctgtcattttccccatctcaaagaaatggaaactccatttttcatttgctcagctcaaaaaccttgaattggagtcccccttggcttattttattaaatccactgctaaattacggtggctctactttcgtattttatgaccattattcacctcctccactgtcatgaccttggtccatgtgtctcccgaataattgcagtcatctcccaataagtttttatgcttccagcctcaccactgtgctgtttagtaacttattgcctctcagctgcaaaaccactttcatataccctggtttgtgttgctgaaaccatgattttacaaatcacgtttcccccttgccagctagtttctgactgggggcactagagggacactatgggaggctgaaaggggaaagagatttgttccttcctgctggtgtcctgtgggtctcctgtctccttgtggttcctatgagaataaccctagcaaccattcttttccatagcagtagctaaattcaagtggcagcatttctcagcactttaaacttagtcaacacacatgtaagagattcttattcttgtcttttaaactttgacatttgtaaaaccacaacaacccagtctaagaataaagcaattctttgggaggctgaggcaggcggatcatgaggtcaggagatcgagaccatcctggctaacacggtgaaaccccgtctctactaaaaatacaaaaaattagccgggtgtggtggtgggtgcctgtagtcccagctactcggggggctgaggcaggagaatggcgtgaacccgggaggcggagcttgcagtgagccaagatcgcaccactgcactctagcctgggtgacagagcaagactccatctcaaaaaaaaaataataaacaaaaataaaaataaaaatcttattgcattagcacaaagtagaagaattagtttatccttggccatcccaaactcttatgcttctttattctagccaggcattttcttcccacatgggctggtttttctactttaaattatcatttcatcttacaattgtatcctgtggtactcttcacagctcagaaaaaaaaaagcttattctaattaatttgataaaattattagtctcttacctgttttggagtgaaggtgttagtgatagggtggtgatcgtggaacagttggaatgtcaagtcagcatttccagcaggacatgggtctttggaaaatcacgtgcaacattgttcatttaattcatttggaaattcattaaattttccaaatacaagtatttaaatatataatattatatatgtattattatgtctattatatatttatatataattaagtataattatatctataaagtatataattatatatttaaatactcatgctcacttattttcacaactcaacttacaaaacatcaagctcaccaacatatttctagttttttgggatatgcagagatgtgattcttagaagaggcctcactttccctgggaagtgcatcagaatcggcagaggcagtggcccaagagatcttaatgtttattaaagataaatgtgggttagaaacaacagcctggggactgctgctttccattaccccctccccaattgtggtatccttgctcccattcccagtgatgtggtgttccttggttccaagagccccatcccccagcaatgccctgtgattcagatcttctcaactcaatgtctagtctctactctattcaagatgatagtgagtcatttgataaacatatctttgttgaaatgttagtagtttataaggggtaatgttttacttctctctgtggttttacattttaactggagccaccctgaggaaactaaatgctttaaagaaatagaataattctttaactggagaaactgcagacactttgactgtcttgggagtgagggctgggcaggggattttagacgggggattggaaaggaatccttcatgttctttacatcattccatttatacagctagttattcctagggctgaccttgctaccacaagattaatgatggcttttggagaactaatgggaaacagactctactcttttgtattacagagccccagagagggcaggattcagagtctatagctgtgctctaagactagaggctcttagaaggttgcctttttcatggtttacatctcatggcaacaaattctgtgaaaaaaagagatttcattcctcaaatatatgctagatcataacatgtgcctgatatcactaaaaccccagaaggcaaagatttcataacctttagatggaaaggttttctgatttttgtgtaagagcattattttgtaagagcttgacactatttgtttgaacaattgttaaataaatattttgaaacagagatttaaagtcctggacgaatgaaactagtggttaccggtacttacattacttgatctctgctgcacttaacacatgtttctgcattcttgatattctttccaccctatgtcccaacacagctctctttactgtttcttgttatcttcctttgttggttttcctttcatctgctaccttaatgttggtgttcccaagtgttgaactaccactagttcagacctgtcccaggccttgaatctcttctgtgcttcagacagctatgtgtctactggccaactccacttagaaatccccaggtacctcatgtttcatatgtccttaaagtgaataatttttctcccatcaaaccatccttgatcctgtagttatcatcacagttattggcaccatctttcaagccatcatggtggataaccttgaagttattctttttttttttttttttttttgaaacccggtcttgctctgttactcaggctggagtgcagtggtgccatcacagctgactgcagactcgaccgcctgggctcaagcaatcctcccactttggcctctcaagtagctgggactacaggtgcatgccaccatgcccagtgaattttttgatttttgtagagacaagttctccctatgttgcccaggctggtctcaaatccctggcctggagtgatcctcccacctcagcctcccaaagttttgggattacaggcatgagccaccatgctcagccattgaagtcattcttgtacatcctcattgtcatcatccctatctattaatctacaaacactgttaatatcacttttacattatccatgaactctgttgctgtctcagtatttccactgccattgtctttgttcaggctgttctaatcccttgctgaaaatagtgtcctaagatcttccttcaacacccctcccctgtttttttacagtatagatttgtctttaaaatccagagtcaatattcttcactggctccccattacttttttttttttttttttttggagatggagtcttgctctgtcacccaggctggagtgcagtggtgcgatctcagcttactgcgacctccgcctcccggcttcaagtgattctcctgcctcatcctcctgagtagctgggattacaaatgcccaccaccatgcccagctaatttttgtatttttagatgagacggggtttcaccatgttggccaggctggtcttgaactcctgacctcatgatccacccgccttggcctcccaaagtgccaggattacaggcatgagccaccttgcccagcccccactaatttttaaatggaatctcgggtcatcatccccaccactgtctcctactttcttcagatgccagtatcacttgtcactctccagggaccacactcaccagtagctctgcacacatgcaatgtcctctgcctagagagtctttctttgtattgtcccttacaaggattagctctccaatggcaatgactctgtctctttttatctttttattctcagtatctagcagagtgtttaacacagtgagtcattagcaagtatctgggttagtatgtgccattctggtgaaatgttgtattccaacttttaaattaaattagcataaataaacacatagacaaaaaaatctacaagagaactgaaaaatagggataagagaaaaataaaatgctagaatctgcagggaatttccactaactgcagcaaggagagggttgggttgagagtcataatctaaactaagcctgctgaaccagaatagcacagaaatctgggaagaagatgggaaaagactgtgactcaaccccactctatccactggcaaagaaacacagaaaatcccaaagctgtgtgaattcttttcttagctggctagggccatgccctttctgctcttaatcagttcttctctttcctcatccacttgacaaccatacttcacaatacacaaaactgccatgggtagagagggaaaagtagaggcagtatcactttgcaggctgagctgtgtaaagactttaggaaaccattcaaggagggaagatgagaagaagagcccttagaacagtgcagctggaggtgcaatttttatctctatcactaaaggaagaattaaattctgcgtatgactccctaaccatcatcagacaacctgtcagttggagtagaagatcttccctcagtttagcaaaaattttagatgattgtttgctagacatgagaaaccaggctcaggacttggcactgtggcattctttgtaagtctaggtctaagaaagaaaatgcacaaatactcaaatgattagtgcctgaagataaaaggataccatatatacctttttgaaacaaatatggttctggaataagtttcttgctttatgtttgtttttctactatttaagagaaataatagaaaaaaaatttggtatagaacacctcaaaacattttttttgtgtgtttttgttttgttttgttttttgagatggagtcttgctctgtcgcccaggctggagtgcaatggcacgatctcggctaactgcaacctccatctccgggttcagcaattctcctgcctcagcctcccgagtagctgggattacaggcgcccaccaccatgcctggctgatttttgtatttttagtagagatggggtttcaccgagttggccaggctggtctcgaactgctgacctcgtgatctgcctgcctcagccttccaatagtgctgggattacaggtgtgagccaccgcgcctggcctcaaaacattttgtaacacagaaaatgtgacttaaagactcagaggaaaggtcaggtgtggtggctcacaccagtaatcccagcactttgagaggccgaggcaggtggatcataaggtcaagagatctagaccattctggccaacatagtgaaaccccgtctctactaaaaatacaaaaattagccaggtgtggtggtgggtgcctgtaatcccagctacttgggaggccgagacaggagaatcattgaacccgggaggcagagattgcagtgagccaagatcatgccactgcactccagcctggcaacagagccagactccatctcaaaacaacaacaacaaacaaacaaacaaacaaaaaagactcagaggaaaaacacgcatataaacatgctttcgcagaggaaatagaaaaaatttcaaagccttagcttggtgacttaataagaattgacccattaggtgcacagagtggttaggagaacaaaggatgagctgaaagttgagatgaaaagagagatggctgagagcaggcagaattgcaaagaaagcaataaagttcatgttggatgttgcaaagagcagagttacagtgcagaaagtaaaccccttaatatttccattttaagaatgtcgaggaaaaaaactcagagagatgaatataatgagaaaaaaaagatgaaggaaagggaaaggagattcatcctaaagatgacaagtttgctgaagaagaatcaataaagaattaaaaaaagtaatcatcagacccaataaggaaaaaaaaaaaagttttaacagccataaggctttccagagctgaaacaggactgggtccacaggcagaagtacttagttacattccaggtaaaattaatgcaaaaagacccacatttagacatattgtgatgaatttttacacttcaaagataaagagaaaaactctacaagcatccaatcagaaaaatgtgatttacctacaatggagtaagagtcaaggtagcttcaaacttttccctatcactaaatttcaggacagatgtcatggtaagtaccaagatgtgaatgattctttaaaaagtctagccaagttgtcatatatataatacgagggctgagaaaggttatttctcgaatattcttcttgaattttttgagtataaaatatgtactatatacatatgtattatgaatatgcactacagctgagagtcaaatattcaagaataagaaatttgcagtataagatactgatagtaattcaaaagcaattaaaagtatacagattgaaacggtgtgctggtaaatattccaaaaccagctctggggtggggaagaaagccttcatgtttagtgtttgctgatatacatggtgtaagtgccgcccccacggccaattcaagctgccattgtgatgttaatgtggagttggggagtgataaaaggtaaattgaggtacactaaaattttaaaaagttgatttgagcaaacagtggttcttgtttcacaaagcaccaaaccaaaggtggtttcaggctttgcagagggaatgcaaggagaaggctttttatggggtgaacgctgaaataaagcaagaaaacatttgattggtaacagttatagagttgccttaattggtctgtcctgcggaaaagtgtttagttatataaccataagtttgttcgttggtggctattgagcttaaaaagtttcatttttctttaacataggtgtttacaagaaatattaatagctcaagttttgtttcacttatgtttgcaaatcaagcaaggttaaggccacttatgagctctgactggctttgtctgctcaggaattcctcagccctggtctccattttaatttactttaataggagaaatgtgagcaattggtcctcacatgcctactaggatccagctactagtaggatccagatcctaataattaggatctggacctattagttcactctttgagcacaaaataacttaaatcttcatcagaggccatatatcaaaattaactgtataatcattttattagtttcttagggctgctaccacaaattaccacaaaccacaaaaacaacagaaatttgttttctcagaattttggaggctagaattttgaaatcaaggtgtcagcaaggtcaggctctctgtgaagtttccagggctctagaggagggtccttccttacatcgtcctagcttctggtgctgtctaacaatctgtagctttcctggctgatagactcagcactccatctctgcctctgtcctcacacagcattcttcctatgtatgatctatgtcactgttttttctttttataaggctgccagtcattggatcagggctcaccctaatgtgctgtggcctcattttaacttaactattatatctacaaagatcctgtttctaaataaagtcacattctgaagttctgagtgggtgtgaactttctggggatcagtacaaggatttgacccaagagaaagattcacacattaaatgtaagaaacagactacaaaaattaaaagcattagtgtgaatacttatttgtcttgaggatagagtactttctgctggcagaaatcaaagaaaaatgatttatacatttgactccaaaaatttaaaatgtgttcttgtcaaaaacataaaatctaaaaaccgacaattatttgggaaaaaattgcatcagagataccaagataaagtataaataggccaggcgcagtggctcatgcttataatcccagcactttgagaggccaaggtgggcaaaaccctgtctctactaaaaaatacaaaaatgagccaggcctggtggtgtgcatctgtaatcccagctactcaggaggctgaggcaggataatcgcttgaacccaagaggaggaagttgcagtgaccagagattgtgccattgcactccagcctgggcgcagagtaagactccatgtaaaaaaaaaaaaagtataaatatatttttatatatttataaagatgatatgtaaacaggtatgaaaaatattgtagtctcaggagataattggatgtagaggtagaaaagtcacaaaggagtaaatacagttggcttgtaaaataagtattcagtcatattaataaatatactcacattagagctggaagcaaattatctatttttaacaaccaaagtagaaaaataaagagaaatgataacaatgctgctgtatattctcatgcactgctagtgggagtataaattagtacaacctttcttttaggaaaacaaaagaattgacatgtatcaagaatcttgaaaatgttcctaccttttgaattcataataacacttctaaaaaagtcagaaagtaataatctagcaatgtataaaggataaagatgtagaaagcaaaagaagatataacagaattaagtattattttgcacaattagaaacattctattgttaaggatattgcagggaatataattcattctaactagcctaagcataaatgggtttatttaaagggattttacagctgtcgagagggtgaagaaatagattcttgattaaggaaatggaaaacagctccaaaagccaaatgacagaacgtctccagcaatcaatagactgcagaatcagtcagaatcagaatccctgccacgttgagaagccacaacttcagctgctcactccagactcatgctgcttgaatcagaatctggcttgaaaaatgggcccctgtctcctcatttaacccagttcagaagtcaggactcacacaggtacatgacattggctgcgccagcatcacagctggaatcccggctataaagaagtctgagaaaggcagttcttagcttttccactttggactacaggaagatacagaaggaggttgaaatgattattttgtgatccagtccatacatgcaccacactctaaacattcaaattataagaaatgtattcaatggctttaaatgactctgaaatacttttgattaaacattttttaaaaagcatgaaatagaagcatatataatgcatgatctcatctatgtaaaatatagaggacaaaacacctgagaaatatgtcagtgcattaaacacttgcatgaaactgtaggagttgttctttttcttaattataccttttctgtttcctaaaatgaacataaattaattttataattctcatttcccatcaaaacaagcaaacacatgtttgttaaataaatgaaggaagtattgaggacatgaatgaaaagaaaataaatatatccatggctgtttctttcgctgttttagggtttgaagagatcccaaaaaggcttgttaatttccctctaaatttggctctttcacatcaggcatgagttgtagctgctgatgaaatactagaggtagcacaggctagtcatttagactggaatttaggggtatttgtgtatttatgtgtttctcttgggtaatatataaatatatgtgtgtatatataatatttgggttaaagtatatgactatttagaatcttacttaatattaaaatgtaaagaaactaattttatttatcaatcataaataaatcaatgagtacagtgattgcttccaaagaaaacaaaaacctagagatacagtgtatataagtatatgtatatatgtatatgtgtatatatatatatatggtctttttctagttaactgtcaataagattacttacacttctttcacatacagtgctacttttaattaaaatattattggtattttgaatgaatactttttactgcttgttaactgtgataaaaataataacttcttcaatgtcttttctctcacttctttaagtattagagattttctttctggaaaattagagattttctaatgtaaatccactaccaaaataaaaatactcgagtagagcaaaaagttactgtctacagtttttccctcgtgaggcagcttctcttgctgaacatgtttggaccaaactttccaacttagcatgtgatctagcacaacgattcccttggagattctgagggatgatttgactgccctacctcattacaaggaattccttcagtgtgatgttaaaaggtgtggactaatgtgttaaaattaacccaataataaaacaagttaaataagttaagtttgtttacttaagtttgttaaatgttaataaactttttttttgaaatttattcttaatataaatatatttggtttcttatcctaatacattgcaattataagatgtactattaagaagattccaaagttcactgtattgtgcagtttttttaactttcttttccatttttgaaaatgggtgaagaatggtggtattagccatattttagagagagaggagaatgactgctgtatatacatgtaacatacgcaattcgttattcaaaatactttttaggctaggcagacagtaactgaggacacttagaaatggaagaaattactatttgccctacatctaatataggtataagcaaggaaaaggtttattttaaaagctaatccactaacacttgaatcacaacgtgaaatgaaaatagatgttctgttttcaacaactgtaatataattaactcttaggctctgcttttacttagcctctgaatcaactgttttgcagtctactgtggtttgtttggggctgtttgcagcacatgatttaaagaattggaggtgaaatgaaatgagtgtataatttagtctttgaaattgaagagagcaagtgagacatttcttctcacctcctcttctttgttattttctacactttgctatttctctcttcgtctttattcattgtggcagataaataatgggatgagtgataggaaggaaaatgatttttgttctttttctctttttgcatctcaacctctttaatcatacaagtttttgattgcctattttatctttgctgttgtttttggtaatacctctttatttacctcctcttcctcttgtccttttgcttcccattcttctgttctcttttttccctttcttctccatctgtctccactcatcattttttttctttccaggtgatgatgtaaattggaaagttagggtagtggtattgctggtgggcaaggtaggtgtctgaaataactgcatgcttctccaaggagactggtggcctaggagggagccatcttggtgctaggagagaatgaaaaatggctgaagggaatgcccagggatggacttgagatgctacctccagttctccatagcctgcatgtgatattttgggaatcatgacatttccacactgccaatatgtagaaaagcactaaaagtactgatggagcaaaaagggctgaaggcagagaaaaggcaggcacggattactgggacagcagagaaggttagagacttgagttctggttgtcagcttggtgtccagaaaaaccagacataccagccatgcagacaccaccagtgccaggtcccaaggacaagctcagatcaacttcaccacattggagacagcataaggatctactatttccgtgaggatcctgggagggaaaaattagctctgaaggagttttgcgttttaaatgaatgaaatatttgcccccaacactgtttttactttgaaagacacttaattgcttttaattggcaaatttaagggtttttcttccgccgtcagtgaggatgggaacatcagagtaagatgaaggcaattgcagggggaaaaaagttagacttttgcacatgtgagttgtgtataaattttcaattctgctattaggggtgtgtatatgaaagacaaaaatccgtatgttaattgaggtcaactctgaatggtagaattgttaggtggttattgttttccttctctgtctctctctcttattcaatatgcatttattaaacactgtccctctgccaaacatactcctttgtgcttatctttatttctaaatttctctacaaataaaatatttctgttttacttttgtgaagaggaagacataattgactgttatttaaaaataaatctatcctattcactcactgtagtatttgagtgctcgtgtctcatcatgtgagttgaaaacaaggccttggagttgactgttctgttcctcagtatatgtttttgaggttagttaaatataagttccaaggtttgcaggaatcattttgctgggcttatgtagagcttaattcccatgcaaaccttttcattcactattttaggctatgttgtgattacatacaaactagaactctgttttgatcttcagaagtggaggaagtttgtagagtgttatgatactctggtactcaagtgatcttactgaaaatggattaaaaaggttcatgtgaaagtcaaatctggtagttggttcttttttaaatataatgattcctctatgtgggtcaagtttttatcacaccatatacaatggaaattcattgcagatgggtcatgcataccctggcatgatgtcttatagcagcctcctaacgtagtcattgcaaggtgtagatggcaggcacataccagtgagaaatttccatttgctttcccagaactagcaaatacactctctagctgctttaaagatcctgtaaatgatttgttcatgataatttcattttaaaaaatcctccataacaaggttccccaaattaattatcttgtggcttgtggtagacaacaatcaacctgccgggtcacctaaccaaaggcaaggtgagtggaatattaagtcctctcttgcttcttcagatgtagtctgaggcctgggaaatggtttcaagtgccctcgcctccaccctatcctggctctgaagtgcagctggtcctcccttccactgctgcatcccaagagaaggatccctgtcttcacacccttctcagattttcagtttgagtttatgacacaaagggaaattccaaattacttcttaacttttaaattgaaggataatcaaagagattatacagatatcctgtctatgtaactatagaaatataataaaattaaaacacagtgtaatttacatttgtggtatgttactggcaagaacttttaataaaataataattgaataatgaaattcatcattaattaaataaatgtgatacctataataaatatgtaatatattaaagctttcaatgctaatgcaaatagttctatcagttgttttaaattagagtatagagagggcatagccaagttctttgtcataaaataaagatgatacattttataatattttggtgggattccattctcttataaaactttgcttacatttagcttgtttcttttggattatagaaaagagattctttggtattccctttctgctctgacaaagaacatgaaattcaccattttcactgatccctgcacttattattccttgctatttcttttttattttattttattttatttatttatttttttgagaccaagtctcactctgttgcccaggctagagtgcagtggctcaatctcagctcactgcaacctccgcctcccaggttcaagcaattcttttgtctcagcctcccgagtagattctcctgccttggcctcttgagtagctgggattataggcgcctgccaccaggcctggctactttttgtatttatttatttatttatttattttgagtctcgctttgtcacccagactggagtgcaatggcatgatctcggcccactgcaacctctgcctcccaggttcaagcgattcttgtgtctcagcttcgcgagtagctgggattatgggtgcccgccaccatgcctggctaatttttgtattttttatagagacggggttttgccatgttggtcaggctggtctggaactcctgacctcaagtgatcctcccatcttggcctcccaaagtgctgagtttacaggcatgagccactgtgcctggtctattttatttttttgagagagtctcactctgttgcccagactggagtgctatggcataatctcggcccactgcaacctctgcctcccaggttcaagcaattcttgtgtctcagcctcctgagtagctgggattacaggcacccaccaccacacctggctaatttttgtattttttgtagagatggggttttgccatgttggccaggctggtctcgaactcctggcctcaagtgatctgcccccctcagactcccaaagtcctgggattacaggcatgaatcaccgggcctatttcttgttatttctaagtgttcactgacagtttggaatgtcagtcacatgtttaaattttatttcacaaaacaatgagacatgagaaatgaacagttatttacattcatctcattattctgataatgcctatataaacaaatgcacagacataccaaggctaggaagtggtttcctattaatttataacttgtgtccttggagataatgcttatttctttggaagggttcttttaagattcaaattttcatcacttgcttttgcaaagaggagagtaatgatgatgatgataatgatgatgtggtgatgatgatgatgaaagctagtagttgtaagacttattatgtgccaggcactattctaagtgtgttatacatatgaactcatctagtcctcacaacagccctatgaaatacacgctattattatttttttcaaatgagaaaattgaggcataaagcaatgaagtaaccagcttaaggttgtgcagtttgcctgtggaaaaggcgggacatacaggcttctcaaaataccttctctaaaatttgaaaccacatttgagaccatcatctatattagacacagatatgaacatgaaaatcaatgggttttccaagatacagtctatttttaaaatataaggtgttgctttacgccatcatctccatttttttacttaaatggtgatagtctatagattagaatatacttcacttaatattatgtctcaaaataaattaatatctgtttttaaagtttagtatggccttaatttcatataaagaaacttaaacaaataaattgctcttctgagaagttcaaaagggagagaccataagagatgaacacctatggtcaaaacaacagcaagtacaattttatttgtcctggaaaaaaaatgagatttttctaaaagattcctgatattaaaaatggttgtgtgatttgtggaaaggttgatgtttctcggaaattaccatattctgtttacaagaaaatgaactagtgcctaatgagagatttgtatttaagggtgctattcagttcctaattacccgttttctggcttcaggcaggaaaatagcttgcataaaagccagtgatagaaaatgttgcatgacaaatgtgaaggcaatcaaagtatctcttatgttatcttggtattccttaaaaaagaaatagcatattttgctttttgtataccatattttggtaagaattaaatgcactttgtgacaaagatacaaaaatgcttagaaattcactcatttcattatgcatttatttgttcaacaaatatttattagatactgcattatgtcaggcatagcattagccttagggaacagcaagataaaggacattagtcttttctgaaggaattccataaaggagatctaaaaattaagatataaagacatggcaagatgacaagtaccttgataaaaataaagtgataagagaacacaaagttagatacctaatccaggctcagggtcatggaaaactttttatagtagataccatgagttgagttctgaaagattagtaggaattagcagggcaaagggggcattcactttagacagaacaagtagcatgtgcaacagtttagaggcttcagcgagcatgacccttttgatgaacaccaagtaattgggcagggcaagggtagggagtgctgacgagcagtggcaagaaaagaggctgaaggtgtaggcagggattatatcatgcttagactttatctgaagatgaggagaagcccttgaagaatgcccccttgacaggaagtgacatggtcaaattggacttgggacaattacttggggaggattgagaattatgcgttagagaccgatctgttaaaataagaaggaggaggcttgaaggtaacctgaaattaaactgtggtactgaggatatgcattagttagggttggccaactgccatgataaactaccccaaactttcatgacgtaatacagcaaagcgttctttctcatccagacacaatttgagggtgcacagaaaaggggaatggttctattctgcactgtcatttatggaccccaaattattccatctctggttccaccattcccttagggctatagagtccttgagtagatcctgttgttgctgaaaggattctgttgttgctggcagaggaaacaactgtgtttgacctgcataatggccactttatgtggctcagcctgtaacactgtaatagatagatggaaaggtaaacttaagagatgctatgaaaatggaacttagtgaccaactggatgtagaagttacagaaaagggaagaatatatgtttttagtttggttgagtcactgatggatggttgtgcaatcttttcatgcaaggaatgtggttgtcacaatagatattggaggaaagttgtgagtttgagatgcttcccacagatctccacagggctgactccctaactttctttgaacttgtgttaaaatgtcaccctaaacaaaacagcaacactctcactctgtcttttcttattatcccactttattctcttcatagctcttcccaaatattgttcattttttggtttactggttgtctcttcttacttgaatgaaagctccatgacagcagagactttgttagcattgttcattgctacatccctcagtgcatagaacagcacctggtacatgataggtactcaataaataattgctaggagtgtgaatgaatccaaatggaaatggtcagtggaatgaggctttccagagagtatgggtgacacaagagaagaaatcagtcattgagagaaggaaacagattgggaagtacctagagaaagatgcacttttgagcaaatttttgtttgttatgttagttttcagttgggggagacttggaaaagagtctatatggaggaaggggccaatgatgtggagtaggcaaagagaatgatgtggaccaggtcctgcagaaggtgagaaggaacccagactaccagggaatgaattcacaggacaggagggctatgtcttctactcagggaaaagctacacaatataattcagagcatagaatcaagtgtcaggctgatctgagttggaagccagagtctactacattcttgctatgaaattttgctagaatacttaactgccccgatccttaattttctcaacagcagaaaagggataatgccttcctcatagagttactgcaaggcttaaatgacatgacatgcattaagcaagaatcttgtgatggaatttgttgattatttctgtaatttaattatagatcttttgatttttatctcaaattattactagtgtcataaataaacaagaggccctatctattatatgttttttttgtttcatttgctccaaaaggatttgggatttcatgtcctttggaattttgaataagttttgagggttaacatcaaacttgttgtcaacaagccaaatccggcctgcagagttatttcacttggctataacattatttttttctttttaacttgaaatccttaaatgggacatgcaacaatccatttccaggtctactccctcttgtcttttgcctgggctcttcatatattttcctaatttacttggcctttgtagacaacccatgatctagactgatttctactatgaaatcaatttcatagtaatttctactattgatttctactataaaatatctcatacctttaatgactctcatattgcaaaatccccacagaccactttctgtctttattttattgatcttgcctcaacatttgccactgttgataaacttttgaaactcttttttcctctgttttctgtcaccttccttttttgtctactctttgctgcagctctgtctcctttgcccaccatttaagtgcgataatttgtcagtgtttttattttagctcactgttcttcttgttggctcatgtctgtggctcaacatgttcaaatttggataatagtctttctcttcaaaccattttctcctattgtgttacatatcacaatgaaagcagtcgccagaaatccaagccattcaatcccccaaactgaaaccactttcacatctagaaataataaatattcaacaactggcacagtgtagacattaaataagactggacagtgccctgtacacctcactgttgcttcccagctaaagatcagccctccacactcagttacccaagccagctcctactgcctctgtggtaacatcattttaccatggactattcacatgctaatgtgttttcattttccttgtaggtaaaatctcaaccttgagtggaatagatccttccttttttctgtcctgtgcatcaagctagctacacctctagctgctcccaaggctctcaactttaccatattaaattgtttgcatttccccaggtactacctgctcttaccacatgcccttgcccatgctggtctttcagcaaagagtgctcttctccttcaactccgtttgcatagctactttttactcattcttcaaaattcatttcagatatatgcatatctgaaaggcctgccctaactttcttctctcttagcaacatcgccagtctaggtttggaacccccatgctgcaagtattttaaaagcttgcatttgtaagtcatattttattattgttatagcccaacaaattcttcttgcctgctgcacagaaaaagcaaatacatggaaacatcaggtattatagtagagaaagaatttaatcattgtggggtgtgaagcaagtaggatgggagatatttctcaaattcacttccttgagaactgagaggctggggtttttaaggataatttggtgggcagggggctagggaatgggtgcggctgattggttgggaatgaaatcatagggatgttgaaactatcttcatgtcccgagtcagtttctggctggcaggggtgggtaacaggacctgtggacctgtcgagtcagttctttggtatgggtcatggattcaggtggcatgagttggtctacctgaatgcaaaagtttgaaaatgatctcaaagaccagtcttaggttttacaatagtgatgaatatacaggagcaattgagaaagttacaaatcttgtgacttctggttatatgattcctgagcagtgagcagttatggaaaagcaatctagggaacaatggctggttagtgtttaactatgcctacctcttagcagaattgaggccccactgtagtcttacaaagatggtgtcagtccccagggatcagtttgggaaagggactattatcatccttgcttcaaagttaaactgtaagctaaattcttcctatagttagcttaacctgtgctcaggcatgagcaagggcagttagcttgcgaggtgaagagcaagatggagtcagtttatgttagatttctctcactgttacaattttttttaaaggcagttcatgtcttatctatcaatggaatagcttgacctagaatgttcattgcaatctggcaaagtactttcctgtggaagaaacacacccataaaatgagaaggtatggaggaggaaagtattgtaaatcaacataaaattaacattcattgacagaaggaaaggaagtaacagctgggtaaacaaacagctgctcagagacagaaaaatgacagtaagcagccatgaacatggaaaatggtccccaaatattagaaaagcaagtaaataatatgaggaaatgaattaacccattggaaaattgctgaagcatttgaagaagaagtaaataaaggaagtgttcaaattaaagttattatacagagaaaaagtagaacaaatattgtgtgtaaaagaagtggacttttaaaacgcaatatggtcaggagataaattaacttgaaaatttatatgagttattttttataaatgtgttttatactgcacagacaacattataagaatattaaaaaaatcaaaagaataaaagtacgccataatcctcacttatcattgtgttgaaaatagtaagttagggccgggtgcagtggctcatgcctgtaatcccagtactttgggaggccgaggtgcgtggatcacctgtggtcaggagttcgagatcagcctggccaacttggcgaaaccctgtctctactaaaaatacaaaattagctgggcatggtggcaggcacctgaagtcccagctactcgggaggctgatgcaggagaatcacttgcacccaggaggtggaggttgcagtgaacctacattgcaccactgcactccagtctgggcgacagagtgagcgagacgccatctcaaaaaaaagaaaatagtaaattagaaaatcacaactggtttactttgcatttataggattactaaagaccctaaccttttaaaaggacatatttaataacacaagtaacatacatatattcaccttctaaaaaattaaaagcattacagataaggctttgaccttgtgaaatacatatttgatcttcaacctatttcatcacatacaacccctaaaatccttagaatgtccacaaggtgatgtattttgtatgctaatgattagccaatcgttagcatgcaatcatggttgacagcccctaggtagcttcaggctgggagctgatcacaggaaagaccaaggcatgattagaggattgagacttttagccccaccccccagtctccagggaggagagaggggctgaaggttgaggtgatcaccagtggccagcggttcaatcaatcatggctatgtaatgaagcttccataaaaacctaacaggacagggtttggagagcttctggatagctgaacatgggaaagttcctggagggttgcagattccttcctccatacattgccctatgcatctctccctctgtatcctttgtaatattaaaaggaaaactttagacaaattaaatttaacagagtttaattgagcaaagactcatgaatcaggcagcccctagaatcagaagtggttcagagaaactccaagctgctgtgttttctgagagaatttatggacagaaaaaagaaaatgacacgcagaaagtggcactgaggtacagaaacagcacgattggttacagcttggtgtttgtcttacttgaacacagctggaacggttggccacctttggctgaaacttggtgattggtacaagagtaggttatggtctttttacacatcctgttaagttacagttcactgtgtatagagaaatctttaggctgaacctaaaatatgtgaagaggcagctttagactaaacttaatttaacagtaatctttataataaaccagtaaatgtgaacgtttgcctgagatttgtgagttactgtagcaaattaatccaacatgaagaagggattgcaggaacctcagcgtgcagccagctggtcagaagttctggaggcccagacttgcaactgatgtctaaggggttgaagggtgtcttgtggggtctgacgctatctctaggtagatagtgttggaattgaagtggaggacccccagctggtgtctgctgtaaaactgattgcttgtttgatgtgtgggggaaaaaacccacatataggtcacagaatttttctgtgttgattagtgttgagtgagagaacagaaaaatcactttgaatttgttttttctacacagagacccttaccactacctccataccactgctatccctggaggtaaccattttttttcagctttatgtgtatcctttcaacattttcccatgcaccacatatgtatatgtaactatagaaaatttctatctttatcttttatgatatgtatatatgataatccactatacaaactgcagtcgtaattctgcaacttcttcatgtttctatataacatttgtcttggaaatatttccatttcaatgtaaattagagttatgtcatttaaaaaaattgccatgtatcataatatggatataacataatttatttggcattctattagtgatggcatttaggtggtttctaatttcctgcatcctccagcagacattcatggatatttacttagtgccacgtgccaggcacccttcctggtttggaggatttaatagtaaacaaaataatacttcttatgggcatgtaagaggagacaaatataaatgaagacatgtatatgtaataaaatattatgttgtatgatagaagaaatacaacagagacagtaaagatgtatattaaaatatatctgaggaagaaaatataaaaagaatacaacaaagatgttgtaaaaaaacatacagaaagaaaacaaagatgagagagtaggtggcagtaaaggcttctatgaggagctttcatctgagccaagacctaaaagaagtgatggatggtgccctacaaatatcaaaggcaccagctgagaactggaaatgcagggtcaataggtgtgcatatttgaaatgcaaaatcactttccaagctgtcagtggcaattcatactcccatttgaagcataaaagtgtactgtttctcacagatttctttgttattatcaatttccttaatttgcaccagtcagatgtgtggaagactgttagtttgctatagttttgttataacttgaatgcgagtgaggtcgtgcttattttaatatgcatattggccctttgaatttcctcatctcggatttggcagttctacatcgttgttcatttacccattgtgatatttgcatgtttgttattaatttttattgtttgtgttctggatactactgttttgttatgttgtgctatttgctgtatttgttattgatttttatcatttgtatccttgatactaatcccttgtcatgtatgttgtaaatattttcatcccaatctgctgcttgtctctttaaaaatatgtttgtagaagactttcattttaaagcagtcatgtttaacaattttttatggattttgctaaggaattgcctcatgtttacattgtcttttgtgtcctaaaggtcttaaagatattttctcatattttcttttaattttatggtatatgattattccatctggagcttaatttttgggacaatgtgaggtaggaatttatcttattttctattactggctagccagtagacccagtacaatgtatggaatagtagatttttatgaattggtttgaaatattacttttggcataaaggaaatctccaaaaatgcttaggtacatttttagactcattctcctgtttcatcatacatggtttattcttgtgtgagttccatagtgtttttattactatagttttataatcagttttgacattggtaagttaagttttctctgttattcttttgtccaaaattactgtcagtatacatactaatttatacctctcatatgatgtttagaattaccttatcaaattttactttaaaataatgttgggatttttgttgagattgcatttgaacctacaaatttatctggggaggcatctttcaatattccttattgtccacataaaaatgttgtatttatttttaggcttatttcaaagtgtttgggggctttgttgctattaacaatgaaatttttgttttattgtattattttaatatatgattcctgctgtatagggaagctaagactctattggttccaataaatatttttttcagttgattattttgtatattctagataggtaattataacatcttcaaatattgacagatttccacttatatacataattgaaatatgtttaaaaaatttttctaatgcagtgtgtgtgtatttttatgttgttgacttctcatttttttacattttcgatcagacagtgtgacccgtatgatgataattgttttattattgattttgcttctttttttttttttttttgtgagacagacactgtcacccaggctggagtgcagtggcacgattttggctcactgcaacctccacctcctgggttcaagcaattcttctgcctcagcctcctgagctgagattacaggcacctgccaccacacccagctaatttttgtatttttagtagagatggggtttcgctatattggccaggctggtctcgaactcctgacctcgtgatctgtccacattggcctcccaaagtgctgggattacaggcgtgagccaccgcgcctggctagaaattttctattttatgtgttttaaataatatattttaaaattgaaaactcattatgattgtggacttgtgaatttctatctgtagtttttattggtttatgctatatatttttcaaaagctatcatgttaggtatttaaagtttcttgactattattattttggtagtcttgtgaacttggtcaatataaattgttttatcttttttataattttaaacattaaatttctgtttttaccaaaataatacacatacgtggaaaaattaacttgtatgacagagctcaaactgaaaagcagcaatctcctgtctcagaccgccccccactcccccaagttatgttccaagaaatctatacctttcaacttcctcagctgattttttttgtcacatgtgaaaacaacatgcttaattacagttcttaaaatttcaacttgtctattgatttcttatggaaaaatatactgagttctcttcatgtgctcctcacagcacggctgtctaccctatacacttatactttcttgacctctcagtccagacatatcgcaatcaaatcaatagtcagtgtctacctaaatgtagttcacatctgagataaaaagtttattacaggaattgatagcctgtccacatgtaaattttctcccagagtgcataaagcccttccatgcagcagtcgcgaatccatctctggaatcctttgaaagtgcagctcttccatccctgctgcacattggcctatctgggacactgtttctgttgagacattcatctggagctgtatttttctcttacttgaacctgattgatggctttctaggcctactgtatagctatttttctggagctttcctttacccaaatccatcatttgttatattttttaaattgccagcagcactttcttattacctaaatgccttttctttttatatcatcctagcccagatgtggtagccatgaacatgaataaacaaactaattatagatgtttaagaggtttcctctgccccttgaatgattttggtttcctctgagtccctctgctctgactcttatgttggacactatccatcagtgtcttctgagcttggctgtgtgttcttgtttggtgactggaagctctgtgcagagactgcacctgtcaacaggtgggttttactctgggttgagatggtggcaacgttgctttctcttgggcagttcccaaatgttactgcttgtaggtcttctccttgggctactcagtgtcagtattccacttgggaactacaagcctgactgctgatattgtatgagtcgagaattccatttccctgggctgagccagctttctggacacctacccactcttcctacctggaaactgacgcgtccttccacatacacggtgataattgatcggtgcaggattttagggttcagcccacctgggtgtctctgctaccccataatctgaacaataaccttgctgattgctgttagacaccactttccctagtatctcctgcctccaggtatagggcattgctactgctgcctttcagaggaatgctcaacaagttccttcatgctctggtttcctttggtaaactgtctgtttttttgaggtaacctagattcaggatccactgaggtttgctttcttttttattttcagaatggagatagatttttaaaaacttattttctcctatttctagagatttgtcataggaggtgagagctttattcaccctttattgtgttcctttctattctattaatattcctttttgtattcaatttgcgtcttgtaactgtaactgaatgctttaacatttttaattgaaattctttcaagattaattgtccattttcatatcaatgtatccatatattcagactctacaatttatcgataccaatttatgtttgttatatttgctgtaaatatttctcagagtaattccctttttactttagttatcttattcttcatggtaatgaaattttacaacatgacataatcaattttgttaatattttcctgtgttgaaatatattttgcaaatgtctgataagttcatgattttttttttagtttttgtaacatagattttatttatttatttattgagatggttgcccaggctggtctcgaactcctggcctcaagtgatcctcccacctcagctgcctaaagtgctaggattgtagacttgagtcactgtgccagctagattttaaatatctatcttacttatcttaaaattatttggtaattgtctcgtgaagtatgaatctgttccctctcagatttccaaattgttagctaactatctcaatattgtttattaagtaatttaaaaaatcttattggttttgtccccattatcatgtattcaattcctttataaaatgtgctatacttttgtcctttccactctgtttttgtttttccttttatgctcatattgattataaattaatcatttctattttaataattcatgggctgatcttcatttttatttttaattcataggctggtctgatttcttttttatttttaaaaattactgtttagtagttttttattcatatagtacacaaatattctgagctacgttataaaaattaaaggatgaatagaacttgtcctttgttttcaaggagtacatagtcttagagagtatgagcaattattattcaggaattcaaagaagacttttgaaagcttaagttggaaggaaggaataagcctaataaaggaaagcttaagttgagttttgatttataggcacaacttcaccagggcaatgactagatcagcaaaaatgaatatatgcaataaaaattgtggacaggtacacacacagggatggctggagcatagggtgaggacatgaggagtagctgagtatgaggctggagagacaaactggagcaccactcttttctaattccagcttaattttgtaataatgtaataaaattcaataccaaccccattaaactcttgatcagggtaatattaaacatattcagtataccataacaattattgaattgaatctaattcttaaataataatgtcatttgtcacagaatgggagaggtaaaaataataactgtcaataaaattaggactatagtaaattcaagctgtgtgttccttttcaaagtgaaaacacagaaagggaaaactactcccttcaagactaatcagttggctttaagacaggaaacacaaaatcaatcatcttgactttattgaagcagtgtgtaattctctgctagtatgtagtccacagagacagggatcagttccatcagccagcagggccctgtgaaatgggagccattctgtacaggaataaggaggaatggaaggaagcaaggaaagcaatagaggtatcctaactgctctagaaggttgatggtgaaatgacagaatgagaatgtagcactgggaacggtatgagcatattaagaagagttttttagttctaacctgcttgttgtaatcatttcacaatgtatgtgcatatcaaaacaccacattacataccttaaatatacacgatttttatttgtaaaatataccttagtagcgttgaaggggaaagttctaaccgtatttagaagacagaggaaataattcagttgagatggagaggttgattttttttttgaagaggagagatccactttggaacatgagttctttaggatatgtgaaacagcttgtctcaagatacagaggggaagatggagcacttcttagaatggcagcaaggatgtgattagaagatgtaaagaaaaaggtggtgagagatggatgcagaaagccagacagcttacactgatgctttgatcttctaaataagtatgtcccacctgtgtcagattacccaggagtactaggtaaaaattcagcccctggatcactctcatcagaacccaggaagctgtgatattagtgaactctctgggttattctaactaaagtgtgagaaccaatggctcaaatggagtagcaggttatctacacagtgtgtcgatatgattgggaaagcattagtgccacccatattagaagatatgggtgggcgatggaagaaaggaattgctaagcagagcccatttggaagttgggaagcaggaatttgtattggagaggctggcccagctccagatatggttgaatgtgcttccatggcttcttctaagttaaagtgaatctacctaaagaccctgttattacttctgtatcaggacccagggaaaaattgataaagcaggctactggatcaagaaagcaggctactggatcaaggacatgaagacaacttgagagatttcccttccttctggccttgagaaacatacctttctgggcaggcagagtcaataatgctgattgctacatacaatcctgtggatttgtgtattcagaactttaatttcacataattatgatgagcctgccaacatgtcaggccagactttcctctgctagttgtggctcagtttattctttgatgctgctgctccacctgcatataacccaagatgggcagctcccatggtgaaaggaattaaaagttgcaaggccctaatctaggtcattgcttttctctctctctacccttctctctccctctctttctctctctctcttttttttaacttgagtgtattagcagcctcttacctggtctccaggctaccagcctcttccttccaaggtaatcttctattctattagagtaccttttttttacacagactgacagttgccataagtgctgtaagcagtcactgctgtgaagatttcctgtcaccacagagtgatgttctaacaaacaaaacagatataagacgtttttcgaagaatgccttgtcttcagccactgctgccgccattagcacctcctacattctagggacagggaatccttgtcattgcctcagtatattgcgtactcttgcctgtaaccaaagtatcccttcgagtttagttgctgttctttctgttgtttccctataagaagtgtatttaaatgttattcccactctgtagctttcttggaccacactccctctttccaggcagaattatttttttcatctgtattccatagtactttatacaagtatcaacattgtatttagaacattctattgtacttatttgtatctttgtttctacaactgcactagaatttcatgtaatccaaactgaaagaacataggaaagtagagttctttggagcaagcaatatgggcaactccctgcatcattttgtaatagtaacaagctttcctttttccatgtaatattatagttgtagcattgatgaatctgaatatttatagaatcatagaatttcagtggggagaggtatcttagaagtgattcctttgatttgcagatgaagaaaccagtcttgtggttatgttagaccacctaagtacctttcatcaaaatcccagccaacaaccttcaggaatttatgagaattaaaccgttttccatttcaggcaaaaacgttctgggagagaacaaatgtataatgcattttagtttagagggagccccattaacaaatgttaactgcgttttaagaagttggggtcagggaaaaagtcaggctatttgatgagagataattgataagttcaaggaggattttaaatacaaataaagtgtttttcatgtgtttcattgagatgatttgaggtatcagggccaccagaagacaacagagtgggttttggtgagtttctttttctctaggtttaattgaacagttttttttttcttcaataggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataattgtgatttgttgagccacgtctatattaactatagctcccctctatttttaaaattttacataagaattgcttcttcctcttttgtcaagtccacagagacaatgtgaagcattattgaatttagactgtgttgcttcatagtctggataacaggagccactttccttcctcagaatttaggacataaacccaattttaggtctgcattatgtaagcctgtttgcattgtcatttttattttagtgcaaaagactaccaatatgagtgaattatttgtttgtaaattggcataattgtcttcataatttaatgttcagaaatgcagtaaagcacgttgatgaaaagcttagtctctgtggaagacagaccagaagacaaatcccttttctatctactgtggcatattcactgcaaggtaaaggacatgtatgcatacatgcaagaatgaattgagcgaaactttgaatatgtttcctcttttgagctattgttatttagtagttacctaaaaaagaatacatttttactagtataccattaaaaatgtaaaaggcttaacatgtatgcatacatgtagacacacatacacacacacaaagttaaacaaagctcattactgtgcaactatgaaagctgaactcatatgacctggtatggcaaaaatttgtaaccagtgttggagaatcacaaatgtgttatgcactatccattacatgttgatataagacaaccgagctcactggttgctgcacataatacccatagcagcacaagatgcaagtcttacccccaaatgcttacccggaatgagcagaattgtcttactcatcctgattttacccaaaatctcatgaatgggcttgctgttgagcgtggtcacacaaggtatagtttgtacaagtaaagaaatgtgaattagtagctatttatttccttagtagcaggtaggactacttagcttgttacaacagctttgatacacagtaagaaaactctactgacagattacaagcagccaaatgtgtttacatttcagagaagggtaagggaagcctctcgttgtcttcatactttggaatgtcttaagctaaaatgtgacactagagttcaatttcttttttattttaaatgtcactaaattgtaggtaaactgtaccaaaaagttctagtttaattttaacagtaaaaactcagcataccatgttaccacgtaaacaataatggctggtattttctgtgggttaatttaacatgacataaacataggaaagcccttggcaaaattctacatcattgaagtagaccatttctaaatgcaattaaatagtgaggttattataaaaattagaatttaaaatatgacttgttgatagtgcagattataatgttacttagaaagttaagaattcgagagtaatgatgctattggagaactggtttgctatacggcagcaaaaacataatgagaatgtaccatgaagaaattgtgttaaatattcactttgagtgaaactttaaatatgtttcctcttttgagctactgttatttagcagttacctaaaaaagaatacatttttactagtctaccattaaaaatataaaaggcttaacaaaaacgcatataaaagttaataaaatgttactcagattagtactttaattgttaaaatgtaattaatgagctccatagagcccatacatcacagttccattgaaaatatcatctggactagaatctcttaaacccaggaagtggaggttgcagtgagccaagatggtgccactgcactccagcctgggtgacagggcaagaccctgtctcaaaaaaaaaaaaaaagaaaagaaaaagaaagaaaatattatgtggaaatttttcatctttttatgatgcctgggatagatttatgcagtagatttatatataatgtttagtttacaaacttgtgaaactatttcatgtgggttctgaaaggcaaaacagaaatggccagtgctgg

SEQ ID NO: 13873 - DNA, 106450 bp, Human
tcatggattggaaggcaatattgttaaaatgtctatattaccaaaagtgatatacaggttcaatggaatccctattattaataaaatcccagtggcattttattgcagaaatagaaaaatttgtactaaaatttattttagaattaggaaaattcatactaaagtttcaaaggacagcaaataatcagaacaattttgaaaaagaacaaagttgtagaactcacacttaccaatttcaaaacatataaagccacaataatcaaagtgtggtattaacataacaacaaatataaaccagtggaatagaagagatgacccagaaataaaccctcatttgtatcatcaaacaatgttcaacaaggatgtcaaaaccactcaatgaggaaaaacaccaccattcaacaaatagtgctggaaaactagatattcgcttgcaaaagaatggtgcactgtgtcttctactatatacaaaaattaactcaaaatgaataaaaagtcaaaatgtaagacccccaaactctaaagctcctagaagaaactacatggaaaaacctttatgacattggaattcgcaatgttttctctcaggtatgaaaactaaagaacaggcaacaaaagcaaaaataaacaaatgagactacatcaaactttaacccttttgtacatcaaaggacacaatcaacagagtgaaagggcaccctacagcatgggagacaatattttcaaatcatacatctgataaggagttgatatccagaatacataaaaactcttacaacacaacaacaaaatcaaataacccaatttttaaaattggcaaagatttcgaatagacattcaaatatctatttatctccaaagatgatatacaaatggccaacaagcatttgagaagatggccaacatcactaatcactagggaaatgcaaatcaaaatcacaatgagatactaactcatacccattagagtggctactatcagaacaacagaaaacaacatgcattggtgagaatgtcgataaattgaaaccttgtgcactgttggtgggattgtaaaatagtccaactgctatggaaaacaatatggaggtccctcaaaaattaaaagtagagctaccatattatccagcaattcaacttctaaccatatatctaaaaaaattgaaagcagagtcctgaagagatatttgcacacccatgttcacacagcattatccacaaagctgagaggcagaagaaatgtaaatgttcatcaaatgacaaatggataaatgaaatgtggtacatacatacagtggaatattaatcaaccttaaaaggaaattctgatacacacactacaacattgataaatcttgagaaaattatgctaagtgaaataatccagtcataaaaacacaaatactatatgatacccctagtcaaattcatagaaacagtagaataattgttactagggttgggaggagggggaaaggagtagttgttgtttgataggtacagagtttcagttttacaagataaaaaagttctgaagatctgtttcacaacaatgtaaatatacttaacgctactaaactgtatatttaagaatggtaagctagtaaatttttttgtttttcaccgtgaaaaaaagacaatttcataaagtatactcagtagaattttaaaaatatttcatatacgtttttctctttgtagattctccagacctttctctcagtatctacacattttaacaatagttctaattattattcagaatactagtagtaattaatagaaccaaaatagatatgaagccagatctgtataactccaaatctgtgcacattttaccatacaaacgtaactttttctttgcagcttagttttacgttgtttttctaacacatgaactaaaggaaaaggagaatgttcatctgagaaaatcttcaaaagatttgtatttttacttaaggaaaaggaaggaaagtaattaatcttctcttccatagaagaccaggaagacgttctgtgaggaagacataggtggaaatacggaaagcagaaaagacaacttcggggtggccgggagataacagaaggtaatcagaaaatgagaaattataagaatagttctgactctcaactccttacaaacagcccacaactcattattctctggctccctaacgagtctcacctttctattacctccatctaagacactgtctctgccaggctactggagctgccaccatgacttatttctgaagaaatccctatttctctgtctggcagttgggaagtctgggagagttattcagacctcagtagagacagaaaagtattccaagtataatatctaaatgcatattctcaaacaaacactatcattcttagaaattaaattccatagtattaaaaatactgccttatacattagatggcttatgggattgctgttgatgccctgcctaggtcccctttactatgagggggcaccaacctaccgtgagctggctgcaaaaaggatacagctccacttttctcctagtactgttgtgagctgacaggaattgccttgtataaaaatgcctgaacagcatggccaacatggcgaaaccccgtctctactaaaatacaaaaattagccgggcatggtggtgggtacctgtaatcccggatacttgggaggctgaggcaggagaatcgcttgaacccaggagggggaggttgccgtgagctgagattgagccactgcactccagcctgggcgacacagcgagactccgttgaggaagggaggaagggagggaggaaggaaaagagggagggaggaagagaggaagggaggaagggagggagggaggtagggagggagggagggaggaaggaagggacgaaggaaggaagggacgaaggaaggaagggacgaaggaaggaagggacgaaggaagagaaggaagcctgagaagttataagcatagcttgcggttgatgactcaataattcagggctacaaaagctcaacccctttgcctcaatttgggataatactgtggtattattttatgctctagagcttctcatgtgatgggtgaagccagactttatccgaagcctattttcgtttggccttcccctctgccctatcctgctgtcggtagtttttcacagctttttcccatgtcagcactccctcaataaacaacttgcaaaaaataccctggtatcagactctcttccagggaaccaaacctaagacatggagaaaatagatttctaaatctaattgccttggaatctaattggtatataggttttgttattttttgtgtgtgtgtgatggactcttgctcttttgcccaggctggagtgcagtggcgtgatctcggctcactgcaaactccacctcccgggttcacgccattctcctgcctcagcctcccaagtagttgggactacaggcgcccgccaccacgctcgttttttttgttctgtttgtttgtttgtttttgtattttcagtagagacggggtttcaccgtgttagccaggatggtctcaatctcctgacctcgtgatccgcccaccttggcctcccgaagtgctgggattacaggcgtgagccaccgtgctcggccagtatataggtgtttttatagaaaaatgcatttcaaattctaacaaccaatctattaaaacatttttgaaaataagcctgtgtatgcatctaaaactaagaaacattttttttcaggttttattattaaatagcccaggtaaacacatatgcagagaaataactaaagtctccttcttccaggtaatagcagactaaataactcagaactatcctcctgctgaaggcaataggaagtctggcaaagtattttttaattctgcttaaaaatgtcagagaactaataaaatagtaaagaattatgagacaagatccatggaaagatggaggcttaaggaggtgagctagaatttggagggacttttctcctgggagaaattcaccaactctatccaggggctcccaaattaagtgcacttttaatagcctctgggagataagggttcagataattaactccagagcctgctgaaaagaaaaggatttatgtgaacattttgggagtaaggatgaaccaaaaataggccctcctagagatggtagcttagctaccaatattttctcgttttttgttgacttttatatgaagttcagaggtacacatgcaggtttgttacgaaggtaaaattgtgtcatggaggtttgttgtacagattattttatcacccaggcattaagcctagtaccccttagttatttttcctgatcctctccctcctcccatctcccaccctcaaaagggccctagtgtgtgttgttcacctctatgtatccacgtgttctcatcagttagctccatttataagtgaaaacatgcagtatttggttttctgttcctgtgtcagtttgctaagaataatggcctccagctccatccatgtccttgcaaaggaaatgatctcattcttttttatggctgcatagtattccatggtgtatatgtacaacattttcattatcaagtctgtcgttgatgggcatctaggctgattccatgtctttgctattgcgaataatgctgcaatgaacaaaaatgggcatatgtcttagtaatcgaatgatttacattcctttgggtatatacccagtaatgagattgctgggtcaaatggtatttctgtttttaggtctttaaggaattgccacactgtctccaccatggttgaactaatttacactcacatcaacagtgtataagcattcgtttttctccacaacttggccagcatctgttatttttttttttactttttaatagccattttaactggtgtgagatggtttctcattgtggttttcatttgcatttctctaataatcggtgatgttgagctttttttcatatgattgttggtcacacgtatgtcttcttttgagaagcatctgttcatgtcctttgcccactttttaatggggttgtctgttttttctcaaatttgttaagttccttatacatgctggatattagactctcatcagatgtatagtttgcaatttttttccattctgtaggttttctgttcacttgcttgatagtttcttttgctatgcagaaactctgtagtttaattagattccatttgtcaattttttcttttgctgcaattgctttgggggtctttgacatgaaatccttgcctgttcctgtgtcctgaatggtatcctatgttgtcttccagggattttatagtttggggttttacgtataagtcttttatccatcttgagttaatttttttatatggtgtaagaaaggggtctggtttcaagtcttctgcatatgactagccagttatcccagcaccatttattgaatagggaatcctttccctgcttctcatttttcttaggtttgtcgaagatcagatagttgtgggcatgtggctttatttctgggttctctattctgttccattggtctgtgtgtctatttttgtaccaaacagattcacagctgaattctactagatatacaaagaggagctggtccctaccatttgtattgaaactattccaaaaaattgaggaggagggactcctgcctaactcattctatgaggccagcatcatcttgacaccaaaatctcacagatgcaacaaaaaatgcaaacttcaggccaatatccttgatgaatcaatgcaaaaatcctcaacaaaatactggcaaactgaatccagcagtacatcaaaaagcttatccaccacaataaagtaggctttgtccttgagatgcaagttgggtcaacatacacaaatcaataaatgtgattcatcacataaacagaactaaagacaaaaatcacatgattatctcaatagatacagagaaggcttttgctaaaatccaacaccccttcatgttaaaactctcaataaactaggtgttgaaggaacacacctcaaaataataagagccatctctatgacaaaccaacagccaacatcatactgaatgggcaaaagctggaagcattttccttgaaaaccagcataagacaaagatgccctctctcatcactcccattcaacatagcattggaagtcctggccagagcaatcaggcaagaaaaagaaataaagggcatccaaataggaagagagaaagtcaaactattcctgtatctagcaaacctcatagtctcagcccaaaagcttcttaagctgataagcgacttcagcaaagtctcaggatacaaaatcagtgtgcaaaaatcactagcagtcctatacaccaacaagagacaggctgagatccaaatcagacacataatcccattcacaactgccacaaaaagaataaaatgcctaggaatacagctaactaaagaggtgaagtatctctataaggacaactataaaacactgctcaacgaaatcagagatgacacaaactgaaaaacattctgtgttcatgaatagagagaatcaatatcataaaaatggccatattgtccaaaacaatttatagattcaatgctatgcctattaaactaccatttgggttctttacaaaactagaagaaaactattttaaaattcacatgaaacaaaaaatgatcttgaatggtcaagataatcctaagcaaaaagaacaaaactggaggcatcatgctacctgacttcaaactatactacagaattacagtaaccaaaacagcatggtactggtacaatactttcaatatttcaaattgaactaatataatcctacattgctagtaaccctagtcatctaccagaaataaaagtaagtccttcctggagtaaaataatttcatcctaggcctccagttatttctataagtaatttacaaggtatctcagtcagtttgggctccattcttatgacctaattacctcccaaaggcccaccttttattatcatccattatggattacagtttcaacacatgaattttgggaaaaaatatgcagtttataatgcaaagtctgacatacaatatagtaatcagacccagcagtagataaaatgacatgaacaaatcagcaggaacaacagacagtagagatgaacccacaaaaactccacacagcggagttagtagagaggcactttaaaataacaatagtcattatgttcaagaaaatgacaaaaatttcagcaacatattggaaatggaaatatataatcacagattagaactcaatggataacatgatgaaagggtatagcagcaggtaaaaagtggtgaggagagaattactgaattgaaggagagatcagaagaaaaaaatccataatgaaaccacaaaaaaatggggggaaaacctagaagagaaggtagaagacacagaggatagagtaagaatctaataagtaacaagacatggagtctcacagagacaggaaagagagaaaatggtcaaaagcaatatttaaagagataataactaagaatatctcaatgtgaataaaaccacagattctaaaatctcttataaaaacccagagttaactaatcaatttcagctttctaaggataaaattttttaaatttaagcatacttttagaaatgttatctatagaacagaaataatagtcataccaccaggattactgtaagatcatatacggtagcatatttggacactatatagaaattaattgtgatctcaagtgttttgtgttttaatataattctaaattaattaatttactaagagttaaacatcatgtaaaagtcttgacacaataataagtcttaaaaatgttaggtaaaaatactccacaaaattagtgggtttaactcatataataaacactcatcacaatatattagttataatttattaattgttctccctcttagtctttatagtctttgtctgtgatatttattaatcttaagaagctgttggaatactctggaataactggagccaagtaggatttttctggcatcaaggaaggaacatggaagaaaatcagcagactaaatttacaaccaaaattcaatagtccctagatgattgtgatatgagatcaatattcatttatatgcacgtgaagataaatatcatgaaagttccagtatttatatgatgcccaaataagtctttttttaaaaaacccatatccgattttcaaaaactgccattagataattatagaaagttatagtgccagaaagttaggaaagcagaaaacttgaaactagctcataaacatttcaagaacctaatgagggttattttcacctacagatattgatcaaactccagaagaggacagagtagtcagccaaatttactatcctcacatgacctttcttggttgtttatcttttttgtactctgctgaatttcaaatcaagtgtctcatgttaaagcagaagaaaattttactaagtgaattaaaggaactggcttccagagccaagtgagcaaggaagcaccaaaatgatttttcccccccgacacattaactttcaaaattttaactgtaggtagttggaattagggattcttcaaccgataaaaaatagtctacctgtactccactatcatagtagcttccactcagtacaatactagatgattttcttttcacgttaaatttcattacaatgttttcagcaggagccaagtttccaagaatgaaacacaatcataggtaaacaattataaccatataaaattaacaatagatttaaattcgtgtcaataaattttgagttaatttgcttactaaatatgtatttagtgatcacttacagaaagacaagcacagagatagaaagatgaaaagatacaaatctaacttgaaggaggttatactttaggacatttatgcaatccacaattacagaattgttccataactgctgagatgcacaacacttatataagatattttggaactacatgcagttgtttctaagtattgttgggaaaattggggaaaacttcagagaggtgcgtcaaagagctacgagagagagaagcatcaaaaggaccaggcattctagtctacaagaataacttatgcaattgacttacaacacgcaaaaaaaaaaaagtggatactagaaattacaatattcatgttgctgaagcatgaaaaaaaggaaaagtagaaaattaggttatttagattggtatggaccagataataaacgaaccaagatttcattcaataggctgattgttttcaaaagaacccaatggattttcaagcacccctgcagaatccaaagagagacaaatagatgaagatccaggccgtttctcttccagtagactgacatcattttatccatttattttggggattcaggcaatattttattgaaaatcactgttataagcaatgagagccaccagggaatgctagcgaggttttcccaagagctgaattcatcagaatgtgtttcacagcattagtttcaaacattttcaatatatttccattttcaaagccatattgtctatttttaaaagacaaggagatatgaaagtaacatagaggtaggcatacaaaagatgactgagggcaccaattgggttctaataaacagtattttttgctgttttggatcatctttaagcagatgacaacatactatatatagcatgcataatcctgttcctcttgaagttaccaggtcttgtttgacagtctcagatctgtcttttaatgaacaatattgttacatcttatagcccttcttaaatatacttcaacatatatgaataataaataaattactggtagcagagctccccaccttaggaaatatgaatccataattctgaattctaacattacacaaaactaatttgtgtgacctttaatgaaaactgaattcttgtttacataatggagaattcattatgtaggagtagtccaggaattaataattaagcagagccaaaaaggcgagaaatagcaaatgcttatcttcagatctctacaccataaaatctctatttggtaaaatctaattggtatgaaaatgactctttaaaccttccaaagtaattagagcattttcaaaaatgttttcttataaaatatggttcccaaaatagttcatactggttattttgagaaggtgcgattttttaaaaatctacatataaaactcagaattcattctgccattattgatgaaaacatggaaacaagaacaattgcaccatatggaagactgtctagacaagaatgttaggggttatgactgaaataatttattgtttgctgagagccaacagtatgcttagcattagacaacacatcaaaagaataggactgtagccattgaactcacaatttaagccagacacacaaacattgaaataataaatcataacagctaagaaaattgtgtgaatttcacaggaatgaatttgggtgttgatttactttattagcaataaaaaattaagagatgccagaaataatcatcataaagattgtcaatgcgtgttattaatctagccccagaattagctacctgactgaattttaaaaagcaaatttgtgacatttaacaatcatgagaatgagtattttttgcagcagcatttataaaacattttatcacatgctgatgttatgaaaagcaaattacgcttaatgttcataccttctttgtgtgcatacatttactatcacccattttttcattctttcttgccttcatgatcactggtctttcaataaataaaaagagtaagccagttagattaattttctgttttttatttaagggcacatttttatatgcaatcatatggatgtaaatgtcacccatgctcaagaaacttcaaatatttttattgttgtcacccttccaaagagtgctaaaagtattaaacaatagtcagctttgagattagaaacctatgctagggtttaattcataaatattctgtgttacactgctgtggaaattaggtggttttagatggtggtttttaggctttgactaacgtaacatctccggacctttgttcctttacctaaaatatgggtaatacacagagttttataagaattaaatatgggaaatctataaaacaggtggccttggtaaaaataacagtgagcaagtatctattatttaaataacataataatgtttctgcatgtatgagtttatcatgctagaaaaatataacaaaaaccagagctaacagaaacagaattatttacagtaaaaccccaaggaaaggaaagtatttgctttacgtttttggagaaataaaaggttaagaattaggggagaaatctccaagagacacaattgtttcatttaagaacaattctatataaagttcatagctgtttaacaggagtgaatgcaagtttaaggttagtgctttgaaagggaattgttgaaacccatgagcgtgaagtaacatttatgtagataacggcaggatgtccaaccaagaagacccacgtgtgtgcccagagaatgtaatacagatacctacatatagttagaataagatcctataagatcacattctataaaatgtgctgcttagctggttttacttaccaatggccttagtatcaagactaaggtcaaaagtagggtacacattgtccagacacacagaataatccctgcacaggttgtttaatactggagttaatgtagattacaaggggatttgtctagattctatttatttcattccacaaatacttcttgaaaacttgttatgtgccagggattcataggcaccgggaatacaaaagaaacagagtaggtgaaacaataaaaacaaataagacaaacaaagacttttattatgcttaccttctattcagagaacacagaaaatacacatacaagtgagtaagtctcctaatatactcaaaggtggtgtgaggtatggaatacaaagtagggaagggggagggaatgagctggagaaatgaaggatgcaactctaaagatctagaccagaaaagacctcactgtgaatatgatattgaaatcaaatatctgaagaagcagaatcttaaactagcaatccatgcatatgtccatggaacaaacatgccaagaagagggaagagcaagttcaaattgactagaacagtgcctggcatagagcaagtatctccaatatttcttcaatgaaaaggaaaattgtgttgggctaagcaagatgagttttggggaatgacaagaggaggagagtcattcttttcttcttttggtgatgggacactcaacaaacaacagaggagcagatgcatcttccagagaggtgatctggttctgcaatgccagatgccaccatgaccactgaaagccactgtggcatttacttgggatggggcatctgatcccttggtcctgtcctgcccactcaacgtaactttgactttgttctcttcagttactaaatccatggctcagcaatgaacttcctactcccagcaactctaagaggctgctcctgaggtgtctcccagcccatgagctctgatgcagtgcattcctgccaggaacttcatttcagcctcaggtgcaggtgcaggtaccacaacttacatctctttacatgaccagctctacagagtccacagtaatggcactgtcattttataatgacaattggcacaaatcagttagtctacactggacaaatataaggaaaaatatagcacttatttttcctatttttcatattatcaagcaacagtcataaagcagtcaattaagttaattgaattggaataaggagaaaattgtttataattacctagaaactcaccttctatatttcacaaggaagagaacgcaattcagagagtctcaacagtttatggcatgcatgttacaaaagtgtatctcttctatgtacatttcatgagttatagttcatttacattggctcacataaacattcaagtctctaaaattgagtagtgtgaacagtgcccaggttaaaagtaagactggaaagaatttgctaatatatacaactataataatttgcgaggctgtaatgagctgtgggttagcccgtcatttattcctgcatctcaccatgatcctttcctgcagctgttctgcaaacatccattccttcccttccctgggacagatctcagcgacgaaaactctaagtctctaatttattgaatgttcactctatgctaggccctgaaggaagggtgccacatacagtgcctcttttaaaatcaccaataacctgggaaagaaggtaatcttattatccctgttttatgaaaattaaagctcagatatgtcaaataatttgttcagagttacatagcttaagttcccaaagcaggattaaactgtggggcttaaactgtaggatacagaattaaactgtaggatacgagaacttgagatttttgttatattctccacatgcctaagtattaatcctgataggagagcaggatcaggcaggggctggtagtgtcagcctgacaatattaaacagcttcccaaggggccccctgaggcagaaaatcttatatgtctcccctctctcgggaaaaaaaaaaaaagtctgattttatttgagataggaatgtacctagctaaatatttttcttatcatcccttccagctagagttggctatgtgacacatgactaataatatttaaataaaaggctgaaagaaattctgggaaaggctatgtttacctaataaatggggacgagttggaccagaatattccctcctttattcctttctcaaatgtagacaagaagctggtagaactgcaggcgccatcttaaagccataaggcaaatcacagagatcttggcagtgaatttgaactgctgaacccacagcagaccgcctaccctcagacatcttatcacagaaagaaaatataggcataccttggagttatcacacgttcccttccaaaccactgcaatagactgagtattgcaatacagccagttacacattttttggattcctagtacctataaaagttacatttacagtatactgtagtctactaagtgtgcaatagcattacgtctaaataaatagtgtatataccttaattttaaatactttattgctaatgatcatctaagcttacagcaagtcataatctttttgcttgttgagggtcttaccttgatgttgacagctgctgactgatcaaggtggtggttgctgaaggttggggtggctgtggcaacgtcacaaaataagacagcaatgaagtttgccatattgattgactcttcatgaaagatttctctatagcatggggtgctgtttgatttaatagcaacagggtctcactatgttgcccaagctaatctccaatgcctggcctcaagcgatcatcctgccccagcctcccaaagtgctcggattagacatgaatcactgaaaccagcctagaacttctttcaaaattagagtcaatcctctcaaaccccaccgctttttcaactcagtttatttaatcttctaaatcgtttgttgtcatttcaacaatgttcacgttgtcttcatcaagagtagatgctatctcaagaaaccactctttgctcatccatatgaaataactcctcgtctgttcaagttttatcatgagattgtagcaatttagtcacatcttcaggctccactgctaattctagttattttgctatttcctcctaagtcacctacagtgacttcctccactgaagtcttgaacctctcgaagtcatccattagggttggaatcaacttcttccaaactcatattaatgttgatattttcacttgttcccatgaagcatgaatgttcttaatgacatctacaattgtgaatatttttcagaagatttttcattaactttgcccagctccatcagagaaatcagtatttatggcaatgataaccttacaaagtgcatttcttaagtaatacaactagaaaccagcaagccagattgattcctggatccatggacttcagaatggatgttgtgttagcaggaatgaaaacaacattcatctctttgtacatcttcatcagagctcttgggtgatcaggtgtgttgtcaatgagcagcaatatttttctcagagcagtatgtctcaacagtgggcttgaaatattcagtaaaccatgctataaacagatgggctgtcattcaggttttgttctttttatagagcacaagctgagtccatttagcataaatctttttttttttttttttttttttttgagatggagtctcactctgtcccccaggctggagtgcagtggcacaatctcggctcactgcaacctccgcctcccaggttcaagcaattctcgtgcatcagcctcccaagcagctggtattacaggcacctgccaccacacccggctaatttttgcatttttagtagagacgaggtttcaccatgttggtcaggctggtctcaaactcctgaccccaggtgaggccacccgcctcaggctcccaaagtgctaggattacaggcatcagccaccacgtccagcccatttagcataattcttaaagaattttcagaatagccaatgagcattgactttaaattaaagtcaacagctgcactagcccctaacaagagtcactgtctttcataggtgaagttcgtgacactcccagacaattacaatagtgacatcaaaatatcactgatcacagaccaccataacaaatatactaatgaaaaagtttgaaatattgtgagaattggccaggagtggtggcttacgcctgtaatcccagcactttgggaggccaaggtgggcggatcacgaggtcaggagttcaagaccagcctggccaacatggtgaaaccccatctctactaaaaatacaaaaattagccaggtgtggtggcacatgcctgtaatcccagctaccagggaggctgaggcaggagaatcgcttgaacccaggaggtggaggttgcagtgagccgaaactgcgccactgcactccagcctggcaacagagcgacaccgtctcaaaaaaaaaaaaaaaaaaaagaaaagaaatattgtgagaattgccaaaatgtggcccagagacaaagagagaacctgctttcaggaaaatggcaccaattgacttgcttgatgcagggtggtcacaaacttcaatttgaaaaaaaaaaaaaaaaaagtctgtgaagctcaataaagcagagtgcagtaaaatggggtttgcctagaagtctttacttatttaagctatttttgactggatattctgttacttgtagatagtcttactagtagctgacacaggagaactcaccttatcttggggtccattctcctccatctgttcaactcttacatcccaaacaccatcaaccaaagacttaaatattgcacaaaataaagaattaatgttgagcttggcactctgatgccagctgttgccatacttcaccaaaaatgcaatgttttccctttctgccctttgttcactctcttttgtatatttgtttcttccactaatttttttatgctttccagaagaagaaagtactctgcatatgctaggaatgtttaagtacttcctaaataaaatacaataaatccaagagtaacctgaacactgagagacatttttggtagcttttgctagctatttaatgttcaacacttgctttcaagatgtttttctaaatagtaaaataaagagttatatcaagtattagtcagtactatcaagtggcagactaatattaaaaatcatgtaatgatctccagattatcactatcttcccttgattctcataaaactaattaaatcaaggaatatgttatgatttggttttatgtaagtcctaatcaaaaaagggccatgtcctgatgaaacattttcaaaatggccagggtagaggataaaattcagtcttgtgaaaagaaacgttctttctcaaagttactggagttttctgcacctgctcttgtgacatcaatagaggaattaaatcacctgataattaaagtggtcatcagagatgtgttgtgttgtaacttacagccatggttctcaaagtgtggtacccagacttacaacatcagtgtcatctgagaacttaacaataaaaattctcagcccctggaaatctgttttaacaaatcctctaggtgatcgtgataatgctaacatttgagaacaactaaactttccgaagtaaacatatttgctaaagtactttttactagattaacaatgatagaaggaaataatggaagtttctgggggaaaatctggaaggagagagaagaaaggaagaggacaaggggagaggaaggagaagcacgatggctgcttgatgaggaacacttttttatgattaattcccaacataacctttacaaagttttctatatatctataaaagacatgacaaacttgttacaaatagctttttaaagaaatatatgtgattgaatttttttgtgtgtagaaatttccttaactgaacacttttgtcaatttcactccttcctctcaggtcttgatgtaacatcctgatattgttttttctccctttatacccatcagattcaatgttcttcctggaagtggatttcctgttatctttagggaatctttgcaggaaaatactcttttgaaagcagttactgaaatccttcttcaaaacttttgtcatttgtttggaagtttaacctttcacttacataaaattttcactcttgcatgtgcttgtgactcttgccacgtaacatgtgagctcctttattctagggacttggtgccattaattgttgtcctctcaatgacaagtaatagaacttgacaaataataaatactcagtatatgtttgataaatcaacagtgttatcaagagatattaatcttttcaagacctccacttctccacctctgctcctctactggatatcttctctctgctcccccttcttggccccagtctacctccttgtactgacttcttcttaggtttggccaatggagagctattataggagactggagggagacagaagagtgagttcagagtgtacattcccctgctgcctccctccctgtgtggtcaccttgaattggctgtgtcccttggcctaaggtcactaattctttcaaggtggctgtgtgcaggcagctcttcttttccactctagtaaccaattcttcccctcgttcttttgggagaaaggatgataacagctctgctgacactagccacatgactacaccatcctctgtggttcctatacaccctgcccatacccatgtaaatagatccattattaaaccatcttgaaattatcctaatctagatgtgtcatttgtttactgtgagaacactaacttttataactgccagattttaagagtataagtaaaactttacatattttacaatattcatcaacaactgagttctcagtacatgtgattttttacataaatatgctatttttaatattcagcaagtctaatatcttacatttggggattttaaaactcaccccctccctactctactgtggaggtggtgcagaaggactctaagtcaatctgtgtctgtctgtaaaatgctctgttaaaggcaggattcctgcaaataacttcacacatgcaaatgacttcagagaaggcacaaatatacatctaaaacacattccatttggggtttttttgtttttgttgttgttgttgtttgtttgtttttttgagatggagtctcactctgttgtccaggcgagagtgcattgacacaatcttggctcactttaacctccgcctcctgggttcaaacgattctcctgtctcagcctcccaagtaactgggactacaggcatgcaccaccatgcctggctaatttttgtatttttagttgaaatggactattgccatgtcagtcaggctgttcttgaactcctgacctcaggtgatccacccgcctcgcctcccaaagtgctgggattacaggcgtgagccaccgtgcccagcctccatttgctttttgcaagcataataaaatttttcctgtgggtataatatccttgatttattactcacactttttgtctgttaggtttacgttttaaaccattttttttcagcaacaaaaacacttgtagacctttaaaaatatacttttaagtctgtattttttaaaaagcccttccaatggttccaattaggagccagggtgaagcccagtgtgtatcctagtggcataggattaacattaagtatttttacctatttaatttttttatgtttcatctatcatgcagcacacataatagattagaaaaagttcccaccattagatgagcaggaatctagagggaaaatccaccttcagtgaagaagacctcagctttccatcttaagtatagctttttgaaaaagaaatgggataagcagattatatgtcaaataaagtgagcaaactgattcagcaaggtgcctgtgctcttctagtcatggtgaatcctacaaggcctatatttagtgatgaggaataagcacttgttgagtgactattaagtactaggcattttatccacattatttcatttagtctttatagttaactccaaaaagactaatatctcaaagtgttaaggtaacttgccaaatatcccaccattaatacataagttaaaaagaataggacttgaaatgctgcaaaaaataaacagatgtaagttcttcattctttaaacaagcaaatatttaacttaaattttttcttccatcatgactctttaatacaagatttttaaaaggttatatgctgtaattaaagtgaagaccatcttgctgagtttgtcttctttcaaagccatgttagaaactcctactaactcttcattagatttagagggaaataagcccttcctgctcttggtcttttatacactcagcagaacaagaccttcacaagcaagcattacccctttctgatgacgacaatgcattaatccaccaagaatatgctagtattgatatataccaagtaattttgtaaatataaggccttttcatttaggaaaaaattttaaaaaggcattaaatcatccttttccctaggaagatatccttctcaggctgaatttgtcaaagaccaccccgaaaataagctatataaattcctgtgaaggcctgtttaatttatggcccagggaaatgtgtaagtattagagagtcacgccaagagactgcttaactgggttaactgacctgaaattttctgggcctttacaagacttgaaattttcaaacagcatttatatatgcttattatataatagccagaaaaataaaagtgaaaggaactaaatagacctttggagtgaaggcctctttctcatgtagacagtttaatagctttttgtaaaataataccattgctattaaagatacttctggaggacttttttcatccataaagcagtgatttcctgtgagcactgcagtatgttgccattggctcatcaccactgaaaggctgcttctggaatccaacacaactggatctctgtgattactcttcagcaaattcacatttagcaaattataaaaagggacaataggtcattatctcattttaaaaataccatttccgtagacaggtctctgtcatagtgatattcatgtcttaactttgagcacttatgaagcaattcatcttttccattttttcaacttcctgccagacactttatcagaggaaattaaataagttcccttgaaatctttatgtcctgagtaaacaaagtgtaagaaaaactttcagaaatcatcaaataccgaattttttaaatattaagaatgtttatattttttcacacactacttttagtgctcttaatggtattactaacttgcaaaactgtaaatggcctcaattaaagtggctataaataaatagtgacagcaacaattcattgaacacacacacacactatgagccacttactaatttatacggttggcacatatatgctctcaacagctccaacaagagattcagagaagttagattaaaagcaatacaattaaaattcagaaccatgtctgactcactctacattgtgattttaatcatgcaacagtacagccttcccagaatgaatctagaaggtgagcaataaccaatttcccctctcctttctccaaagatattatttataatcctctcacaaggcaagagaagacaaggagcttgatatggtcatattttgtcatacaatggttttaagggaagagcaatgaacctgacttcagactgacaaactgttacacaccaggcacatcacttgttgtcttgtgatttttttgtataaattatatataacataaaaattatatacaaatatatgaaaaagtatataaaaattatgtaacaaaggaacattatataaacatttgtggggaaggtacaaaaatgttttcattggaagaatttacatttattaagggcactgtggacattcacattctgtcagtatttgaaaggtatatattttgatctcttttttaaaataaagagactaaagataaagttaagtacctggagcaaggccacatggctattaaagttatcatctaaactaaagcaccccctcaaattctcaaattgtgaactttcttatcgtaataacctcgccatttccggttgatttccaacagctgtttttgttattgttctcgatgttttcatttcctgcaccccatttacagagagttggtttcagaataaatctttccttcagcaaattaatttgtcctgctttaattctcaccaaacggttcatcaaaatgtataaggtggactctgtggcagtggttcccaaactttgctgatgttgaaatcatctagggatcttacactattcgaatcctgcttctacctccccagaaattctgatttagttggtacgggctgtgaactggaatgccaggtgttttaaagctcctcagattattctaatgtacagcaaaatttggttaccactgtcctagtaattgtttagacttctcttggactgaatctccaaaactccccagctcctgctatcagactatattactcaccatccctgcttattccagtcatctgaggacctccaagaccttcctcctattctttgaagatgttagcagtggtaactccagagcgattactgccataattcttggcgatttccatgtccaggcacataatcctttcaacattttatcctttcagattcttgactcctcttttgaactgtggttatctttcactctaccaaagtcacctctcaaaacatatctctgtatgttttaccaataactgcattattcccaacctcaagttcaatcaggcctctctccagccaccacatcatatctttctagatcatttatcttgtcccttactcaaaaaattacttgactttggacctcctcctattattctatcacctttttactgtgccttacccaagtcatattctcacctgcttcttatccagattagattctagaagtcaccagtgtaaacactcccttacatacactcttgactcttagcccattttcccctccatcgtagtcctctggaaaaactctaaacctagctagatagcattctctatgtagttctcacatgcaccaatggaggagcacagagctgaaaaaagaaatgcactcaacatgctcactgggctcatttttatgaccattaacctcaagtgggccctcagtgctgctaggcaatttgattcattttcctaattcgttcactcacccactttcagagtggtgattcttcactctgagttgatgacctagattattattctgctgaaaactacgaatcagttgggagagaacattcatatgggtctaccccaaacctattatgccatcttcatctgagcttacatactccattttccctcatgctctgtggataaatcctctgtgttcttatttaacaccacttcttccactgcacactggattctacccctctcacttacttaaggtaatatttatctccttctccagacatcttttccattagtatacaaatatactctaacagtgcctatttaaagaaaaaagtccttctttgaccccatatcttcccctagctactgcctcatttccctgattgtctttactgaaaaagttctcataggagttatctatccttagtctttcaatttgctccacagttatattatttccctgaatatcctatttttgttgaacccactctgtaacaactatgaaactcttccattgtagtgcaaaagcaatcatagataatatacaaaaaacttgcaaggctgtgttctaataaactatatgcacaccaataggcatgggccacatttggtctgtgagctgtagtttgtagcaacttgcattatacagctcctgtttctttcctgaacctagtctgtttagaatgtaaacacttgatggcaaagatttttattaatagtagatcatcaattaacaggcatagtatatagtgaattaacatttttaaataaatattgaatgttacataaatctatttctcttttagtcttatttttgtaattgttacttttttctgtgatattctgaatgggttgagcagtaccaaatgatattttttgttgttcaagaagtaattgtgtatgttttagttgaagaaagaaaaatccagctagtggacttttttagattctctttatgaaaaaataaaatcaatcctctgcatgttttatgattaggcacattattattattgtttggtacctttgaattgcattttcttaaaaattaaaaatggaattgaatctgaatcaaattggataataactgtgttagtccattttgtgttgccataacagaatatatgaggctggctaatttacaaaggtaagaggtttacttagttcatggttctgcaggctgggtagtatgataagcatggagccagcatctgtttagcttctggtgaaggccatgagtgaggtcaaaacgtggcagggaaagtcaaaggggaaacagacaggcatgaagaggaaccaaacagaaggaggaagctcgctttgtaacaacccactctcaaagcaactattccattctcaaaagagtgagaactcactaccagcagagcaggagggtgacaccaagaaatctgtaagagatccacccccatgacccaaacacctcttattaggcccagcatcaccaaattggaccacatttcaacatgagttattgttgggacaaagcatactcaagccatgcaataatcaaatctatgttcaatgttttaaaataaagtaaaattaaatattgacgatcacaatccatttttctgagggaagttgttttactgctacacaaggaaaatggtcatttcacaaaccatggaagatgcacatgtgctcaggctcccgaatatacatcatgctgggaaacccacatgaatccttgtatagttgtttccagtggaagattgccccaataccatcaaatcccactgccatgaaactctacatttgttaactcaaaaatagatgaaaaatgtctgactctcagcagcccatcttactggcaattgtctatatctactctgattgcttccaggatatgttcaggctgaagtatcagtgtctataatttacttatttatttttccagccatataaaaattttcaattttacgatttatattgaagttaaagaaagtattgtcttcctgaagttttttgatctcctctgttgtgttcccaaattacatcttaaaagcatcatcctagtgctcctgaaagaagtcattatgggaaaatagcaaggcctctccttttcctagtgtcacagaaaatgcaggaaatgttcaaagactgcaatgagttccccaaacacaaaatgtttctgcactcaacactttactagcatttgcagccacatacatttagacatttgtgattcattactagaccactattctcataagaacataaaataagaattaagaaaatgatcatcattcttaacaacagaaaatctgctcttcaaaattgctgacagaaagccaaattaataaatagtattagtcaaactaattgaatttatttattatctaaagatgctcttccacacagacagtcttggaaaataaggctacacttcttgtatttactctgaaagtaaaaatcttgtctgtatagaccttgaattatcactttgtacttttctaaaaacaaaagtgcactcaatttacaatatgtgtttctaaatgaaaataaacgactttcattcagatgtttgtgaaaccaaacacagacactgtcatttgagaagcagaatttatgggaaaagaaagagagaaaagatggttctgggatagttcaaatcccaaaggaagagaaggacacatatcacttagcaagaattcccatcagaaacaggacacatgcatttcagacaacaaaaaaactgaacgggacccaaaaacaatagacagataaggaggtttaaatgagtgaaaactactttttgttgtttatgtagtagtcttacaaatagattttagaacaattttccagcgataaattttttaattttactcaaataagaaagttgtttaagatatttactttaatattttaataaacatggcttttaaagggccatccgtgtgctaaaaagtatcagaattaaaatatttgcttgaggtttactaatgacaaaaatctcgtgtcagtattttaaagaaaggtaacagattaataatacagaagctgtgagagctactttggaaagtctcttcttaaaatgtccttttagaagtaagttaccatcagttgaacaccctaccttttacaccattagactagtgcatagcctggaagttagttatcttccagcatgggaggagtgttagtccaattgagaagaatatactaaatgctatcaactatttttgttattgcatctcaaagaatattaaggtttagtgcaattctatgcagaatcccaagcagacatgtttaacttggcaaataactctaaacttctgtaagataaaatgagcaagacaaacaagtagatttttgtgaggaacaaaatcataacatgaggaatttgtcttactagatgttaaaatttactataaaggtacaacaatcaaaactgtgaaacttaaacaggaatgaatagatcaaaggagtataatcaagaccccaagaatgctcacatacaaaaaactagtatatgctacatgtatgatcagtaagaaaatacataatcagcaaaaaaaaatgcataatacataagaaaatagctgataagcagaaaaagaactattccataatgatcctggaaaatgtatcaattatttgagagtaaaaaaacaaataattccaagtgtatcataaagttaaaaattaaaaatttgggggattcctctttcagttttggagccccccctctctgtctctgcacgggggagcttcttcctcctgccttctcccttgttttttgtctactaaactctctactccttaaaaccaaaataaataaataaataaataaaaattcaaagcagaaaaataaaaaccaggagaaaatataaacaaacattttcaaagctttatatggaaaagttaagctttaagaaatggaaaactcacaaagaaaacaattactagatttaattatttgtaaatactatcaagaactgccagtatcaaaattaaaggtaaactctaaaatggaaaaatacttccaataaatatggattcagataatgtctttaagacataattaattcttatgaacctgagagcaacatatcacacaacaaattaaattgagaagaatcacaaatgagcagttcaccaaagaaaaaatttaaatgtttattaaacatattaaattggtcatctccctaagaaacaaagaatgtaattaaaaataagacaacttttgcctataaatggaatgaaaagagcgctgtgatctattgggggaattataaattggtaaaagtttcctgggagaaagatacacagatatttgccaaaacatttttaataataaagtcaaaactgaaacaacttaaatatctaacaataggggaatagttaaataaattacggttagtaagattatgcacttggataatattcataatcggttactttaaaaaaaaaatccagtaacaaaactgtatattgaataatccaagtttgatatcacactctcacacaaatccacatacacatttttgtagaaaaaaaaacagaaaataggcaaatacattgtttgcaatcttttgatcattcagatttgccttattgtcttgggatttcttagaataactgcaaggggtatgtattgttatttttagaaattattatttaaaataacatgtgcatgcagtaaccatgcatatgtctgatcttcaggagaattgcaggagatagtccccatcttcaagaagcttatagttccactcacaaatgtgcatacacatgaaagacaaatcacatgtagatgacaaggtatattcaaatatcagcccatggaataatttgtattttggaaatctgaggcattgtggattagagtagtcaagggggctgagtcttgaaggaagttagtctgataagaacaggtaagtgatcaagacttgagagcagataggacaggacatgacacatcctgaagacaatgacaaagcatgtctggcaatatatcacatgtttgtacgcttttgatgggtattttaaagttaaaaggtatctggaaaaccaacataaaggtactactgtactaacacatcagagtatttacaactgtcattttcttgcagagattctataatagcttgcctctctgagaaaagaggtaaaactcatttttaacagtgaccaatgagttaattaagtgtatgagcattctaaactttatcacaattgtagataggcaacattttgtcattgtgactacatctcaactccttagggacaaatagaactgtccactaacagtggctgtggtgagcagggctcatatatgtgctatgcaggaaagacagaactttcccatgacctaaagagactctgcaaagtgaccacagatggtttataccagaaaagctggaaaaattatatgaagtcctgtgaaaaaccttagtttggaaaaaaaaataagaggaagcaaataaataggaggtcaccagcaagctccaaattaaaggaggtctctctgaatcaccctttctgagattttagcatatggacttcctaagtcacaaaggcctggagagaagatgagaaccacagtaaattccaaatcccggagttttattatcccattgttacacactagagagatttatggagccgctcccaaaaatgttgtaagtgtgctacagaaatggcttgttctccctgagccttttaataaagaagtaaggcagtgtgccaggaagagtacagagtgaagagtgggtgactagaacttcagctatcctgataattctctgagggaaatggcacatcatacttaacctcacagggttttcactttcattatctgcaatatgaagacagtgttcaaaatcaaagaggcacaaccagtcctgagcaagctgagaagattgctgctcaggaggactatccagaatgttcaaaaatagaagatgccagctgattccatacaaattccaaatagtgtcaggtacactataggccgcaggggaaaagtctagtgtctctgggctcagagtttctagaccaggagagctcttggcctgccactctcactttacagaaataatacctgacatttgaatgcaagctagcctaagagttgaagtaaacaatactttatttataagataaataataattgcaggtaaataatatatctaggagaaacataatattttacagatgcaaaaactggaagcatagagaaattaagccacttggcagagacgagacagctgtcatggcaaagtcctcaagacagggtcacccattccagcagcaccctcttaagcatttggctctgtcttccttcaatagaaaagagctgggacttgcctgagattaaaaatagttaagcattttgcaaataagtgcttagaaagatctatttaatatcataaaaaatagaaaataagcacattggcttgcctatcagaaagacgtgtggaaattgagacatgaccaaaaacaacttactagaaaacagctatactttaacactgtttttaaatttcattgagatgttttgaataatcaaagatgtaacctccagatatcaatgtttgttacttttaggctaagagtttgtgggaaatcaatcctacaactttttctctcaccattaatcaaaaaataatgatagtttcctgtagaggaaagttttgagaggtagtgattaagagagtcaaccctggaggtagctggcttgggttaaatcctggtcccaacacttaatggctatggcacgttgtcttagtcactgctgcatcctgaatgccaaccaaagggtctgacacttaagaaactggtaataaaagtgtaatgaatttttaacacttaatttgtttttgaagaaaatggggacttggctctctctctctctctcccagccccccacaaccaccacacaatcaagacatgttttgaaaggatggtatagcataccatttctgtttttttctttctctttatcacttgtgagaatagctgcttctcctaggaaagtgacatttgtagaacagcagcatgaatgttatgttatgaatatattaaccatggattaaaatagttctaacaggcacaaataagacatttacatttggagcctaaaatagccagtttgtctactttggtcacattagaggaaagctgtcactccacttgccctcccatggacctatctgattggagcctttggctagcatttattttttttgaaagaagcaaaaaaaagttgaggaagggttcagatggtatctcaaactacctaagaaacacaaagccctttagctaggctttgaagtttgttcctctgagcttgtgggcaaacaaaaagcattagcagcattcaatgaaaaataaaaaatcatgcaagaagaaactaaatattttaaagcacccgtaaccattaaaataaatagctaatgtaatgccatgtgtaatctggaaaacaagaaatgagtaattagggggaaagttcatttcagtggacgacgaattgcccttaaggtttctgactgcctactttaaattactataatatttacattgtaaattcagttataattagactacccaattcctctcaaacaatacagactaagaggctttggttaacatcctagctttattactagcaagttggacaattaaaacaaataatttgaccttcttcaactttagtttccacaagtttaactaagacaattgaaacagatcatttccaaagttcttttttagttccaaaacactatgaattatcaggctaataacaaaaatgcgatgtagaagatgaactgcattataaatgtctatttaatgttttaattcagtaattcaataataatggtcaacatgtatagagccaggcattttttgacactttacatgtataaatacatttaatccatctaaaatttccatgaaataagtcctaatattaccccagttttgtaactgagaagacaaagaaaaagtacactgattataaagctagtggtcaagcaatgtagctgggattcaaactccacgcaatctggctcagaatccctgtgttcaattcatcactctgcaattctgctagtgcaaatttcaaaatgcagatccagaggagaaaagaccctgcccctggctattatagcagttggtaatgattccattcatgcaaaatgtcatgtcttcctagatgtgctttttcaggtagaaaaaagaattttgaagactaaaatttatttttttcccacagaactattaattacatatccccaggccctcccatcttttaaatattttccctagttataaaattacttcatctgattgctgggatttaaaagtaatgctgattggccaggcgcaggcgcagtggctcacgcctgtaatcccagcactctgggaggccgaggtgggtggatcacctgaggtcgggagtttgagaccagcctggccaacatggagacaccctgtctctactaaaaaatacaaaattagccaggcatggtggtgcatgcctgtaatcccagctactcgggaggctgaggcaggagaatcgcttgaacctgggaggcagaggttgtggtgagccgagatcgtgccattgcactccagcctgggcaaaaagagcaaaactccatcttaaaaaaaaaaaaaaaaaaaaaaagtaatgctgatttattaatattttattacttttgtcaaaacatgtagaagtgaatactgcataaatacctcgatcctataaagatatgattagcagacgcctttgttaaatatgagtactggtttcttaaaatataattactatttgttctggccaagactatcataaaatatggaatagatgaaggataaaacttacacaaatggtaacttacctatgcctgtaagtcttatgtgaatgtgtatgtgtgtatgagttactaaatacaaaggaagtcaggtaaaattacagcctattatcagcaattcctgaagaaaaaaatacagcagtaaagttttaggtattatgtgttgctaaatttgcatagacttactaagttgagttcatatggtctaattcagattaattcaagagcatgtgatgaactggaacttatttatttcataacagcaaacataggcttctgccattctgacacaaaacaaaagtaatggaaagaacaggtatggtagcacttctctggagaaaactccacatggaaattaaaaagctgcctaatctctcttttccacctccattgtgggaaatgcggcagctgctgatgcacggaggccacatatgatgggaatacgggagcttcaggtgatgagggaatggattcctctaccctacacttcccaaaaggggaaaaatacattttttactggaaaaaaacctgtaaaaagcacacaataaaccaaataaattatgaaacataattatgccatggtcatgttgcacaataaaaatcactattaaagaaatgaagattaaaaagaaagccttggcaatattaagccccataatctgcttcctctttcgatatttcagtagcacaacacttatcactatcttaatggatgtgcacaatatgtagggtatgcacttaataactataaatacatatgtaaaataaaatactatcaatggcaatttatcttaatgctttcattctcctgggttatttccttctgaccaacattctaagaggggtaagagaaaataccagtgggcttgagaccataaactgcatgatttcatttatattacatagaaaaaagcaaagttaatcaacgttattcaaagttaaaatagatttggaaggataggtaatgaatgaaagggagcatagaagaggtttttacgtggccgggcacggtggctcacgcctgtaatcccaccactttgggaggtcaaggtgggtggatcacgaggtcaggagatggagaccatcctggccaacacagtgaaaccccgtctctactaaaactacaaaaaaattagccgggcgtggtggcaggctcctgtagtcccagctactcgggaggctgaggcagcagaatggcgtgaaccgggaaggcggagcttgcagtgagccgagatcgcgccactgcactccagcctgggtgatagagcaagactccgtctcaaaaaaaaaaaaaaaagaggatttttagggttcttgtgatgatctgtcttttgatctggttactagctacaaggatgtgtttaattcatcaaggtgtcataataaatatgctttcagtatatatattttaatttttaacacttgtaaaaaatactcttattttatgtttttaaattatattcttatgcactaacaaacaactatcagaaaatgtaattttaaaaaataaactattcaaatctattagaatgactgttgaaaaaagttgaccacaccaagtgctggtgaggatatagagtagccagaactctaatgcatgttgctgggaaagcaagatggtacagtttggcggtttctcataaagtcatgcacatgtgatgagatccagaaatctcactcctaagtattttcactagagaaataaaaacttatgtttagacaaaaacatgcacaaaaatgtttgtagcagcattactcaaaattactcaaaactggaatcaaccaaaatctctctcaaggagtgaatgcataagcaaactggtacatccatataatggaatactcctccccaataaaaggaacaaactattgatacacaaaacaacatagataaatcccaaatgcattacgctaggtgaaagaagtcagtctcagattgcatactaagattacatccatttgaaattctggtaaagagaaaactacagagatgaagaacagatcagttcagagttaggagtagtggggacaattttacctcaaaggggtagtgtcttagtccatttagtgttgctataaagaccctgggtaatttacaaagaagagttttacttggctcacaattctgtgggttgtacaagacgcatggcaccagcatctgcttgtggtgagggcttcaggctgcttccactcgtggtggaaggtaaagggcagctggtgtgtgcagagatcacatggcaagagaggaagcaagatgcagggagggaagttccaggctctttttaacaaccagctctcagaggaagagacacagaaagacaaacatcacatattctgacttatatgtaggagctataaaagtagatctcatggagataaatagtagaataatcccagaggctgggaagagtgtgtgtgttgtgcaggggttgaggggatcaacgaagaaaagttggttaatgggtacagacagataaaaggaatgaatcgtaatgtttgataacaaagtagagtgactacagttaacaacaatatattgtatatttcaaaataacctagaagagacagcttggaatgtttcctacatgtagaaatgataaatacttgaggtgatggatatcccaaataccctgacttgattattagactttatatgcatgtaacaaagtatcacatgtacctcataattatgtacagatattacgtattaacttaaaaatgaacttcaatacatattttgcaccatgtaaaaaattaactcaaaatggatcacagagctaaatgcaaaacctaaaacttctatgaaaaaaataggagaaaaatatttgtaactttggattagttaataatttatttgatatgatatcaagtgtacaatacacaaaagaacaaattgataaattggacttcatcaaaattaaaaacttctgttctttgaaatatcgtttcatagagaggatactttttattatcactgctaacctgcggaggtagcagtgagccgagattgcgccactatactctagcctgggctacagagcaagactctgtctcaaaaaaaagaaagaaagaaaatcacataatctttatttagtatatatttaaaaattatcaaaacccagtaataaaaatataaataacccaatttaaaatatgggcaaaatatacttgtagaaaaatgaaattggatccctatctctcaccatatacaaaaattaactcaagatggattaacgacttaaatctaagacctgaaaccataacaattctagaagaacacctagggaaaattcttctggacattggcctaggcaaagaatttatgactaagaccccaaaagcaaatgcaacaaaaacaaaaataaataaatacctaattaaactaaaaagcttctacacagcaaaaacaatcaagagtaaacagatagcctacagaatgtgagaaaatacttgcaaactatacttctgatagaggactaatatccagaatctacaggaaactcaaacaaatcagcaagaaaaaaataataataatcttttttttgagagagagtcacgctctgtcgccctggttggagtgcagtggcacgatctgggctcactgcaagctccacctcccaggttcacgccattctcctgcctcagcctcccgagtagctgggactacaggtgccccccaccatgcccagctaattttttgtgtttttagtagagacggggtttcaccatgttagccaggatggtctcgatatcctgacctcgtgatccacctgccttggcctcctaaagtgctgggattacaggcctgagccaccacacccagccaaataaccttatttttaaatgagcaaatggcatgagcagacatttatcaaaaaaagatatacaaatggccaacaaacatatgaaaaaaatgttcaacatcactaattatcagggaaatgcaaaataaaaccataagaagataccaccatactccagccagaatggccattttaaaaacttgaaaaccaataggtgtttgcatagatatgagaaaaagggaacacttgtacactactggtgggaatgtaaattagtacagccactatagaaaacagtatagagagttgtaaagaactaaaggtagatctgccattcaattcagcaatctcactactgggtatctacccacaggaaaaaaagtcattatattaaaaaaaaaaaaaaccccacctatgtgtatatgtttatcatagcacaaatcacaattgcaaagatataaaatcaacctaactgtccaccagccaatgagtgggtaataaaaatgtggtttatatatgccatggaattctactcagccgtaaaaaacaaagaatgtcttttgcagcaacttggatggaactggaggccattattctaagtgaaggaactcaagagtagaaaaccaattactgcatgttctcactcataagctaagatggctactcaaaggcatacagagtggtataatggacattggagactcagaggtggaagggtaggaggtgggtgagggatgaaaaattacctagtatgtaaaatgtacactgttagggtgatggatacactaaaagcccagacttcaccactatacagttcatccacataaccaaaaaaatggctggacccctaaaagctgttgaaataattttgttttaatgggcaaaatatgtgaagagatacgtcaccaaaaagaagatatacatatgtcaaataaacacataaaatagtgatcaatattactacccattagggtcatagagattaaagtcatgctgggataacattacacacctattaaaatacctaaaatttaaaaaaactaatcatgtcaagtgttggcaaggaagtggagcatctggaactctcattaacttttgctgacaatatgaagctgtaaaaccactttgaaaaaaaatttaggcacttaaaaaattgaaatacacatctatcatatgatgaagacattgcatttctaggtctttacccaagagaattgaaagtacatgtctaaaaaatgtatacacaaatgtttgtagcatctttatttgttatcactgagaactggaaacaacacaaatgtgcatcaacagttgaatgaattaataaagtttggtaaatagagacaattgaatactaatcggctataaaaaggaatgaactactggtatacataataacacagataagtgtcaaaatactattctttaagagaaaagccaaacaaatacatactgtatgattccatttataaaaaagactagaaaatacaaactaatttacagtgaaggaaatcagatcaatactttcctggaaatatggtaggttgaggtgggactggaatgagggactataaaagaacatgaagaaatctaagggagtaataagtatgtttattatctgaattttgtttatggttttctatacatatgcatatatcaaaacttatcaaattgcaccctgtattagttttttattactgcataacaaattattgcaaacctagtgacttaaaactaacctatcatcttaccatttctgtgggccagaaatacaagcatgagctaactggatcctgtacttgggatctcactagactgaaatcaaggtgtcagccagggctgtgatcacatctgagacttaggggtctcagaattcaatgacttgtggttgtaggactaagatccccattatcttgctggctgctggctagggattctccagttcctagagcttgcccccaggttcttgtcacgtagccatctcacaacatggaaattgacttcatcaaaaacccaccttacaggcgtgcagtggctcacgcctgtaatcccagtactttgggaggctggggcatgcagatcacctgaggtcgggagttcgagactagcctgaccaacatggagaaaccccgtctctactaaaaatacaaaaaaatcagccaggtgtggtgctgcatgcctgtaatcccagctactcgggaggctgaggcaggagaatcgcttaacccaggaggcggaggttgtggtgagccgagatcgtggcattgcataaaggccctaccctcataacctaatctaatcctaattatctcccagaggctctgtctccaaatattatcacattgggggttagggcttcaatgtttgaattggaacaggagggccacaaacattcggtccataacagagaggattatacagggtgtacactctcaggagtagaaatttgggggactatcgtagaatgctgcctaccacataccttttaaacatgtgcagtttatgtccacacaaaacatcaatgtacaaaaaagacaaaatgacataagggaaagaaaattatattatcatcagacttctggacagcaatgtattatcccagaaaaaagtagaataaacttgaagatacatacatatgtatgtatgccgtggattttatgtccaacaaaatttaccttcaagtataaagggcacacatgaatttttatcagcatgcaaaaactgaaggaatgttgtttctattttcctccttaggaatctactatggtaggtactttagacaaccaaaatgaatagaaaattatcggtatgaggactgaagaggagtattaaacatatagttacttgtagagccagatgaagtgaagattaaaggaagagagtataatatataatggttttatatttaagcaaagtagtgaagttataaaaaattgacataatgtgtagaatatgcaaaatatatttgaacaattctcagtaatttttcatggtggagattttggtatggttattttaagactattctgtttataacatgggataaagtaataattacgggaaattctaattttattatctcctgcattcatgggaaccaagattcttgatacagaagaaagtagttgtagttaaagtaaaaacaatccctgacacacacatctctttccctaattttaattggaaatatatcagtaagatctgataaactattttgtatgtacatacagatatgcctatggtatatgtatatgtgtgtctacattcatatctatcaatattttctctcttgcgcatctcttcccacaggagtctctggctacatgctcccgacaagacaatcacaaatgtcaattgcacgtaactccttgcgaaggacaaatgttaaggttcttttccactaagcccagtccatctcatttctctggcttccctcataaaatgatgaacagtctttgcatccgtcagtgataacagagtctcagcttcccatctcctgtgaataaattcttgggggagggaagcatctacacacctatctaaaacaaagaggccttaggctacataaatcaaaatatggggtagggaggatttctaactttgcagaaacaaagttcagccaatagatacaattactattactaaatagtacacttaatgcttcagtctgaaggtacagtcaatcctccatagccatgggttccaatgtctcagattcaaccaacctcagattgaaaatattgtggacaaaaatataaaaaataacaatacaataataaaataatacaaatttttaaaacaacatagtataacaactatgtatacatcatttacatgatattaagtattataagtaatctagagatgatttaaaatatacaagaggatgtgcacagttgtatgcaaatactatgccattttgtataagggacttgagcatccacagattttgttatccacaaggggtggagggtactggaaccaaccccctttagctactagggaagaactgtactgcattttggttccttcactggatttcagagcttctcatccaacattagcattgggaaactcctggatgaaagggaacatctcccataaaaacaaattcctgtaccaccattgcaagatagaaagtgattactactccccacatgaaaaattctccaacttcaccacatcaaagtcaggaagctattgagcattcaacattctagaataaggcaacccaaagctttcattgaacaaatatggtttgattgcacaggtttgtcaaagtgccatgtggtttttgagttcctaaacaccacaatgtccccaagcaaatttttaaaacacaagttattccttcaggatgccaagattccataggaacattatcctctatttcaaaaataaagtataaagctatttgaaaataaaatatcaatcagtcaatgccgaaactgtaggaaagactgaatgttgcctgcctttggaaatctgtgtcattccagaacataaaggccaattaccatatctgctcagaaatatatatcagaaatatatatcagagttggaagctctttagtggagatggatcttagaggcccctttaagacataggcttttagaaaccttctatattaaagcatgctcttacatccttccaatcctataacagaataaacgtttcaaagcaccgacctgttaattaccttatttaatcttcactatgttgcattcatttgtaatgttgtttcttattcaattaagtaaagaagcttaacttctagatgcatattatgtgttttaaaaggctgcaaaaagcataagaataaaaaattattttccccattagcttatcatcaggaaaattccagaccaaagaaaggcatggaagtggatggttatggagtaaacttctggaagaaacaaatgtggaagacacagcttttcctctttgtaacttaagccagaatcaacctacttttatccagggggtaaactgagagagaaagaaaactctctattgactattgcgtgcatgccaaaagatcatagactttatctcaatgaaccccatataggcgttattatccccattttatagatcatgataaaaacatgcccacagccatatgtgtggtctttgaaagtacaccatcaaacccagacctattgattataattataaggcctcttttcctttccatggtatctcactgacaaaacctgtgttgcctggtctgtgaccacgtcttggttaactgaaggagaacagaaaattgtccttttcagctgaaactaaaaccagatcaactgacgactccaagatgttaaaaaatggtccagataatcctgactaaaaatacaatggacaaacaactttatcaatttcagactatttttcccggtctcttgaattttgcatgtgaatgtttcatttaaaaacagcctcatcaagcaaagtttaaagaagtgtgtccaaaaaaattataggtttttcccccaatctttagaagattttcattgctattgctacgaaatacaaaaagttaaacaaaaaattttgttttccaagctgaaacatgtatttgtaaatccaggatagttaaacaagaaaactattcttgcagaaaatatctgaaaaatgaaataagcaatattaagacaaactgagtaaggaagtggtgattaagtggagtaaagaccgaggtcatgtacatctgtgctgtgtaagggcccacttcattttttgataacttcactttttcacccttaacagggttaaccctagaatgtgacaagggtagcctatgacaggcgacattttgaagtcacatttatacaacctctaccccaaacccaaagacctctctctctctgacacaaacacacacggaaatttatatacttttaatatacacaacccaaggtagtcttttacaatttaccagagtcatttattacttagtggcattccagctctcacacaaaatcacgatatttcctgtgcttccctccatgcacgttttgttcacttctttgcacaagggaactgtgactctagcatgctgacttgtcgtagaaaataaagtgggaatttttggccatcacttttaatttagagctactggttcatttctagaataacattaaacaagagaacgattaaaaaaaaaaaaaaaagagaaagaaatgaatgaataggttatcactgccatctggtggtgaaaatgcaagaaaacaggatatacattctgatagctcaaaatagaattagtttgggaaaagcattgttttataaaatgtcaaaaaatgttcagaagtttaattaagaaatgattatcaaatgtttgtgttactgatatgactcagagtagtcgcaatacggaatatatgatctcttctgattcacattttttttttctcaatttccaggaacatagaggtgttcctacttttcaggcccaagaaccatagaaaaagttaaatgatcattgcatccgtttcacctccccatggcactcctccttcacagttgttatttcaagagaactaagtatttacaatcatgctatgtggtgggcacagcatacaaaacggacatctcatcacctgcttgcctctatcaggctctgaaggtgtctttcctaggaagttgtcaacataattaaatcagacaaacttcaagataccattgcttttgacagtgtggagtttcaacatgacagactttgactctgcagggggattccacagcagctcccatcatatctaagcttctattacacccaagcttctatcacacactaagcaatgtgatctcacattacacagcatactaaactctctatataggaaatcaaactttcttacgttgcacacacacacacaccatttgtttgtttctgctttcaagtctttatgctttcttttattttcacttgtattgcctatcatattatcctcttcaactacccaggtccttgccaaacgtaaaaattcactgacttgaaaatgcctcaaaggttatctatatattactttttagggtttgctttctatatgtcagacactgtttcaatcattttatgcacatattagtatttccaaattctcaaaaaaactttggagaattattattcctatttaagcgtggagaaaacttggctcagagcaatgaataactcatctaagtctgcactgggagtgagtggagaaaccaagttttgaagcaaggtcagtctaatttaaaggttaaactcattccttccttgctcatcattctaacagggctttagtacacacacatatatgatgtaagaacaatacatatatgttcttacatccctttcctgtgcaatatgatccattcctctcaagaaagtatgaatgacatttcctttagcaactccagagaaccctcattagctaatgaagtggtctcttggttaacagtgtggatttcaaaatcagaaagcattctaccactagcaactttacagtattgcaaaagtactaggcttcagatcttcagttttgcccctttgaaatactaataaacctttttgaaaattaggtgagataatccatgaaaagagcttaactagcatcatgcctgtgacatgttaagcactcaataaaagttggcgtttattatttcagtctcttttatatactggatattcaatgcagattgatgattaactgttttcagcgatatgaaaaggcctttatgaaaggaaaagagctcttcagaatattggatgactctgaatggtgactctagaataacagggcaagactctatatgggctgtagaatcgatcatatgagagatctgggtagaacatcttcacatattggaaaatgtaggggacaccacgctcctggggtttctaggctggcagtgaacacatggaaaattctaaatgtgaaaatgacagctttgtcagtttgctcctcgaggcctgccaaagactgccacagtccctgtccatctctagtaaatcacagtaactaattcagctcctacaccaaatttggcttcttctatgacttttcctaacataaaaacacacaaaaaagaatagcagcacaaaaaccacataagtcccagaaatcatttccagatgaaattttatatgttctgctttctagttttggcaagtcattgaaaagtaaaatagcaaccactgtgagagaattcttatatttctggaaaatgatgttccaatgttatttttaaggaaaggaatgtttatccttcgttccgaggaatgataaaaatgttcccaaattaccctttaaaaaggcagtgattttacaaaatatatatatatacacacacacacacattaattcctcactttatatcttaaataggttctttgaacctattgcttgttaaacaaaagtttaaacaaaacgacatataacaaaaccaattttaccaccagctacttgatataaataagattcagttcctacaacaaatttctggtcacaaaaacatcaccagacttctaaataaagagccaaagcacttctaatattaaacatagaaaaatatttgaactatatatacattttttaactattaatatactcaagcaggataattatctacccatttattccagctcggggttgtaggtgggtgagtctgtctcagcagttcagggcaccagtcagaaacccaccctggataggccgccatcccatcacagggcacactcaggcacacacactcacactcactcagacaggggccatttagacatgctaattcactgaatgtgcgtatctttgggatgtgggaggaaatttgagtacccagagaaaacccatgcagacatggggagaatactcaaggttcacacgacagtggccgtaggaagaagcgatattttttctcatcaatgcgatgagaaaacaaggttgaatgaaacattattcacttacctggtgcttgagtgtgtggtatgtgtgtgtatgtgtctatctccaaagataatattatttattaaaccactgtcccactcccgtgagcactgatgtcctaagaatcccacccctgctattgatacggaagtggggaagggaagtgctgggaagggaagtgctggtgtgggccctttaaatgatacggaaatagggaagggcgtggtccctgactaggactccaccacctgccttgtgaccagggacctaggtgaggacaggcatttttgttttcctgcccaaatgttgcatttttcaagaccaccctggcgtgccactcccccatcctatgcctatgaaaacccccaacaccctaacaggcagacacacaaacggctggacatcgagaggagcacatcactggaggaacacgcaggtggctggacattgagaggaacgcaccgacaagcaccagcaggccaacaagccaccaaccgactggcagactgacacggagtttggctggggcagtcggaggagagcgcccaggccatccagcagcccaactccagaggaaaaccatcttccttctggctccctcatctgctgagagctacttccactcagtaaaaccttgcactcattcttcaagcccacgtgtgaaccgattcttcaggcacaccaaggcaagaacccgggatacagaaaggcctctgtccttgccacgaggcagagtgtctaattgagctgattaacacaagctgcctatagacagcaaaactaagagcccccagtagcacacactcactggggcttcaggagctgtaaaaattcacccctagacactgccatggggtcgaagccccacatcctgcccatctgtatgctcccccagagatgtgagcagcgaaacactgaagaagctagccactccctctctcgcatgccctgcgaaggggacaagggaacttttccagtttcactatgaccatggcaaaagctacatacctcaagactgcccattgagattagaaaacaatacaaaatcctgacccttaatccagctgtcttacttctaggaatcaacccaaagatacattagtaaaaacagaaatatacctgcttaatactggtttttttttctttgcaacttttattttaggttcgggggggtacgtgtgcaggtttgttacatggctaaattgtgtgtcatgggatttcttagtcacccagataataagcataggacttgataggtagttttttggtcctcaccctcctcctaccctccaccaccaagtaggtcttggtgtctatggttctcttctttgcgtccatgtgtactcagtgtttatctcccaggtgagagaatatgcagtatttacttttctgctcctgcattaatttgcttaggataatggcctccaactccatcgtgttactgtaaagggcatgatttccttctttttatggctacatagtattccatggtatatacataccacattttctctatccagtccatcattgatgggcatttaggctggtttcacatctttgctattgtaaatagtgctacgatgaacacatgcgtgtatgtgtctttatggtagtttgggtatatacctagtaacgggattgctgggttgaatggtagttctgttttaagtcctgtgaaaaatctccaaactgacttccacagaggatgaactaatttacattcctaccagcggtgtgtaagtgctcccttttctccacaacctcacatgcatcggttattttttgaccttttaataatagccattccgattggtgtgagatagtatctcattatggttttggtttgcgtttttctaacgattagtaatgttgagcttcttttcatgtgtttgttggctacatgtatgtcttcttttgagaagtgtcttcatatcctttgtccattttttaatggggttgtttggtttttgcttgttaatttgtctaagttccttatagattatgtatattagacctttgttgggtgcatagtttgcaaatattttcccccattatgtatgtaggttttctgtttactctgttaatagtttctttcaactatgcagaagctctttagtttaattaggtaccatttgtcgagttttattgttgctgcaattgcttttgaagtcttcatcatgaaatctttgccagggcctatgtccagaatgggatttcctagggtttcttctaaaatttttatagttttgggttttacatggaagtctttaattcatcttgagttgatttttgtatatggtgaaagtaaggggtccagtttaaatcttctgcatatggcaagccagttatcccagccccatttattaaataaggagttctttccccattgcttgttttttgtcaattttgttgaagatcagatagttgtacatgtgtggttttacttctgggttctctaacctgttcccttagtcgatgtgtctgtttttgtaccagcactatgctgttttggctacaatagccttgtagtatagtttgaaattgggtattaaagtgcctctagctttgcttttttgcttagggttgccatggctattcaggcttttttttttttttttttggttctacatgaattttagaatacttttttctaattctgtgaaaaaatatcattgaggtagtttgataagaatagcattgaatctgcacattgctttgggcagcgtggccaatctaacaatactaattcttcctatccatgaacatggaatatttttccatttgttagtgtcacccctaatttcttccagcagtgttttttaattctcattgtagagattgttcaccttcctggttagctgtatttctatatatgttattatttttttggctactgtgaataggaataagtttttttatttggctctcagcttggatgttcctggcgtataggagtgctagcgattttcgtgcattgattttgtatcctgaaactttgctgaagttgtttatcagatctgggagttttggggaagagactatgggattttctaggtatagaatcatatcatctgcaaagatagtttgacctcctttcttcctatttggatgccttttatttctttctcttccctggttgctctggttctcaaggggaatacttccagcttttgcccattcagtatgatgttgactgtgagtttgtcatagatggctcttactgttttgaggtacattccttcaacgcctagtttgttgtgcatttttaacatgaagagatgttgaattttattgaaagcctttttgtgtctattgagatgattgtgtagtttttgcttttagttattttcatataatgaatcatacttattgatttgtgtgtgttgaaccaatctttcacatcaataaagcctagttaatcatggtggattagctttctgatatgctgctggatttgcttttctagtattttgttgagggttgttgcacctatggtaatcagagatattggcctgaagttttactttgtggttgttgggtgtttggcaggttttgctatcagaatgataccagcctcatagaatgagttagagaggagtttgtcatcctcaatttttaaaaacagtttcagtaggattggtaccagctcttctttatacacctggtagaatacagctgtgagtccatctacttcaggactttttcttagtaggcttttattactgattcaattttggaactcatttttgttttgttcaaagtttcaatttcttcctcgtccaatctttaccaggttgtatatttccaggaatgtattcatttcttctaggtttcctagttggtttgcacagaggtgttcataatagtctctgaatgatactgtgttccatttctgtggggtcaatgataatcatttttgattgtgtttatttggattgtctcttttttctttattagtctaactagtggtttatcaatcttaattattctttcaaagaaccaattttttgtttcattgattttttttttttgagacagatctcagtctgtcacccaggctagagtgcagtggcatgatcttggctcactgcatcctccacctactggcctcaagcgatcctcccatctcaccctcctgagtagctgggactatggacatgtgccaccacactcagctaatttttatatttttagtagaaacagagtttctccatgttgcccagacaggtcttaaacttctgggctcaagttatccacccacctctgcctcacaaagtgcaggggttacagatgtgaaccactatgcctggccttgtatggctttttgcatctcagtttgattcagttcagctcagattttgggtatttgtttttttctgctagctttgaggttggtttgctcttgtttttctagttcttcttggtgtgatgttaggttgtcagtttgagatctttctaactttttgatgtggtgatttagcactgtaaacttccctttttgcactgttttagctgtgttccagatattctggtatgttgtatgtttgttttcattcgttttaaagaatctgatttctgccttaatttcactgtttaaaagaatttcttgatttctgccttaatttcattgtttatccaagtcattcaggagtagattgtttaatctccacataattgtatagttctgagagaccctcttaatattgattcttatttttattgtgctgtggttcaagagtgtggttgatatgtttttggtttctttgaatttgtcaagaattgttttatggctaagcatatacttaattttagagcatgtgccatgtgcagatgagaagaatgtatattcagttgttgctgggtggaatgttctataaatgcccattaggcccatctggtaaagtatcgtgtttaggtcctgaatatctttgtcagttttctgctttgatgatctgtctaacactgtcagtggggtgttgaagtctcccgctattattgtgttgttatctaagtctctttgtaggtcttgaagaacttgttttatcaatctgggtgctcctgcgttggtgcatatatatttagaatagttaagtcttttgttaaattgaacctttatcattatgcaatgtccctctttggttcttttttgattattggtctgaagtctgttttgtctgaaattagaaaagcaacccctgatctttttcattttccatttgcttggtaaatttttttacatctctttactttgagcctatgggtgtcattgcatgtaagatggatctcttgaagacagtgtacagatgagtcttgcttctttacccaacttgccattctgtgtttttgtaagtggagtgtttattttccattcaaggttaatattgttatgagcagatttgatcatatcatactgttgttagctagttgttatgcaggcttgtgtggttgctttatagggtcaatggtctatgtacttaagtgtgtttttgtggtggccagtaacagtcttttgtttccatgtttagcattcctttaaggacctcttgtaaggcaagtctggtggtaattaattcccttagcatttgcttttctgaagaggattttgtttctttcacttacgaagcttagtttgactggatataaaattcttggttggaatttcttttctttaagaatgctgcatataggcctccaatctcttctggcttgtgggtttctgctaaaaggtccactgttagctggatggggttgcctttgcaggtgacctgccccttatctctagctgcctttaatattttttcctttgcattgaccttggagaatctaatgagtatgtatgtgtcttggggatggtcatcttgtatatagtgtctcacaggggttctctgaatttcctgaaattgaatgtcaacctctctagtgaggttagggacattttgtggaaatgttgtggacaatatgttcaaatatgttttccaagttgtttgctctctttccctctctttcaaggacaccaatgagtcatagccttggtctgttcacataatcccatatttcttggaggttttattgttttttgttcttttttatttatttttgcctaagttgattagaagaaccagtcttcatggttcatgcctgtaatcccagcactttgggaggcagaggcgggcagatcacaaggtcaggagatcgagaacatcctggctaacacggtgaaaccccgtctgtactaaaaaaaaatacaaaaaattagctgggtgttgtggtgggtgcctgtagtcccagctacaagggaggctgaggcagaagaatggcgtgaactgtggaggtggagattgcagtgagcggagatgcgccactgcactccagcctgggtaacaaagcgagactctgtcaaaaaaaaaaaaaaaaaaaaaaaagattgttttccttagcttggtctattctgttgttaatacttatgattgtattatgacattcttacagtgtgtttttcagctctagcagatcagtttctttcttaaaatagctattgcatctttcaattcttgtgttattttattggattccttagatttcttgggttgggtttcaactttttcctgaatctagatgatcttcattactatccagattatgaattctatctctgtcatttcagccatggcagtctggttaagaaccattgctgggaagccagtgtaatcatttggagataagaagacactctggctttctgagttgctagagttcttgtgctggttctttctcatctatgcaggctgatgttcctttaacctttaaagttggtaaactttggatggagctttttgcttttatattttctgaagaccttgaagttttgactgcggtataagttgagttcagtcagccggcttcatttctgaatgatttcagatggccaacgctcagctcagcaactgtgggctgcatgctaaccctggggggctggtagcaggcccacagctttgttctctgtccacttgaggttaagcacctgctatgcaggacgggctgaagtgctctggtctgctgacaacactctgatggggggtgccagcaaaagcacatcatcagggtggtggcagcagagtatgcatgcactgccagcagcatcagcatgatggggtatacatgtgctcacaagggtggggagatagcatcctttcatgagtgctcacaaaggtggctgcaatgaggcagtgtccacacatgccagagggagcggggcagcagcaggaggtccacacacacatgccagtgacaactgagcagtgaagtctgtgcatgtgcacactgccaaaggggtgagggaaggttgtaggtgggtgtgcaccagcaaggcccatctgctgaagctccctgattgttaggtggggtctgccggtgaagtagctatggcagctgccaccaggaagcaccctagttgggcatccaaggctgtgctgcaaatgggcacggccaggcaggcatgctgggagagactgggaggcaagggagtgcacagatcatactagccccatcccatgggcaaaaccgtgccactctgtccaggtatgacaggaaacaaaggccaaagccacctaggggagtgtagtgagccttggggatgaatgcccctggccgtgctccactgcctctattcctatgccaaccccccttggctctgcacaggctggaatactgtccctgccacctctccaagtagctctcctatcagctcaagtttctgtgggggtcataagagtctcctgaagctaggagtctggaggtccatggcaagagtcggccactgcttacctatttaacttatctcttcccccaggaactgcagagggccaggagcaagccttggtgtttcactgccctgggcaaggtttccagcttcctcccgcttcagcccagggtctgcgtcttccttccttccttccactctcttaatgtcttcccttcaaatatctgctcagagtgtgctggtagtccctctatgggagatgctcttcctggctgcatctagtcaactatcttaggtcttctccaagattcttcaatgaatcattatttataatattaaaatactagaaagagtcaaatgtccatcaagaggggactggactgattaaataatgtatccttacacaatggaatactctgaagatgtgaaaaaggcataagccatatctctataaatctattaattacgtaggatatattatggagtaaaaacaaagtaatgaaaaacttgtacactatgctaccattatctgaaaacagagtatgtgtttgtgtctagatatatttttaaaaaatcaatggaatgctaaattacaaagttttttttttttttttttttgagacagagccttgctctgtcaccaagctggagtgcagtggcgcgatctcggctcactgcaacttccgcctcccaagttcaggcaattctcctgcctcagcctcctgagtagctgggactacaggcacgtgccaccatgcccagctaatttttgtatttttagtagagacagggtttcaccatgttggccaggatggtcttgatctcttgacctcgtgatccaccccactcagcctcccaaagtgctgggattacagctgtgagccaccgcacctggccagtgaatgctttaaatgttttatacatacataaatattatatattagttatatgaataggtacaagtaattttcgaacacagtaatcttttctgaacatccttaatgacaaatagtctaaagacaaataaaacctgaaaaaacacattaactattctctgtaattcttattgttgatggtagtggtgatattgtcattctgagaccattgagtgtgtcatataggataaagcaaatatatttgtgtcattaacaaataggaatttcaacatgagaaaaagtagctacaaacataaggttaattaagtaaaattaaagttctgtcttcctgaatattaattgaaaatactggtgtgaacctatgatgaattttaccctaaaacacaaattatttcaagggttccttaactctgtcctcagcaaaggcctagaactaatgagtagtactagaactactactaacctagtagtaatgagtactttagtgcccatgttgtggtctctaaagatgattttccactatatggaaagtggggttcctggagaaaggactgattccaaagctagagcaagaaatttacaaaataaacttgaactatcttgttgaatcagaaaagaaggaatgccaagatcatgccaaaggactcactggccaacctgaagagattcccactgccctgaaattagacaattagagcatcaatagaacaataaatacaatcacatcacatgtattaaacctatggtttataataatattcaaacaaacaagcaaactcattggccaactttggaggataatatgcaacaaagtcattattttgaaaacgagtacgtaaagggaaaaaaatcaaattttatcctgctttttctatataaattatactttaaggtaactaaatgactaatgaggataggtttctctgtatagaaatacagaaatattccagctaataaaacagaaaggaatgatagaatttttttgtaaactataatgaattaatggatttaggtaatgattaataagggcttctaaaatcacaaataagaaaactaaccaggcaagatatacctttctatggaagtgcaaaaaatctatcaagtatgcttgacaaaataataataataaacttattattattattccaaatcgactctaaatctaactaccaatttactgaaattacagaaatatataaaatgacaccatagagatgcaatcagcaaaattcagtttctacaacaaataaattgcaagagtgggaaaaaagtaatggagagaagccctatagattaaaaaatatttgagaaacatagtaaccagtggcaatgttgtatgaagcttatttctaatgtgatgcaaaacaaaaacacactgaaaataaattacgagacaactgggaaaatttgaacactgacaatacttgatgatatttaaaaattattgttaatattttaacaatattaatgctaagtgtaataatgaaattgtagttatattaagaattcctagtcaggcgcggtggctcacacctgtaatcccagcactttgggagtctgaggcaggcagacagcttgagctcaggagttcaagaccagcctgggcaacatggtgaaaccctatctctgctgaaaatacaaaaattaaccgggtgtggtggtatatgcctgtaatcccagctacttgggagctgaggcaggagactcgtttgaacccaagaggtggggtttacagtgagccgcaagatggttccactgcactccagcctgggcactgggaaacagagtgagactccgtcaaaaaaaaaagaattcctatctttcaatgatactaacatatttacaaataaaactatgtctttattttgctattaaatgacctagtatgttggaggaaagtaaataaaggcagaaaggaaaaaggtaactggaactggtgatgtatatattggaagtagttacataactctattttggtgtacatttgaaaatttccataataaaaaggacaaataacattgaaatctttactattagcctacaaggacctgtataacctggtccatgcccaccctcctcatctcatcactcttcccttgctcattctgtaccagtgactttgacagcctttctgttctatgaatatgccaagctctttgtctagagaaatatgtaaagaaataataacagaattttccaaaaattttgaaagacatcaaacaaagatacaagaagtgaaaggaggcagtaattatttgccacttttcaattaattctaatatccttagcttgttaaggcactccattctgtgaagaccttccactccaaacccaacctaaatctgcagttgaccacctgggtggacttcaatggagaataatctcctcaatcccatcctgactgactgggttttgcatcatctgtgtgaccccagagaccagcattagcaagcctcaagttagaagtttttagcaaatgtaggttctgtgatgcctttgagctaaggtgcactagatgataggggagtaatagttgtttcttatttaatttgatgtggaaataagaatggaatgaaatggctatcaatacaatttcagaagtcttctaaaggcactgtcttccttgatggttcttattgcaaggcaactgatctgaagtagactgaagagggaggctggctttagaaacagagactaaaaagtggggacactgggccaggtgcagtggcttatgcctgtaatcccagcactttgggaggccaaggcaggctgatcatgaagtcaggagttcaaaaccagcctggccagcatggtgaaaccccatctctactaaaaatacaaaaaattaggctggcattgtggtacacgcctgtagtcccagctagttgggaggctaaggcaggagaattgcttgaacccagcaggcagtggttgcagtgagccaagattgtgccactgcactccagcctgggtgacagagcatctcaaaaaaaaaaaaaaaaaaaaaaaaaaaagtggggacatctgagttacttaagagtgaagaatcaagagaacttaagtgaagtacaaaagaacaacaaaacaaaacaaaaataagaataggaaacagagaagaaaatgactgcaaactagattctttaatccccaaagattcatttataggaacacaaaacaaattttacttttgtgttcagggccagccataaagatccgtccttaaagagagtgagacgaagggcacattgcaacagaaaggtggatgcatacagagttatataattttgcagccattccacacaccttggcaagggccgatggtttcaaaatccaagaatagctccacatgtgatctctgactgattgggaagaggaatatgcctggcatggcaagagaagagcactcccaaaaatgatgagcaagaaaatcattttctctgctagaaataggtcagagaactttccagtgatgagatctggagattcagaaatcaatggtggtcactattttgctgctttttaaaaggcagagggctgttaataccattcatctcatttattcaaacaaacacattatttgaaaatacattgttttccaagccctgtactagacacagagaatacactactgggcaaaagaggaatggattctgaggacaggtagagtatcccttctttctctatcagtaagtcagttctccagacctatttactgagaggccagacaaaggatttttctaggctcacctttcttagctgcctcttctaacaatccctgtgaagtagagtttaaagttgactgagtccataagagattaatgtacagtaattaaggatgtaaaacaatgttctccaatggccagaattctttactctgcagaatttatgatatatggcaatgaaaataactaaaaccttcaaaaatttagtactcaaaacaggacaaaagagctagatgaaacttgtctgctttaccaccactactatagtcactttaatcccaagataggtaactcaagattggcttcagctgttttgtctaggctgaagggcaatttatattatgaaaaaaaaatgacagtatcaaagaataagttcagttgtctgctttattccataaatataaattaagccattaaaagtaagttagctcctagaaaatgagcagctttttgtctgtgaaaactggtatcaaaattaaagaaacaggaaaaaacagccccacttaacaaaaaaagatacaatatccaagaaccattaaatgctcagattatgagtagatacttttcatccagaattgatgaccaagcatgggtcaggctagtcaaatactcctgaggttcccagaacatatctgggagcagaatatcccaggtaagtgtgaaagcaatgtgccaacaaagactttcgttcctcaaatgccccagcactttaatgttgaattgtgatttttttctactctcagctttggccttgtttttgtgcctgtacctgcttcagacagatcttcacaaatagtgcctttggtcagttaaccataggtggtatgaggtctagattgcgcaaaactaacaagaacttgaagacaactatcttataaaactgaaatcaaagggcttaaaggacattcagtttgttgataaagtagatatcaccttgtagaaactcaaaaggccatatataaggaacatgaataaacatttttatttatttattatttttgttttttgagataaagtctcacttactctgtcacccaggctggagtacagtggctcaactcactacaacctccgcctccccaattcaagcgattctcctgtctcagcctcccaggtagctgggattacaggcacccgccaccacacctggctaattttttttttttttttttgagacggggtttcactctgtcgtccggactggagtgcagtggtatgatctcggctcactgaaacctctgcctcccaggttcaagcaattctcctgcctcaggcctcccaagtagcagggactaaagacgtatgccactatgcccagctaatttttgtatttttagtagagaaggggtttcaccatggtggccaggttgatcttaaacccctgacttcaagtgatttgcccaccttggcctcccaaagtgctgggatttaggtgtgaaccaccgaccatgcctggcctgatttgtttgttttttgtcattgagattgggaggagggataggagttggtgtttaaagatatcacctaatcatttccttgcatacacaggaaacataaaacacaattttccctcatgttggaagttgagtgctctcagggcatagagtgaaggaaagtcctcattttgccctaagcaaatgtttcctgggtatgtggctccaagggaagatgccaatgctaagttctctaagagtactagcaaaatgcttcttgcacatcataactgcttcatagctatctcttcagtactttttccctggtgatccctaaccaaggctcccacaatgggagcatcagagcttgcacattggccttgcagaagctataccaccaccaccaccacacaaaagacttggattaagatcccaaatgcctcccccaataagagccgtttcaaatctccaaactattgtctttattatcatagtttccataaacaaccgtaattaaatgcatactaggtactagtgttttacatttagtaacgctaatcttcagaattttccagtttataaaagagttaactgaggcttagaaggtttaagcaatttacctaaaactacaaagttagcaagtagtggagtcttggttgaactatatgtctcagtcttaaacttatcttcttagtaactcgacgtctaatgagaagataagcaaaacaacaattttaagcttatgaaaatcaataaaaaatcataaattaacagaaaaatacaaattttcagcactgctgctacattttccagttccctttgtctctagctgtgaatgatttcacggaaagaatagagatgaatacgttcggactgaaatagaaaatgttggaagcactcatttaacattgtgcacagtatttctagagaacttccagcaggtggcagtatttaagaacattactggtagtcacaactttggcagctattgctgcaaagagagattgggtgtcaaaagtctttttttttttttttttgagacggagtctcgctctgtggcccaggcgggagtgcagtggcgcaatctcagctcactgcaagctccgcctcccgggttcacgccattctcctgcctcagcctcccgactagctaggactacaggcgcccaccatcacgcccggctaatttttttgtattttttttagtagagacggggtttcaccgtgttagccaggatggtctcgatctcctgacctcgtgatccgcccgcctcgcctcccaaagtgctgggattacaagcgtgagccaccgcgcccggcccaaacaaaagtctttaaacttcggcccaaacttgaatttccagttattttattcattgtccttggaaagtttcaagagctaaaacattacctttttcttataattgtttaatttgaggttcactttaacttgcagatatggaacagtggtttcaataaattacagtaaatttagttaatcttactttggaaattgtgtaaggtctttgatgttgttccaaatatcagttccttccctggaattttgtggcctaagcctcagagcagtattcaaatggctgttattttgtattgtttcttaaatatctagaaaatatgtgaaatacagggtcaggctctgttgacaatgcacaggaatcgttcaaaaggcttacattatatgcttggcctagaaacaaacagaacagtttgccacattttcctaacagttaaaacctcttgcaaactattccacattcagcatttctctctgctctgcaacactcatccctcagtcctgtttagcaaaccatataccttctgtgatcatcactgttgttcccacttccatccattacactcattctcccatttaaaaaaatttcttgctttactctttttcaatccatgtacacaccttgcttcaaaatactttttacgaaacattccctaggcatcattccttgactgcttctgtgttcttcttttgcaactgtgtattttcttggaatgtataaaatcaattttcccataatgtacatgttgtatatgtttatcttgcaattttcagttgaacatgtgtcataagtataggtaagcaagaaggaagattttaccaaagaagagaaagttgtcagttcattaagacaaagtccattatgttttcttttctgtatggtatctctcagaattaaactcatccattgtattattttcttcctgtcagtttcattgccagagtcataataaacttgaaatgctctgacataattaactagctggggaaaggaagaacataactgtcagttaatttaggaaatgactatgcttatcattgctcagataatgtgtttgtgtctcacacacattctcatttccctttccttgtaggtacatcgtgacaggcagaaaaaatcaatcttctgttagaaatagttctgtaacttatttttcaaacaaactaaaaggactttaaaaaaacagcattgaaagaaactaagtgtggtttaggaagaaaggaaatacatttctaacccaatttatgcagtatagttttcccccaagattacctacttactttcaaatacatgctaacaggctgtgtttatacagcccacacatagatgaggaaagcttacacagtaaactccccagcttctgggaggactttgtggctcagtaaaaatgacagaaggattccatggaatgatatagctctatatcctaaacacctttaatccaagggtttatatgaatttgtacaatagctactaggtataaaaatagtgtagtctatgcgtcctggaataatcaaccaatatgaagccaccagaaatgtattcagctggtaaatgtattacccttcagatgggtaaagtgtttctcatgcattggcagtggaatgctcaatgtttgggaatggctggaataaataagaggtttttttaatccttccagagttatctgtattttaaaagtttataactaatgaagtgtccatgtcttgagtttgtgtgcacacgcacatgtgtgtgtgtgagagagagaaagaaagcaagaaagagagagagggaaagagaaagaaagaaagagagagagagagatcctttttgggaaaccactgatgaggctatctggactctcaccctgggaaaatgtccacatgcatatacgcacaattttatataaaattcagaggttttatgggtttactcaaaggttagaaagacttacatcaattgacatgactttaggcagtgcaaaagttaaactaaaactcttcaggaaataaaaatattaggcacataagacattccctggtttaaacacataacacacacacccaccacacacacacagccagagttcttgaattcagttaggaagatgacgcatctaaagtcatcattagctacctcacacaagctctgacaactccaaattgctcctctccctagtttacagttcggcattccagatctcagtgtttttgctcctgctcacctcctctctctcctaattcagctccaccttaagagcacagaccctgtctttcagaaagcctcacctggctgcctaaaccctttctgttcacagcaaggccagatgccccagatatcgcctgcacaataacacatcatttcatgttgaaaccggaaaagttcccttgtcccccatgcagggcatgagatgggggtgtggctcactttttcaggtgctcttttattttagccatctgtaggcagcctgcgttagctcaattagactccctgccttatctcaaggacagaaggctttctgtaccctggggtttcttgccttggtgtacccgaagaattggatctcacgtgggcttggagaatgaatgcaaggttttattgagtggaagtagctctcagcagatgggggagccagaagggagacagagtaggaagatggttttcctgttggagtcaggtcactcagcagccgggctctcctctgaccaccccgtccaaaccccacgttgttccacctgtcgatggcctgctggtgcctgtcgatgtgctctcgacgtccagctgcttgtgtgttcctccgccagtgtgctcctcttgacgtccagctgcttgtgtctctgcctggtagggtctcagggggttttataggcacaggatggggacgtggccggccagggtggtcttgggaaatgcaacatttgggcaggaaaacataaatgcctgtcctcacctaggtctgtgggcgcaggcctggggatggaaccctagccgggaacggaaccctagccggggaccatagccctcctctacctagcacttccctgctggccttccgtatcaatagggcctctaaactgtgagcgatttgagtacaggaactctgagttatttaattctgtgtcctcagatcttaactcagtgcctggcactgagaaatgtttttgaatgaataacagtgcacatatgcgtgtgatacatgcactcagtatttaaattcaggtggcttaaagttcacaacccttgactttgtgttcaagagaacttgaaacaataccacagcctttgaacaagcttgtttaaaaggagcaagtactcatgaataaattatcttctgtctcactttcagcaaagtatactttgaaaggaaatgggccagttcccttataggtgagttctcaagtggtcagtttttggtatgtgaatttttatgataaatatttccctttccttttcattacactattatcgttgtataaagaagtgtacctgtctgtggcataaaatttaaaagatatcaaaagataaacaacacaaagtaacctttcttcctccccagaagcaaccatttgtagtattcattaacctttcacacagagtctaggcatattaaaaaataaatgacatcttttgttacattttaagacatacattcagagaaatatttctcaatatttgacagctgccataaggaagaaatagcatgtagaggtgcttcttcagagacaggctgagtctaaggtgcctgtaaggattccaggcaaatgtatccagaagatagctaaaatagaggtctgagactcaggagaaaaggtcaggtggtagccatcaagggtaacaaactgttgatgccactggaatggtgtaatagctcaagcaccatagactgtgggtgagatgctggcatcacactaaatcctaggaaccaccaatatttaggacagatgcaagaagagctaataaccaaacccaggaagtctaagttagggtcaccctaacggcagatttaatagcagtagattttcaaaatcaaaggaagagaaaattttacactctactctttaaattacactgatatgcactaaaaaggccagtattgtgaatactgaaaagagaaagtatcagtagttcagtgagatgaaaaaaaaaagtatccatcaaatacctattgacgattactgtgtgctaggaatgtgggaatataatagggaatggtactgtccttttacaggttcgaatttctgtgaaattgtaagtctgcaggcatgccctaagatgatctttcttccacatggctggtggaacattcaaagtggagagatcagtctcaggttgccctgatgtgaatcatccacttacacttaggaagattttgaaagccttgtaaacatgtattttctaacctgttcaaacttgggtctaggaagagaggtcaggaatgcatcaaggtaaacatgcaaaacatatcaaagaataggaggaagagaaggaggagggggagaaggagcattgccaacgggtctgaggcttccatgttctcatatcatcttcattcattggtctgtttaacaaaaaaggaagccattgtaaagatatagaaaaaccgaaacatttttcctactctctactgtccacaacacaatccacatggaacacttctgtgacctctggtctggtctccaaaatgtgtgaggatttctcttaaccagcaatgaagcaattctgacaccaggtatgtgtagattttccccacgccacaagcaaacaagcaactctgcagcagaaaccagctgagtgtcctttaattctattcaattctgagactatttgcctagagatagcatcagatcccacagaatgagggctcagtcccacaagactgccctcccacttccgatgccaaccaaaagccccaggttattttacccgtgcttctgagcaactggctataaatcaggattcccacgctccctcctcaggtttgattaattcgttagagcagctcacagaactcaggtttatttaccagtttgttattaaggatattacaaaggatatggatgaagagatacataaaacaagccatgtgggaaggagagtggagcttctatgtcctccacagtcatgccaccctccaagaacctggaaagtctcagaacccagtccttttttgtttttatggagccttcattacagagtcatgactgatgaaaccattggtgatcaactaaaccttcagcccctgtcccctccctggaggtggcagggtgtggggagaaggctgaaaaattccagccctctaatcctgccttggtcctgaaactacctaggaccaccagccaccaatcaactcattagcaaacaaaaggacacatcactttggagattccatggattttaggggttgtataccaggaaacagggaagaagaccaaatacacacttcacaatatcacaaccattaaattatttcctataatatgtcttgaactctttcacacactgaagatacagagatgacagatgagcctctagaagtttgcagtgtacaagtaaattagcagactatacctgctgatattgagaggtgacagcgcactggcagccctcacagccctcactcgctcttggtgcctcctcggccttggcgcgcccaccctggcctcgcttgaggagcccttcagcccaccactgcactgtgggagcccctttctggcctggccaaggctggagccggctccctcaccttgcagggaggtgtggagcgagaggcgcgagcagaactggggctgcgcagagtgcttgcgggccaacgcgagttccgggtgggcatggattgggctggcctgcactccgagcggctggccggccgtgccggccccgggcagtgagggacttagcacccgggccagcggctgcggagggtgtgctgggtcccccagcagtgccggcccactggcgctgcgctcggtttctccccgggccttagctgcctccccaaggggcaggggcaggggcagggcttaggacctgcagcccgccatgcctgagccgcctcccccacccccacccccacccccacccccaccccccagctctgtgggctcctgtgcagcccgagcctccccgatgagcaccgccccctgctccactgcgcccagtcccatcgaccacccaagggctgaggcgtgcgggcacacggggcgggactggcaggcagttccacctgctgcccaggtgcgggatccactgggtgaagccagctgggctcctcagtctggtggggacttggagaacctttatgtctagctaggggattgtaaatacaccaatcggcactctgtatctagctcaaggtttgtaaacacaccaatcagcaccctgtgtctagctcagggtttgtgaatgcaccaatccacactctctatctagctactctggtggggacttggagaacctttgtgtggacactctgtatctagctaatctagtggggacttggagaactttgggtctagctcaccgattgtaaacgcaccaatcagcaccatgtcaaaacagaccactgggctctctgtaaaatggaccaatcagcaggatgtgggtggggccagataagagaataaaagcaggctgcccaagccagcagtggcaatccgctctggtccccttccacactgtggaagctttgttctttcgctctttgcaataaatcttgctgctgctcggtctttgggtccacattgccttcatgagctgtaacactcactgcgaaggtccgcagcttcactcctgagccatcgagaccacaaacccaccagaaggaagaaactctgaacacatccaaacatcagaaggaacaaactctggacacgccacctttaagaactgtaacactcaccgtgagggttcgcggcttcattcttaaagtcagtcagaccaagaacccaccaattccggacacagtatgagtaggtatagtgtgtcccaccgctcccaggggccccttttacatgcacaagtgcacaggccatggcccagacagatatatgtagaggcaataaaggtcacccttccccgttttggggtaaagaaatgatacagggaattttacactaggaactattagtcctttcttggttgcagttatagggcatatcctgccactttatctaatctgagctctacaacaatccattgctatgtgtagagatgaggaaggttaagaaagatggcaccatctattcactgtgacatagctaatcatgggaaagcctgaatttgactccagacactctaacagagaacatatacttgtgatcatcacccttgctgcttcctatagttgcctatcaccttgaccaaagcatttgggattaaacaatatgattcttatttatggggtggagtgaaggcagtgagggtagagagccaaagataaggtttgagactctttagaaacttagaacagttttccacaaaatgtgtactttggaaacctgtatcagaatcacttggatatttattaaacacacagtctcttgaactccaccccatacccactgattcagaatctttatagggtatttaagaaatattagtttgaactgtgatacaatagtatttaaaattccactactataattacaaaatattgaatgtagtacagtttaaaggaaaattcagaatttctgaaaatgcttctaaatatgcaagaccatgcagtcaggctgcatcttcaccatctaaagcacctattttatatagggaattgagaattattcacaaggcttgattatgtaaaaaggctctggggccaccatagaaacaattctgggcttgccaatgtaaacaactagaaaactgaacaagacgggagaaacaggtttttagacattataaaataggcacaagaatgtgatccttgaaaactaggaaagaagatgatcactataattgccttgactttcttcctgaagggattttttggaccacattggaggtataagtccaagcagaacactgcagtgtcattgagttgaaaagacagggactagagttcagaaaagctcaggcagctggaatgtgtggggtgcacataagacaggagggcagcaaagaaccattgagaggagctgtaaacgaaatgtttctagaacccaaagggaatccagagatattcaaactcgggtcagccattagtgtacagatcctgttgaagacccagggtttcagtacatcgcccagaagtgtaaaccttggtaatacatataagccagtcatagagcaagaccactctagacctgctctaacagtttaaaaacaagcctccacagcatcaagctgatccacaagtaatttaaatgtctgtcaaacaaacttccacactctttataaaatacagtaaaatctagatacttaactttcagaaaatggatgagaaggatatactttccaactcgtcttcaaaggccagcattagccttgtaacaaaatcatcaagaagttaccagaaaactacagattaattctagagatctaagatgtaaaaattctcagcaaaatattaacaagtgaaatccaacaaaatactaaaatactaccaccacgtggccccacaagtagggtttattccaagaatgcaaggttgtttaatatttgaaaataagtcagtgtaatcaaagataaatactaaatcatcatattaatagatacatataagatgtttgctaaattcagcacctattcttaataaacaaaaataaaaacaaaaacaaaagcacccccactgaatttagtatcatacttaatactgacttaagggctttctccttagattgggaacaagagatagatgtctactctcctaactgctactcaataaaagtgccagtgcaataaaggaacaacaaaaaaattaaaaggcatctaaacaagtctggattgttgaagttacacatgggagtcacataagtaccaaacaatggcatgcttgaggaatgcactgttgcatctcagtggtctggggattcctaagagcaagtccatacccctataagtgtggggatgaggtgagggctctctgtcaacgaatgagactttatccccacctgcaattactccctaaataatcggggcaggaaatggggattttaggggctcagcttagacagtgtagaagaggaaacaccttcctttctctggagtttgtgaatcagtggcctggctgtgttcaaggctactcctttttggagggaagcagtaccctacaatttgtagttgggtccagagctaagagtgacatctgcaggggagcttgcatctgtggactccggtgtggctatctataggttccagttttaggctttctgtgttataattcccttctgttcttcttaaactatctgataaattttaataaacattatagcctaatgtctgctcccactggagagaatgatctgttatcatgcttgaggtgaaacaggccaaggaaaagcaagtggcacttgggagaagctggtctcaaaatggaagaggggacctgcaggagaatgaagcaatagactgaagccctaccactgatggagacagggagcgataacaaggactgatttgagaaacactgtgcacattacccaggagttcccaaacacagctggaaagcagaaaagtggaaaaatgactaaaatgtctttggtcttatgggatagaggctctaactgttgaaactagacattaaatggaaatgtgacgtaataagctaatgaaggctaaaactcttgggccatgagatataattctggagattccatgcatagataccactaagagacacaaaagggcttgtttttactttgtttttgctttgccaaaggccaaaaggagaggaaagaaaaccataaaagttatggttaaagggagcctataataattctgaaagaaacaatcccacataccataattccaaatgttgaaatcttaaaaaagatcaaaatcttgaaaatataattctggtaaagataatttaaaattatttaaataacatttatttatattttaaaaggatatttgagaaaaaaaagaatatttcatagaccactttacataataaagtaaaatatttttattatgtaaaggtctattgtaattattttattgtgcaaagatctattgtcatagaccactttacacaataagatatgtaaaatatacatatttttgcaagcataaacactcagctatagagtctcacgggtacaacagttatgagcagaaaaaccatattcataaagaaacaggtcaaaaagcaaaatgtataaatgcatgtcaccatggttggtaattgtgtgcacttagttttgtaactacagtcatctgaagtaccgtgaaggacaacataagtcttttgacaagacgaatcaaagattgtgatgggttgccaccgcatttgcagtctcccaaagagccgagaccttgtgaaattttatctttcacaaatgcatatgtacaaaaaggacatcttttcatttatagaggaagcttcaatgtttttatgttgagaaccagggaagcaaaggtacctctcagtctgagagcgtcaggacctgggggaccactgatgtaagttctggagtccaagagccagcaagttaggggttctgatgtccaaggcagaaaaagaaaagtctctactctcaaagataccaatttgccttctctatctattctctccaagtccctagctgattggatggagccgccaacattgagggcagatcttccccacctacaccacacaggctcacacagcaatctcctctcaaaacatacttgcagatactcccccagaaaattctttaccaggtttttttggtattccttaatttggtcaagttgactcccaaaattgagtccacaagttcaccccttgtcaacttggcacccacatgcatctccttaatcacccacacttaatttttttttttgagacagagtctcactctgtcactcagactagagtgcagtggtacgatctcagctcactgcaaactccacctcctgggttcaagcgattctcctgcctcagcctcccgagtagctgggattacaaggcaccagccaccacacccagctgatttttgtatctttagtagagatgaggtttcaccacgttggccaggctggcctcaaactcctgaccttgtgatccacccgcctcagcctcccaaagtgctgggattacaggcatgagccaccacgcccggccactgaattttcaaataagaaaataacaagataatagttccaccaaacatgatgtcgttataatgtgatcgtgattttggggggattttagacttcagggatttggactttagggattttgatttttcgggatttcaacattcaggattatggtattcaagtctttcaggattatgatccaaactcatgagaaaacatcaaatttattagttcagaacaacaataatacaggcacacttggtttctcaagtcacctgcttggtcctccttccaagtgtgcttttcttcctttctttctttccttttcttactgttctaaaggtttctaataaagttccactcctgctctaaaacttgctttggtctctttctttgccttgtgaccctcagtcaaattctttctaaaaccccccacaaaaaaacaaacaatatattttttcatagaaagtagaaaatctccttgtctggtagcaaaactgtgatttctaggttattaccagctgtgtgtgtgtgtgtattgaccatgctctttcactagctcattatcttcagtactgcatagtggttaagagttctggttctgggatcttggaacttgacttttgggtttgaattttagcatcaccacttagtagctttgtggtcttagccaatttatttgacctctcggtgcctaaaatttaccaactgtccaatagggagagttttagcacctagtttaaaaggttctcatgaagattaaacacgttatcatatgctaatttaggcaaagcacctagcacacagtaataaactttagtaacttttaaactcagtaaattttaacaatttttattaaattctaaaccagtaagaaaaatatacatacaatgctatattattcctcacatgatctaagagacccaatatttgaaattaggaaatataatttgccaaaagtaaagctatcattatgaacagtaagttatttacatctgaaaaggattggttagaatcttattgtttactaacaaaatttcaactatatcttttatttttaggttgtgggagacagaaaggacgcatattaatatgttaaagacaattacccctaggcagaggaatcggggtatggggaaagtaaggacttttgctttcttacaccttcccgtattttttcaattctttataaaagatcatgaattatttggagaataaaattaagataattaaagtgagaggatctgacagtatagtatcacttaattagccagaagttggattgtaccttctgcctctggctttacaatgcttcttttgccccgttacactgtaatccctattcattaaatactattagacatttgtctcaaggtcaacatcatgagtacacttttgactacaccaccaagattaaacagagccattcaaagcacctagtatgacatctagccatagtagatgtcaataaatattagctcccttatgttctactccccagtggcacctattttttatttaacaaatttcattcaagtaatatcagggctgggagtgatggctcatgcctgttatcccagaactttggaagaccaagccaggaaaatggcttgaggccaggagtttgagatcagcttggacaacatagagagacccccatccctaaaacaaaaaacaggaaacaaaaaaatcaactacaacatcagaactctggattttaggggctacttttggttcacctgttttcaaattgttttttgtttgttatcactttttattttcttttttgccataggccaaaatcagagaaaacaaaaagagacactaaacttttatatttatatacacaaggcttttatatttaaatacagatgagtgaagtgttccttgtcatatttctgcttaggaagccccaatgagcatttggagagaagggtaaacacagctgcctggaaatggcttttagaaacccattaagctgactgatttcaaccactggtgatggatgagggtaggaacaaattccttcgtggtacacgagaacactgcaagaagttacattttaacctgtctgaaataatgagtaagacataataattaacgtaaatgctcaatccactctcagaatgcctgaggcaaatgttctctccaacgttttctactctaaaagtaaaataaactcctgagtccactgatattgcctaaaaacctaggtagtgcctgatatatttttaagtatttttaatatttactttctagttagaaaaacaatctatccacaatgcacaaattgcttaacatgaataaatgtgtatttttaaaaaaatactcatattaatattaaaattgctaaaatttgaataaggtccctagtttagcttacagtagtgtaccagtgttcattttctgatattaacaagctcaatgataaagtaagttgttattatgggaggaagctgagtgatggatacatgggaactcaccaaacagttttggcaacttattctgagtttaaaattaacacaaaataaaacgttttttaaaatcacccttacttttagtattttgatattattaaagcaaactaaatatggcccgagaaagactccatacttctatatttgagtccttgtggatgaactgtaacctagcttagtagtcagacaaaattgaaaacgtaacttcagagtatgcatctgtaactatagctaagtcttggccattccagaggccatacttcaaccattcatacactgatgagtgttaaaactgtgttcaaataaggcaaacaccgagctgtaaccaatccagccattctgtacctcacttccaatttctgtacgtcatttccctttttttttgtctgtaagtcttcttccaccacatggctgcgctggagcctctgtgaatctgctgagatttgggggggctgcccgattcgcaaaacattcattgctcaattcaactcctttaaatttaatttggctgagtttttcttttatcagtattgaaataacaatgacattgtaatttcaaactggtcaaaataatacatcagttaggacctcttttatcgtcagtgaagtttgcttacctaaactagcctagggacgaggctgcattatgttgccttttttttttttttttttttttttttttgagagagagttttgctctgtcacccaggctggagtgctggagtgctggagtgcagtggtgtgatctcggctcactgcaacctccgcctcccaggttcaagcgattctcctgcctcagcctcccgagtagctgggactacaggtgcccaccaccacccaccatgcctggctaatttttatatttttagtagagacagggtttcaccatattggtcaggctggtcttgaactgaccttgtgatctgcccgcctcggcctcccaaactgctgggattacaggcctgagccactgcgcccggcttacgttgctcttgatgcagaaactcgaatgccatcactggcttctcttttgctgtctctcgtcttattccccttgtttggctccagttttagataggtttttcctttgggaagctttgatgtatttaaggagaggaagagatgagaggatagaaaaccccgaggctgttttcagaagtaaagtgaatagttgctaagtagagaaacaaaacaagaagaatgctcactttggtagaggagcagataatggaaagtttaaaaaatgtgaaagtatacacaaccaataatcatagttatacaaatttataacaaaacatcactttttttcctactgcctctataattgcagaagagaaccaaatacccttttcatctgacaaactggacaaataaaatttagtaatatgcaatatgatgacagtatagtaagacatatgcagatggggtttggaatcaaagggtacagcccttccaaaaaactgttctactcttttacccaggaatttcactttcagagacctacccaagcaatgacaaatacagatgactacaatgtacaatgatatctatacaacattatttatcatagtaaaaagcataatgtctcaaaatatgggaacagttaaatacatcatggtgtttctgaatgattgaatatttagtaaccattttttaaaaggaaacaaatctgtataaatctgtatgttaagaatgatccggcggggtgcagtggctcacacctgtaatgccagcactttgggaggctgaggcgggaggatcatctgaggtcaggagtttgaggtcaggagtttgagaccagcctggtcaacatggtgaaaccctgtctctactataaatacaaaaattagctgggcatggtggtgggtacctgtaatcccagctactcagaaggctaaggcaggagaatcgcttgaacccaggagacggaggttgcagtgagcacagattgcaccacagcactccagcctgggtgagagcgcaagaccctgtctcaggaaaaaaaaaaacaaaaatttaaacacagagagagagagagagagagagggagagagagagtctgcttactagttgtgtgatcttggtcaggttattgaccttctgtgattcagtttccccatatccttaaaataagaaaaataaaagtacccaccacatagggttgaaatgaggattacgtaagttaatataagtaaagtaagcattacttatacttggttcatgtgagcacattattacatgcagttaatgcattgcatgcctggcacatagtactattttcaataaatgaaagctttacacaaatcatataatacaaattcctggatgtgtattgctttgcaggactctaacaaaactttagtcaagtgaactctagggttttctagcaaaaaaatctcagtaataacactttccacctcacaaattaatgtatatttaaaggactagatactcatgcatattttaaatgagcacagggagagaaaggaatcagcagctggactttcggactacaactcaagaagtcagaaagaatgagtagttgctctgaggatcaggactggggatgagagagaggcggcggactgtttttttttttcctttatttattttttttgatacagagtctcactctgtcacccatgctggaatgcagtggcgtgatctcagctcactgcaacctccacctcctgagttcaagcgattctcctgcctcagcctcctgagtagctaggactacaggcaaatgccaccacacccagctaatttttttttttttttttttttttgagacaaagtcttgctctgttgcccaggctagagtgcagtggcatgatctcggctcacggcaacctctgcctagggagttcaagtgattctcctgcctcagcctcccgagtagctggaattacaggcgcccaccaccgtgcttggctaatttttgtatttttagtagagatgcggtttcaccagcttggccaggctggtctcaaactcctgacgtcgtgatccacctgcctcggcctcccaaagttctgggattacaggcatgaaccgccgcaccccgcccatgcccggctaattttttgtatttttagtaaagacggggtttcaccatgttagccaggatggtctcgatctcctgacctcgtgatccacctgccttggcctcccaaagtgctgtgattacaagctggccgggactgtttgttttattaccagcatttgcattctgattaaccttttattttctaaaacataaactaaacaaataaaaaaaaatctgtgttttgaaatgtgtacagctagaacatagaaaagctactatctccttcaggatctctgatataagaaagtaagtatttgcaactgcagtccttggcaccagaaaggataatagttcatggttccaggaaggggaaatatagatgccatcagacgacttcacacaatgcccagagaatgtagactaggtgcttctgttcccagaagcagcacccagacaatgagaagaacaccatgtggaaagaagtggggcagttctggtttctaatgggctctgctgatctttcagctcctctgcctgaaagctcactttcagacaaaaactatgaacttcaaactgtgtataattcactatacatgcatattttattctctgtataactctagcaaggctgaacccctagcaagtcaaaggcttacctgaggtgcccttcccagatttatcatgtcccccgggtagtgcgtccggaattggtaggttcttggtctgactgacttcaagaatgaagccgccgaccgtcgcggtgagtgttacagttcttaaaagccgtcgcggtgagtattacagttcttaaaggcggcgtgttcggagtttgttccttctggttggttcgtggtcacactagctcaggagagacgctgcggaccttcgcggtgagtgttacagctcttaaggccgcgcgtctggagttgtttgttcattcttcttggtgggttagtggtttcactggcttaaggagtgaagctgcaaaccttcgcggtgaatgttacagctcataaagacagtgtggacccaaagagtgagcagcagcaagatttattgcaaagagggaaagaacaaagcccccacaccgtggaaggggaccacagccacttgctactactggctcgggcagcctgcttttattctcttgtccggccccacccacatcctgctgattggtagagcccagtggtctgttttgtcagggcactgattggtgcatttacaatccctgagctagacacaaatgttctccacatccccacctgagtagctagatacagagtgtggattggtgcattcacaaaccctgagctagacacagggtgctgattggtgtgtttacaaaccttgagctagatacagagtgccgattggtgtatttacaatcccttagctagacataaaggttctcccaagtccccaccagagtcaggagcccagctggcttcactcagtggatcccgccggtaccgggccgcgggtggagctgtttgccagtcctgcgccgtgggcccgcactccccagcccttgggtggtagatgggactgggcgcagtggagcagggggcggcgctcgtccgggaggcttgagccgcacaggagcccagggagcgagggaggcccaggcatggcgggctgcaggtcccgagccctgccccgcagggaggcagctaaggtccggcgagaaatggagcgcagcgccagtgggccggcgctgctgggggacctagtacaccctccgcagccgctggcccgggtgctaagcccctcattgcctggggccgacagggccggccggctgctccgagtgcggggcctgccaagcccactcccacccggaactctagctggcccgcaagcgctgcgcgcagccccggttcccgctcgcgcctctccctccacaccccctggaagctgagtgagccacctctggccttggccagcccagaaaggggctcccacagtgcagcggtgggctgaagggctcctcaagtgcccccaaagggggagcccaggcagaagaggcgccgagagccagggagggctgtgaggactgccagcacgctgtcacctttcagtaggagacagcaagaaagcatctttccataagtagaataaatatagtcaaagtttttccatgacgtttttcagatacccagagaaaacagcttgcaagagcaagagataaaaatgtatgcatattcatagctttgagcctaggtattttttaccgataaactacttctaaacatctgtcattcaagcacattagggacgtactgcttagcacaaactagtctatatccaagtagacaccacaatgagtcaattcacagttattagtatgatttagaatttaactacctgtcttctaaaaagaacagctaacatgtaaacggaaaaaggtactctatgttacaactatctaatgaagggctagacaattagaatcgaattattttgctttttgagacattaaaccctcagttctccttttccccactagtattattttctctccctggaacctttttcttcttcttgttagagatacccaccaaggccagttgctgtccatttacaagcatatattgctattatagtaatacctcacctacctgaagctcagcttcaaggaacttcagctcctcaaactattccgaagaactaggaaataaggaaaatgatgtaaaagaatctatgtatcaatgaatgtctttcaaatcctaactcagggttcatttactcatactgtgcctcaagtttaataggtatctgctgggagatataaatgtatcttgtcagaaatactatgctacttggagatataaaagtgaataaagtaccctcaaagaacttacagtcctaataacattagctaatctggttttgtggctaccgaagaataaagacagcaaaatagaatttacaaagaatcccacagaaaggcacacagatagctgcaagaccaaaattatttttggttctattcttaaatcacagactaatttgaggccagtcactcaaactctaggcattcatttggattagattattttaaagttcctattttgttctccaattctatgaatacagttttaaaacagttcacaatctgacaacaggagactttttttttaaggcatgagaagtcaaaaaacacagcagtatggagtcatttactataggagtgaattactccatcttctgcaacatcataaatattgttgacaacagcccacaggctggaaaagcccagacgggcaacttgtatgttgttatgtttacatcctttatctaatcattttaaaattcattgacttgtttattatctatgatcctccaccagaatatatgttcctcatgagcaggcattttatctgtcttgatcactgaaacagtgcctgtcacagaggaagtcctcaatattttttgaaagaaaaatattctccttttgacaaatattgttttgacaattttggacattaacattcaattttataactacgtttctgggaattatttgtccttatctctaaattaattggtttagccatcattgcctgtatttttatgccataattcccccctttcttggattcctaattttgcttatttttcaatatgttggcatatagtttcccaatgatttttttcaaaatagaatggtatggggcatatattttctggatcattgtatatataaaattgtgttttacacataaaagataacttgccagggtatacaattctcaactatttgagaggggtagtatgctctcctggcatttagagttacatactagagcattcactttgttcaatcagattagaacaccttgtggcgaggaatggaaatgagggtagaggagggaaatagatacctcttttcattttttcctacctcatctccaaagttacacagtaatggggatggcaagaagaggaataagtggaaagatatttagaagtaaagtctaaatatctgacttgcaaagtaagtgaaaaagaaatctagggtaccttctagataacttgctaggctgacttggctattcttgcttcaaacttggatttagggttaatgtaatacttttgagattatcctccaagctcttttcctcaccatcacattttaatttgtaattggactgtatcttcagtcaaagtccccactagctgaatgatttatgctaggagagtttgaggcttatgaattcttctcaacaaacccttctcttagtgattctttactctgaatttttattgtactttaaccaaatttctattgccacttattgtaattgaaataggttgcctacttgtctgtctccaatggactaggaacacctcaaagggcataatcttatatttatgttttttaccaatgcttggcactgagaataaactgaagcaataattatagaattagtggtcatatacaagaaatatgcatttacaaaaaaaaacacttcacatacaggaagtttgtgagatggctatatttgaaagcattttaattataagaaaacagaactgaagccagactcttcagaattcctccaatttatcattcattcatttattcatcaatgctatatttaggtaccaagcactggctgagtgttgaagacagaatgaatgacaacatccagctttggagtcgattagggactaaaaaagaaagtgcatctcacttagtggtcccacatttcccctagagggcaaagcctgaccttgagaccaggtggaattgtaggggaacttcagatggcagggacaaagcctcattggtcttgtcaggcaacgagtaagcaatcattgcgtgtttgttgaaacaggttgaaaaaaatagtcattttcatcaaatgaactttaaaacggagatgatctaaattcagatgtatttttttaagtcctttaaagtttaactgaaatgcaacatagaaatttatttctggccgggcgcggtggctcaggcctgtaatcccagcactttgggaggccgaggcgggcggatcacgaggtcaggagatcgagaccatcctggctaacacggtgaaacccccctctctactaaaaatacaaaaaattagccgggcgaggtggcgggcgcctgtagtcccagctactcgggaggctgaggcaggagaatgtcgtgagcccgggaggcggagcttgcagtgagccgagatcgcgccactgcactccagcctgggcgacagagtgagactccgtctcaaaataaaaaaaagaaggaaagaaatttatttctatttgtactaaatctaatagaacaagagcgttaaagtccagaagagtcggggatgggcaagttttataaataacttggcctccgcattgaagagcctgcgagatgtgagaccagctgagagcggaagcctctggaaggagacctcctcatctggagggtgggggagggagtgtgcacacttgagcccttgtccttgaaggggattgagcgagccgaggggaggggtaggcggtactcggatttccaatcacaatggagaaacctaagaggctgcggtggttgtggggccccgccccctcctccctccttgcagagccggcgccggaggagacgcacgcagctgactttgtcttctccgcacgactgttacagaggtctccagagccttctctctcctggtaggtttcggctcaggaccctgaatcctggcccacaggcaagcctgatgggacgtgcggggtagtacttgtatggggagacgcgggaaggaggaagaagcacatctgtcctccgcggcctttagctctgagcatccggccgcgggccctgactttgccgctcagtttggggcgcagcgggggccgtgccctggcggaggagcagaaggcagagggtagcagctgcggctcagcggagagacttgttgcatttgcagctaaaaccaggccctacttgtccttggtgggttcatggcggccacatcacccccacggcctgctggcgggagtcgggacacgtgcccgagtagctgggggagggggacggaaccaggtggcctatgaaggctggacgatctttacctcgaatatttgaatatattgccacggtaatagagaaatgcccttgcactcgctgggatgaggagaaaggcacctagatgaccagcacgtttggcgctgcacttatttttacccggctctgacggtctttccaggagccatgcgccagttctttgctgcagggcctcttttctggatgcttaggggcttcgtttactttaccagccttgggtgctccgagtaaggaagtcctagacttgtccccacagaccttactcggggagatctctagcttctgcatgccctcgtgatctgctgttctttgctgccggtgccctgaggaaaagatggttgtgcgcaccgcgagcagtacaagctgcagtaagggcctggggaatggggggaggggaggaattcaaaagcaaaacctggatttttaaaagattacggtgagaaagattctgcaaagaagatctttgttcctgaaattaaggcactcctttatttctaatgatttatatccacagcagtgaggagacataagggaccaagactcagagatttttaccgtttgtcgttcttgttccttacagcctgcactctgatgttggcacaggcctgtatatcatgcagaccattttcttctcatttcttaaaactccttttaaggaaaaattgaagaaaagcactttctccagaaatatctgaaagaaaatctggttcgagcctttaaattgtacttcctgaagttttctaaattaaaaggtctatcagaacaacgaatctgtatttatatagccactgtttcttcattttcattttccactgcttcctgggccccctgtataccaaaatggtcgtaaacagaccatctaacaacaataaacttaagtgcagaacaactattcatgtgtgtcgtccttcaaaaagagatgcagcattctttcttctgagcctgtttaaaatgcaggccatgtctgaatttatttcattttaaggtcatctatttgtggaggcacttgcacaacattgcatcttctctctttaacgtccactaggaaactgtaaatgtgatctgtaaaggcgaaagaatctccttttaatttatccttacagatgggaggaaatattttttggaaaaaaaactataagataaaatagttgttacacagttgtctccaaattcagatgctttattccaactttgagtcctgctaactcttactttacgtatacagttaatagactaggcttattgcttagtccattgcagattagaattaaaaactagactgggaagctctggtacagtttgagacaggtatggtgacctcagatgcgacataaaaagtaaaaaacaagtgaaaatcatggacattacaatggactactacaattataagtaataattatgaagaaaaggcttatttgccatctgtattctctgttcaagaagacagggtggtatatatttagtgtactataaattgccatggaattgatgtttatttcgataagttttgctctttttttcagttatctagaaaacacatctggttatctgatggcacaagtacatttggtgttactgtacagatcgttcattttccaacaggtttcggttttgttttgttttttacattttaggggtctttagtttggatggttagacagaaactgtttcagagactgatagtctcctaatgtgatcccctgaaacgacaatgtattaagtgtctatctactttccaagaagcttcttaggtgccctaaaaggaattcaggttgatatttttgcagactttgaataaaaattattcattgccattatattgtcactatgtattaagtatgcattctatgtccagtacgctgtaacacattttatgtgagacagagtagaagaatcagtccctatcttccaagaatgataaccattagtagtagaaattatgttcataattggccatttattctttttatccaagcttaagtatgagtcaatactagacccaaacttagtttacatagttccatatacattcttaatagaggaaacaaacaaattagctaatttaaacaaatgttcacaggtttttagccagaaatattaacaacctactaaatactcacatggaatcataggctgaaggaagaaatccaattctaatgggcttcatgaaagtttttaccttaatgaattcttccattaaatgggtctcatggttcttttttttctttttttccttttgagacggaatcgctctgttgccaggctggggtgcagtggtgagatctaagctcactgcaacctccacttcctgggttcaagtgattctccttccttagcctcctgagtagttaggactacaggcttgcaccaccatgcccagctaattttcttttttttagtagagacggggtttcaccatgttggccaggatggtctcaatctcttgacctcgtgatccaccagcctctgcctcccaaagtgttgggattacaggcatgagccaccatgcccagccgggtctcatggttctttaaaatatattctgctttctagaatatcattaggctcattttaagttgtacttcagttcgaaattgcaacactaacattttaaggatgatttctatttggatttcatatgcagatatatgtgtaatgttttgattctttccttgcagtgcaaaatggcaactcttaaggaaaaactcattgcaccagttgcggaagaagaggcaacagttccaaacaataagatcactgtagtgggtgttggacaagttggtatggcgtgtgctatcagcattctgggaaaggtacatttcaagaacaccatagatgatagagaagttcagcatgtgtacacagtttctttgggcaccttggaattttattatatctttaaaagatttctttttttcctgagcaatttgaagttgtagatgtaatcccacttcactttcaaatatttaagcatgtatctcctaaaagaattatattctccctatgtgaccataaatagttactacacttagagaatttaacactgatgcaatactatcatccagtatacactattaacatttaaaattctccatgttgtcaaaatcatgccgtttatagctattttcacctcagtccaagatcatgtgtctcatatacttacgtctcttcattctttaagctggaactgttactcaacctttctttgtttcttgtgtcattgacatttttctagcatccaggtgagttctgcagaatgtccctcaatttgtctgtctgatgttttcttgtaattcagctcgggttgaattttttgggtgggattggaactaggtgatgtcatgtccttctttgtgcagaccatcaggagacacatgatgttcaacttgtctcattactgctggacttaatcccctggttcaagtggtcacagcaagccttctccactgcaaagatccctttccctcctttaattaataagtaatctgtgccatgcatggctttgtgaggttgtgggaatattctgttatgcccctgaaacttttacctaatggttttattttgaaatgatttcagatttacagaaaatttttaagaatggcaagaaaataaaactttcataaataattcacctacatttaccaattcttaacatgttgttatttatactctctcaccatatatacatatatacatacatatatgtgtatatatatatatgtgtatgttcataggtagatttatagatacagagatctatagaaatacatagatgtccatgacgtatttgtctatatctatctatagatggctggaaccatttgagaataaattgcagatattatgccctttacttacacgtcctttagagcagcagtccccaacctttctggcactagggaaccagttttgtgggagacaatttttccacagatgtgtgaggggatagttttgggatgaaattgttccagttcagatcatcaggcattagctagattctctagattcagtactggctcgtgacctgggtgttggggacccctgttttagagtacgtttcctaagaataggacatattctgagatcatcagtgcaattatcaacatcaggagatttaacactaataccattctattatcaccttccacttcaatttttcttacatacctccataggctttttgccttacctcatatgtatcctttgtagttcaaaccacagttaagctttctttagttctcgaagacttgaggaaagaagcccttttcttatttatttcactgaatggattccttatttcttctgatggctgccttgaatgtaggaacaacaacaaaaatgctgccttgccttcaggagaacacactgtccctttgtatcatatgtaaaggctgcctgaataacccctaaccaagccatgtcttttttcaaaatttaaattctaaagcagcaaactgagtctttactaagaaacagttatcaaaaaaataaactaaaaaacgtagtgcacacccatgaacattttatccttttgcatttgcttctagctagtttcaattgactaggtaactgtcatttaggatagcagctccctatccttttgcatttccttctagctagtttcaattgactaggtcactgtcatttaggatagcagctccctatccttttgcatttctttctagctagtttcaattgactaggtaactatcatttaggatagcagctccctatccttttgcatttccttctagctagtttcaatagactaggtaactaccatttaagatggcagctccctagattacagggaattgaagtaaccacaatttcacgctcactgttcgtgccaataaaaacaaaaactatttcagcttacatcattttgaaaaagacattgagtatgtgccatgttcaaagataaaatactttattttaaacaaccttaggagataggaactgttcatatacttgctgttggatgagatgtctgatgcttaaagatcctgtccacagtctcacatgtggcagtggtggagctgtattttgaacccagggctctgaactcttcaccatagtgacttttcaattttctttttattcaatgctactatttaagcatttagaaaaaaataaatgtattaattaaatactagctagagatttttcttaccttctgttaatctcaaaatttgagcctttcaggaaactatatctgagctatcatgattctataagaagtacctctatgatgttgtaatcataaattttaaatcttcttcagtaagtagtttaattgagactgtgcctggagttatataacactttggctcaactcaagggcttgagagaatagcccctgctgctaccacagttggaatcttcagattcagagactatgatttctgtttttcaatctagcgttcttttccctttatcttttgcaaaatggagtacattttcttagaaattatgtggagactatctaatgaatatttttgaaaaaataaatgcaggaaagaatgactgacttgttgaaagatgcttttaccaattaagaatgtctaaatattattttaacggttaaagataaaagtggttccaaattatgttaatacatggtaaagattagaaatcccactagcttaatagagaaaggaatataactgcatgttggtgtttgtatattacttcatttattcctttctgtaacctgtcagaggatattgtcatctatatcatatggctgaaatcaacaaaaaccaaacacctaagatcacacagatagtaagtgccagatctggcctttttgagctcatagatggtgtactttgcccccagaagttaaataaaagcatagcattggagaggttgaggagggacatgcattagccagattcgcgaagcccactaaggcccctttgtacagtgtcccaccatatgaagacttgattatttttggcttctacttttgcccactctctgcagcccattgcttatataataaccatagagagcttttgtaaaactagtggctccgctacttaaaactctccagtcattttacagtgcacatatgctacacacatacataaaatcccatgaggcctcacaaatcctccctgcctgtttctcagagcagagcaatggagcacacaactgcaggggcaccatacacaccaaggcagcagacctgccagtgcaacatgatggtaccatctctgacttcatctcttctatttgctttctgcctcccaaatgccaatctcatttttgcttaaactcttttgctcgcatttcccttcacctggaatgttcttctctaggccacagggttgaccccttcttatcattcagatcttactgcaaatgcatgcctttgcaggcaggccttccctgccttccgatataaaataaacttccttcccagtagcttcaacatctccttgtcttatgcccttcagagcacttctaccttcagagattagcctgatttgttgtttgtttaattcctatttccttcctgatatgttccatggcagcagagactttatcgtaactgtatacctgagtaggaggataatgccaggcacttatatgataaataaatgaatactcctgctattacttgtaagcttcactcatgttttgtcaaacttggtcatggcttctgatttttttacatcttctactaccagactttacttttatcccattatccatctcagactctgcattttaactaccaagaggaggatctgaatgtcgaactcatcatgttgtaagggtcatgaagagctttgaggcaagattatcataaatccttagcttctaagtctgtctttggtttgagtgtttatgtttgcttcagtcaactgtagccatgttcttgtggacaaacacagtatataacaaagctcttaggaggagcaaggtaggtacaacgacacattgcaaagtagtttttgcagtgcaagactgggcttaaaagtaaaacataatgaaaatttggtatttgtacaagccacctttggtatttcagccagaaacatgctcaaatagtatttaataataatgtagaagtagcatttcagaggggaagaaacacaaactattgaatagatggcacatatccatttagttaattatttgagaaaggttataccttttcctcccgcaaaattttatgcatactaaacacttggagagagagatatatatgtgtgtgtgtgtgtgtgtgtgtgtgtgtgtgtgtgtgtatatttttttttttctcttgagagagagagtcttactgtcacccaggctggagcacagtggcagaatctttgctcactgcaacctctgcctctcggattcaagtgattctcctgcctcagcctcctgagtagctgggattacaggtgcatgccaccatgcccggctaatttttgtatttttagtagagacagggtttcactatgttggccaggctgttctcaaactcctgacctcaggtgatctgcctgcctcagccccccaaaatgctgggattacacacgtgagccaccacccctggccaacacttggatataaaaatgaaaccatcaaatattaaggcactggtggtagtaatttattacttaggaggaggaagaggcagaatatatggctgtgtctggtccacacaggactttagattaaaagccttttttttaagtctgtcacaggagtagagtaaaaataaataggttttttaaagccattttagtgatacattaagcaagctttcaacagtggtattcttggtatctaagtgaccttgatccataataagaatactgcttttgcagttaatctaaaccttgctgtttcaaacattttaaacatacttacagcttaagtgaaatatatatatggtaaattcattgtataaaatatgtgaatacagagggagatttatttaagccaaacaatagcaccagtacttagtcacacatcacgcctctccatttgggggatattcagtgctgcggatgcagctaaattcagtgttacaattattattatttaagtgttggatctcttccttccttttcagccaaatatgcacttctcaggcaattctctacacccactgaaacagagacaggatctgacatcctgtgacatccttttctacttaagcactaaattgttttgccctgtggatttcagcagcacacatgtgatgttactaaaataagagtgatattcccagtgctcagtaccttaatagaaccattatagctattattaagttatgttgcattaatttaggacttaaaaaatacaaatgagaattttgtgtgttcttgtcagagattgcaaagaacaaaagcagccttaaaggtgtcaaaacgtgtttaaggaaaaatggataaaaattaacgccagtatttgatacacatggaaatgaggaaatgttttgtacgtgatccccaactcacagaatgatcatttcaaaaatctgcaagtaatttggttgctcagagctaaggacacattcagtcatcgggaagcttcagtcttagagaaaccctcacaagcaagcccactgtaactcacttcatgagaccaggcagccacttagattttagcaacagaggacagtgtttattcattgtattccagggaggagacttgctttatctaacaagctgagtaggtcaacttttcttattgactgtctcccagctctttgctgcatctccgtctggtggcccctgctgcctgggctactccaccttattccaccttattcttcaaagtgcttcctgaactccagttacctacctatctggcccctccccccccattaatacccttcacctgtgtagctgatcacactactattcttagaagaggttgacccttgaacaacatgggccggttcacttacaggcagattttttttttcaaccaaaaatatattgaaaatacagtattcaggggatgcgaaacccacatatatggagagtcttttgcatccggtgaatactgtcctttctgtatacttgattatgcccagattttggtacactcagaggtcctagaaccaatcccttgagtatcgtatattgaggaatgactgtattggcatttttaactgggccccagtattgatgtattctacttagctgatatttttgctaacagccataaaaacagtaagagcaaggactctggtgatgtttcaataggagggataaccactttataaacagtttataaattatgacttccataagataatggaatttcatagctgaaaggttgcttagatgcatgtagaccaaccacctttttttttcctttctttcacttttatgtagatattgagaaaatttaaaaaattatgattccaggcccagcactgcctattccagcattttgggaggccggggcgggtggatcaactgaggtcaggatttcgataccagccttggcaacatggcaaaaccccatctctactaaaaatacaaaaattagctgggtgtggtggcatgtacctgtaatcccagctactcaggaggctgaggctggaaaatcacacaggaggtggagattgcagtgggcggaggctgcagtgagccgagattgcaccactacactccagcctcggcaacggagcgagacttcatctcaaaaaaaaatatgactccagatcaagattaaatagtatattcattgctttagattgtattttgaatgggggacagagaatgacaattggaatagaaaacaaaagaaatctgagactgggcaagtctcaggcacagatttggagtgatcacatgaaaaaacctcccaatcctagattcctctgtccataaaactcatcttcctttccccaccaagacatttgagtggatcagagccaccctgaagattccaagcttcaacctgggtttcaaatcctactctaaagtaaactcacactcctggtgatttaagccaaatctaccatctcagaaagcctccaaattggggtgacctcaaggatggacacattgcccaaggttgtttctgggcctgagtgtatttttgttttcaccattccctctccattaatatagacttgtattcactaggcctactcttgaactaagctggtttcctaatgaatctttaagtctacatgttcttaaagtatagtttgtatcatgtgaactgaatcctcattgagtatctaactccatggtaaaattctcaagatgtttagatctttggtgcttagccatgttaaagatctttctttgggttagattgtgagctgaggcatcctagagtggcttagggttctaatgcctgtttttgcgtttacagtctctggctgatgaacttgctcttgtggatgttttggaagataagcttaaaggagaaatgatggatctgcagcatgggagcttatttcttcagacacctaaaattgtggcagataaaggtaatttcacttaatgcccaaagtgatctaatatttttttcatggccccaaaacacatttggaatgcatcttacagcataatagatttatttgtaagtaggaaaggttgaagttttggaacagttatttcaataactgttaataagatatttataatgtagtttagcaaattcagattattgcaaaattgttatataattataaaatgtttccctctttttcctcattttataaaaagctcttatttctctactgtattctactttttatttctcaaatattttatattcacttattaatggacagctacctaaaatgagtttgctagccataagtgatcactgatatgtcactaacaggaaataacaaattggatttatcgcattgtttggcttattttaccacgtttcttctataggccaattttctttcatccgtttctagaaactcattgctactgctaaaatgtacacatagcaaattgacattttcccattggaagtgtatgtagaaaatggttatgtattccacactccacactgccacactagttatctttatcctaaaacagatgctttccctaaaatgaaagtttgaatgcattcttttctttaaagatttcttatctttttataaacctttgtctgtattctaaaacctctggcagggcctgcacagctctcaatttagatataacctgcatttcctcgtggctcatcattctcctctcctccctcagtctgttataaaattagtcttcccatcctggtgaatctggtgttggcagtttcttttcatctgggtccagtttatccttaaggttaaactcaagtatcacttacattaaccctctcccacagaccttctacacatttgatatgtaacattttgggctattgtattataatgccttgtttatatgtatctgagaactagcatgttttagaccccaaaagtattggtacaatgaaggggtggcctgcctctccacccttgtgggcatttctcgtcgggtggaacgagagactggagaaaagagacacggagacaaagtatagagaaagaaaaagtgggccgagggaaccggcactcagcatacggaggacccacgccggcaccagtctctgagttcccttagtatttattgatcattatcgggcgtatctcggagagggggatgtggctggacaatagggtaatagtggagagaaggtcagcaggaaaatatgtgaacaaatgtctctgcatcataaacaaggtaaagaaaaaagtgctgtgcttttgatgtgcatatacataaacatctcaatgccttaaagggcagtattgctgccagcatgtcccacctccagccctaaggcagtgttctcctatctcagtagatggaatatacaatcgggttttacactgagacattccattgcccagggacgagcaggagacagatgccttcctcttacctcaactgcaaagaggccttcctcttttactaatcctcctcggcacagaccctttaccagtgtcgggctgggggacagtcaggtctttcccttcccacagtcaggtctttcccttcccacgaggccatatttcagactatcacgtggggagaaaccttggacaatacctggctttcctaggcagaggtccctgcggcctggccttccgtagtgtactgtgtctctgggtacttgagattagggagtggtgatgactcttaacaagcatgtgccttcaagcatttgtttaacaaagcacatcctgcacagcccttaatccatttaaccctgagttgacacagcacatgtttcagggagcgcaggggtgggggtagggttacagattaacagcatctcaaggcagaagaatttttcttagtacagaacaaaatggagtctcttaatgtctacttctttctacacagacacagtaacagtctgatctctctttcttttccccacagtacaaagtaatttcaatgccttgaagaaactaaataatagctattatttataaatttttaacattctgggtactgtgtgaaacattttgcacatattatttcatctgacttcatctttgcaacaaccttatgaaatgtagggactataattactgccattttatgggagaggaaccttacaaagtattaccaatcatcaaaagccgcactgtaacccagtttaattatgtgaatcatccatagctgttgagtcaaatgatcacatcaaatcgcaatatctgtatatttcgaaaaaggacacacttccttaagaaaaaaatcaaatctccagggaaacttgcagcgctaaaaagcaaataagcttcctaaaaatattgagtattagaaatccaagttttagtttccagacaaaaccaaacacttcactgccttccttcccttcctaaattttaactttttaagataaaagtaacttaaaattggtttttgtttttgtttttttttttttttttttttgatgtctacctattggagtcactgtttacacttcattttattcctgacaattcattgaattcatagccaaaaatatactttcgggtcatctttattttctgaggcagtttgatgtttggattattgcagtgtagctcaagggagaaaaaagaagccacaggaacattaaacttcaagcccttacaatacagaaaacttaattcacgtatatgttctagaagcttatgtatggttaggcttttagagcatgtcatataggttatgttataatgaagagttgcatttaaagtacctgtttttgcttttctttttaaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccaggtattattgtatactttaagtctctgttctgttaagttcagtgttttggtgtttttgttgttattgttttggactaaaatcagtcccagtattcatttacagaagcagtttacatgtcttctttcattggccctaaatagtggtgtttgcaaaacaaatgcctctgtcccaggccagatgttcaaaaaatgtgacaagagttttagctaaagcaatttcatgtttttgcttcatctggcttggttatagattctgaaggcttttaaaacttttttataaagattatcctgggatggagaatgaagcattcgaacatagtttcaatttgtaagaaacattttgacatatttgaccttttattttctggaaaatcccattatacagaattgaaacagatcaactttgaaaagaagcatataagaaagccattaaacaattctgttttaaagatagaaatagactgaattgatggacaaatatatgctaacaccaaatgctctgacttaaaaattgctttccttgctaacttgacatctacaggatgaacattaaaccttctgactagaaagaatgcacttttttagccttaacagctaaaatatgctctatttgatatactgcttttatctatagtttgccaccaaaattactgcatgttggtgagcatagcaggtacattgagaaaatagtaaagaaactggactgattatctctcacacttcccatagagaaacactgtgaataagagctaggggaatccccacagtatcttgagtattgagagttgagagccagcaaggacagaggttatttccatatttttactttcgcaaaccaagattggagtttattaaatggttcagtcttacatataaaacttctcataaatatatatgtgccaggtagatgtagaataggaatgacaagtagctagcacatagtaagttactgcatcctgtgcctcaggcaggcgtcactaaatgattatgcaactttctacatatagcttcacagctggattttccagggagtcacttccatggaatcaaagttggcaaggaaaagttatccagtcccaaatgtccttgaattatcttagccattgtctacagattagtgtgggggtggaggctgcaggattaactttcagctcttcaccttccttgtgtgcacattttttactttttacagcttagcctgcaagtgctgtgatcctgtctggatcagcaaaagttttatctctgtggttttaaggctatgccacgctggagcaaaggttctgacatagatgttcttttattaaatagaaatttttaatactacgtattatcacagttgtttactgaagaatacctcatgcccagaaaaatttgtggtagcaagatttggtagtttagtaatcaaaggcttcttggtttatgatgacaatcattataattatggaatgttacaactgggggaaacttaactgacaacctggttcaacctgttttgtttttttcaactttaagttaattaatctgcaaggttcttaaatattcttgtttcacataataatgcaaatgtaaaagcacaatattgcatttttcatgtcttgcaatcttcatataaggcttaaaagtttgtttttgtcactgtcattcctggtatctctaacaatgaaaagttaaagtatttactttaatctttctggccacatctcatttggggagtggggaagtgggaaaagggaagccagggcaccccaagctgcctaacagttgaagttggttttggtttacttacatatattatttccaaaatttttagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtggtaaagaaaaaaaaaagaaaaaattacttgtgatgttggttttgccattttgaatttttcattttatttcaaattttatttttatagactttgatgtacttaagaacagttgcaaaaatagtagttacttttctattctattccattttgctttatcatttactctctcatctctctatctacctatcatctatctttaccttgatcaattaagcataaatcaattccctcacctttttctccttaagttctttactgtgtatttcctcaaaacaaagattttctttttcataaccacagtacacttcccaaaatcaggaaatgtaaccctgaaacaatattatctaatccagagtccattattcacaagttatcaactgtctcaatagtgtcctctaaagcttttttcctaattcagaatccattctaggctcacacattacatctactatatatccttagcctccttcattctggaacagtttctcagtctatctctgtttctcatgatcttgacatttttgaaaagtcaggtgagttattttgtggaatgcccatcattttagacttgtctgattgtttctttatcattaggttgagctatgaacttttggtgcaaataccacagaaatgaccctatagttttctcatggcatcacatccaaaggcatgtaatgtcagtgtggccaacaattggtgacactaactgtgataactcagttaaggttgtattttgccaggttactctgtgtgaagttactgcttttcctttgtaatttatgagtaatttgtgggaagatgttttgatgctgactaggaaaatgtctgactcctcatcaatttttctctgctaaatttagcatctattaatgatttgtggttgaataaattaccatgatagttgtcaaacacgatctactaattccatcatttattctgtattagttgcattccactgtaagacagaaatttttcatcttccctctttatttatttgttgatatcaatgtggcctcggatttttatctcatgcccaaaatattgtgtcactatcatttgtaatgctcaagttgtcccaggcttttcaaactgactcttatgtctttttttttttaacatgtcccatcatttttgagcactgtcttgcacaataaattgcaccagcctcattttgaactttccccttcccagcactagaatcagctgtttccctaatgagccctgtttccttttagtgaggaatggtagttagaaaccaggatcagggcataggtgtgcttgtgctactggtatatctttgcttctaggccctttgagtagacagagctattacatccattgtatttgctgaaggaggaatgagttaggtaacaaaagcttataaataacttgtatctactcttctataatgtaaaataaaccttacctcaaatgaaatcttatttttaataaactattaattataactatcaattatttaagtagtaagagactgtatgataaaactaaatagtttctttaggaacttaaattgaagtaaagaattgtacataaattagtaattcaaaaagagcaacattaaaatcacattacacttttttagtgcttcgtgttcagacaatttaaaactatattataaatgttttattttaaattaatatttttctcatttaaattaattattctttgaacaattttatgtaaaactgtttttgaacaattttgattctgtttcatagatgtaaatctgtttattaaaccacaatatattgaataagctcatggcaaaaaaataataataaaataatccaatattgaaactaataatttaaaatattttattaataataatgatgataaataatatttttattttactaaattcatttctgccacctgtgtaaaggactattttctcccaataagctcagagtataaatcttcctttgaattcagtgggagtttgaaatgcaattttagtaaagggtttatcttggtgctataagaatttgttcttgaagttgtagcataatttatttctgattttttatataagaatgctgacttttttctgacacatatcactttattcaagaattgtttacctccagggactcgtctgaatttttgtctggttaattgtaatggtcctatgtgtctctcttgatcagattaatttgagcatggaaagtttttagcaagtcaactccataactttaagcttggctctcccttcttaacaagataatgtgactagcaagttcttaacttctctgaacctgtttcctcatctataaaataaagataattatgccacctatgtactatgtaaaaagtacttagtacaatgtcaggtgtacagtaaaagttcagtaaatgctaggtgtagttatacattgctaggtgatagaagtgatattacatgtcctctagttcaggactttaattttagtgagaaaaagtgatattacatatcctctagttcaggactttaattttagtgagaaaaaaaataaggcaaagtaggtgaagtagctattgaagaacttttagttagttaatgccatagctaccactagaattatgtcttctgattcccgtccaatgttctattatattatggctgttatttttcccagaacatctttttaaaatttttcatgttgatctatattgtgtacgtaaaatgaaagagaattaaaccatgctcactagacatgattatgcagatttcataattttcatcaaaattgtaaaaatatctaattaccctaacttgccagaagttgtagactaataggggatcttatttggctttaaatagctttttccttcatatctgtttcagtcatagtagattctaccccacacttttgctcctatttccagagtctacaatgtactcctccaaaggtctccaaggaacatataacttaggttttaaggtccaattcaaaggcccattttgtgtagttctttctgatactcttctcctttaaattaagtagacccttatttataatttttaccccactttcataattatgctttatttgggtcttattctaggattttttttctttactgtagaataaaggagcatatattagaaaaatatggaggagaaaagttaaacattcctcaaaccaaaagtttagcatagtccccaactagaatccctgtgatttcacacacctagagagaagcaaagaattttattttctctgtaactatgacacagcaattctgctttgcactaaaattcttgaaagttaaaaggtcagacatgttgctatttgaaggcaaacgtcagccttttgggggaactatactggaatctactggagagtcacttattggagcagttccagttggtattcagtaatttgcatcataggtgaaattgcactaaaagaagaaaatatttttaaaaataatgtaagaaataactgcaatgtcttttttttttttttaaacagtggctgtgtggagtggtgtgaatgtggcaggtgtttctctccaggaattgaatccagaaatgggaactgacaatgatagtgaaaattggaaggaagtgcataagatggtggttgaaaggtaagtgaaagggagcttgattttagatgattaatttcaactctacttaaataaaattataaacattttccatggctgtctgctcagataaactcttaatgtagtaattatgcagctgttatcttttgaaactgataagacttttacactggtcaaacttgctatgccagtctccctagggaaagtaaatattttctctagagaaactctattgtagaggtaacaggagcaaaatgtggaattaacaagtgagaagagtcttcaaattgccacctctcaacaaataaggttgatttatttagaaaagtaaacttagaaactattggtttcataattgccccaaataaataaacttgcttgctgattgctaacagtgtttaagttttaataacaagactaactgatgtctcaaatatagaatcattttgttcaattttagtaattttttttttcaggaatttgaactatatgtggagaaaaggaaccttaaaaaagttgaaagagtctttataatttcaattaacatatacctttatattacaagtgagaaaactatggctcacccagatagtgtaactggtccgaggtcttctaatgattgggtgtcaattgcattaaatcctaattttccaatactcagctagagttactcctgctgcttctcaagtaccagggcctttatgggttttaagagctacaatttgtgctgaaaaaactgtcaggcaagatactcttatcccttttattagttagttgattatgttaggtgacagtggcaagtgggaccttacaattgagatatattttgttctttcacttttattgtttcctgattttatgtgtttggaaatatgtttacagatttgttacaatgattggaaaatgtatatttttgccacagtgactttataaatcttaacttatacaataaactaaagttatcaagcatttatatagtgtttactgtgtagtgcttacagttttaagcattttacatatatattaattcatttaacactcaaaaagggaacactaaggcaataaagggtaaataatttgcccaagattatagttagagacagagcagtagtcaaagtcaggtctggtttcaataatgattgagtcttatttcagtgatgtcttttataatttttttaagtgcctatgaagtcatcaagctaaaaggatataccaactgggctattggattaagtgtggctgatcttattgaatccatgttgaaaaatctatccaggattcatcccgtgtcaacaatggtaaaggtaagacaaactaccacaaaatgtaatatgatttctagcattgtattctacaaaaagattcatttaaagaggctcagaccagataaaatcatagttcaaggttatttctgtctctcaaagttttatgtaaactattctcattttccaacagaagtcttggacagcaagggcagaaaacttagagaatctaagacattcaatagattgttgtcattctttatataattttgcaaattaaatattaactctgaatcttagcacattcttaaagtattgatcatttgaataagtgtaatagagtttcatttaaagttgatgtactaaactctagattgcctttcatatagcacttgataccttagcaaatacagtttaattcaaaagctatggagcaaatgcacaaaacaggtagaaattaatgattttttaaacaaaactaaaattatattaaaatattttgtaagacaactgactcattttccacaagtcagtgtaaatcaagtgtgtcaataattgggtaattactgagtctttgggtacatacataggaatttgtttattctatctacttttgtgtatgtacaaaatttttgaaattaaaagtttaaaaactgacattaaggtatgtttaatataattagttatatagttaaattgaccctgtgaataaattacccacacgaactggtaaagtgttttggaaattgtatttttttttttttttttagcaattcttgggtattccaagcatcttgccttttaatggtctctaactattacccaggacctcataagttggctaccacctgaaatttcttcctaactaaaagtctttaagcaacttaaaatttcatagaaagtaatccattaagaaccacaattaaaagcaatttaatttgaagactcatatatcaaaatttattaaagtgtatttaaatagagcagtgttcaataaaatacgtatataataaaattaaataagtacttgttacttacaaatatctaattttctcatagtgtatgtttgcatattctatgtataaaacctaattcaaaacataagtattggggaaatgtggacctgtaagtgatgaaaattagattagggaatgagttcaggcctatcaagttttctacaattctttctgttggaacatcggacctttgattattctcttttttcccccctttagagattagttcttgctctgtcacccaggctggagagtagtaccgctgtcatagctcactgaagcttcaaactcctgggctcaaacagtcctcccacctcagcctcctgtctttgatcatttttacttacagtttcatgtcttaatctcgatgctttgttgttctggcaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtgcttctgtttctgggattccttccttaatgattcctgaaagatttcagtcagtctgccaagtcattcttaccacacgtcataaatgtccctaaattccaacatcatctacactcctccctctggatgagacaaaaattcttttttgcaacaggtgccacggtttgttgttgttgtcctgagaatatgattatctttttaaggttataactgaagaagttgtaacggatgtcaatgtatatgacatttacaaaggaagcccgttttaaaaggaagaacccctaaaatggaaactttgttagaattctatttaataatgaaggaaaatgaaagtttggtctggattattcagattgaggctacttggagatagcataacatgtgaatttacagggaaacttaggtagacttcctttaacaaagagttccaaatttacatgtcatatgtaggggtcaatttaggtagtgtttaaaacatgagttttggtgtcatataaacctggacttgagtgctggccttatcattgattaactgtgatcttagtcaagttaactacttaatcactcctaattctcattttcctcacctataaaacagtgatgataacaacacctcttcaatatgggttgtttaaatgagaaaattatgtaaaactcttagcacatagcttggtcatcatggtagctaacatttaagtagtgcttactgttccaagtgcttcatagatgttaacttagctaaatcatcccaactatcctataaggtagtgtttcttcacctcaacactattgaccttttgggttgaatgtttctatgtagtgggggctgaactgcgcattgtaggctgtttagcagcatctacccaaccaatgccagtcacacaccgctgccgacaaggtgtagccaaacatgtctgcagaccttgccaaatatcccctgggaaggggtgaggagaatcacccttgattgagaaccactgctctaaagtatgtatcctcattttacagatgaggaaactgagacataaagaggcacacaggtaatagccaccaaataacagaatcaggattcaacctaggcaattagctttaaaatcctttctctttgctgggcgcagtggctcatgcctgtaatcccagcactttgggaggcagaggtgggtggatcaagacgtcaagagatcgagaccatcctggccaacatgtgaaaccccatctctactagaattacaaaaatgagctgggcgtgggggcatgcccctgtagtccctgctactcgggaggctaaggagaatctcttgaacccaggagacaaaggttgcagtgagctgagattgcaccattgcactccagcctggcaacagagcgagaccccgtcttgggggaaaaaaaatcctttctcttaagcacagtgtactataatgcagaaaaacttactgtcaaatttttgtatctttttagaataatattgaaattttttaatgctccagcatattatgagggtgctattatttctatattacagaatgggagatggatacagttattaaattccttttttatatcatatttccaaagttactatctagatgtaaggaggagggttaatttaatatatgcttctatttcattgtttcagtttctacgtgaatgttgaatttgcaataagccaatagtttccaaccttgaatttcatggatcagtttagaattatttaaactgtttaaaagggggaatagacgtgtgtaggttaagaagcacaaacacaactttgccaacttttcattttgccaaataagcacatggagaaaaaactaccattttctactatcatacaaaagaaaagacattttaatgccaaaataatgggaagaccacagtctcaaatgtatcagctatcttggaccatggacagaaatgcagaaccttgggatggcagagccaagagctggaagaaggctgggctttcagtttgcatgcagctgcctgtaccagctattgac

SEQ ID NO: 13874 - DNA, 24201 bp, Human
gaaccttgcttgttttctttccaaagtatctttcctacttgcttcactgcagtatcccatttgttctttataacattctctcggttttggcttctggggactccttggtgacaatggagaacagagactccatatcacattttgaggtatatgctgacttagccactctttccacaaatacttcttaaacagtgtctacgggaagtaattttttttttaaccaaccgaacttttaaaaagccacctggaagttggggacagcatgacaccccttcttataatatgtaataattaatgtaaagcacttggaggtccttgttgctgagacacactctgacaaatgtgcaaactatcactatcctttgtgccttgttgaggacctgtcaaaaaattcatctctaataagggatcgccataaagtggaggggtttatttaccagttcactccttcactttagttcactcatctgagtatactttggtttattctcaaggatgcatgtataaatgaccctattctccacggttagcaaaccaaaacctctctaaattgggagaaagaacttgaatgtcgtgtgaaagaaaggaaaaaagagggcttgaaaaggcaaaaagcagtgaaaagcagtagttaaactgtaacccctatctctactcaccagaccacatcccaaccgaatccagctgcacccaccccgtagacctttggggctcctgattgagagtgcagatacagggcacatactcatgcgtggctcccttcactactgggtgtcagtctggcctgtgctcaaggtgtggcatctggttggagtttcaatatgtaggatccactaccagggttttcgtgagattaagaagggtaaggtaacctactggcaaaaggggctggtatgccccaggggttggtttggcacagcaggattaaaacgaagtcaaccaaggctacagtctggtgttctttagtcattcacctcaccctccaggaggccaccgaatggctttatctggacagggacagatccagggacacaactgggataaccggtattcctggtaagcctgtcactggggcatttggaggttaggtggggaagggacgcgcgcgtgggggcggggtgagagggtacagagggagaaggaatgatggtgaagggtttgctggggctgcagcatcctcattctgtctccaggacggatttggaggccccagtttggggatacgggtaggtctgtaactcgctgcgggacttcacctttgcaagcctccgtttgctcctctcaagagggatggactctgatctttgcgcccccttcctgccctttgattctggttctttgagggaagccctgctatgcagtccggggaaggaaaggcattctctgctgcaggcgggccggaatgggacggccaggaaagcggcctctgtggcatgaattatatttatttagatacctgtattaaaaattattttcgttaaaaaaggaatccccacccaccaagctcgcgctggagctttgcactgcgaccgtccggcggccgccctttccctgaactgcggggtagccggtgcgcagcgctttcttccagcacctgacgcttagtttcgcgcagaatctccctacgccgccccgccggctccacgcgccttcctccttttcccagccccacggccgccccccgaggttgccctcgcggcttcccggagagcaggaaaacccggggagtggaacgcgtcgaggcgaaggtccccgcaagccgcgcagggtgtctgcggccggttggacgcttgcgcccggggtgggcgactcctccgggcaagggcgcggggacggcccggcgcgcaaggttgacgggagctcgtctcgcgccgcggggacgcccgggcggccctgaaggggacggggcggccccagtcggaggtcgcagggagctccgcccccgactcggtataagagctgggcccggcccacggcggcggcggcggcggcggcgagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcgtagtgtcatgaccagggcgggagatcacaaccgccagagaggatgctgtggtgagtgtcgttgaccgaaagcatatggtggaaacccaggtggggctttggagacaagcaactctacacgagttctggaggaatgtggctctgctgtgaaccatagctttgtaaaaagatcctttgactcatatttggtggacgttaaggaagaaaggaaattcagggtgtgggaaaaggggtttgcacacaggcacggatggagtagattgggcagtttggattgccttgtgtaaaaaagaaacaaaacaaacaaaccaaccaacccaaaaaagaatgctgaaacaagagtttcttcactgtatgtgaaatgtgaagttgggcagttattgactaggtcaataactgaatttagtgaatggtattaagtgaacgaaatacatcggttcataggtaacttgataaaatgtacgtggtttgtcctgcaaagtagtttttaataatcatgttctaatgagatcaaatggataagcattctgccctcagctcattaagtgactaccatcgctttttctcaccccgcctgtgtctttgcaggatccttggccgactacctgacctctgcaaaattccttctctaccttggtcattctctctctacttgggtaagtgagaatgcatagtcttacaacacagttgcgcaattttttatttcctttcgttctagccagttgtattaagccaacttccagttttgtcaagcagttaaagaaataaatcatccaagtacacatgctttaatgaaaacgttatttacatcgaagatctttccccatgagtgttagttaatgcaacttaattatcagatcatcgtagtttatgtagatagacaactatccagacaagattatcaaggaaaggaatatttgccttgtttttaaattttatgttgcattagtagctttggtaaatagacatatctgctacaaaagatggatggatgtctcatataccttctcttcttcacattttaaaatattttgttttctttttttgttaaaatttagttccagcgtgcagcaccatgagaatacaatagaatggtagagtgactgacttaagctaataataacattctaagattaattgaaacataaatgacccccagaacaaatatctgagtgacaaaaattctggtctttaaaaatgttatctatagttagataaagtttggggcagtggaggctatcttaaaattaatcatccaatgaatatcagcaatggatttacagttttccctctgactttctaggttgtcctggaaaagacctagtgtttctgtagatctgggctcctaaaactctctccgaaaaataataaactagaagggtgctagatatatgttcagtgatgattagaatctttaacattaaacaattattgtttaaaagcaataaatctggctatattctgtccatggctcatatgtatttaaaaagaatggaaagaattttgagagtaaattttttgaatgttattttccttttaaattggaaacttatattggatcatccttaagacatggatggaaaccactggaagaggaaatctatacccaatgcctttgagaaattgttaagctacattattggttctctaagaaatagcagtttatagatgacattttagaaaagcaagctcctatcttaccagaggcttacacaggggtgactctgcaaatacatgtaaacaaagtggaattggtgtgagtttgttttaattccaacagctgatgatgctaagtagaaacctagtgaaacaacccttaataaataaaaagcaatagtttgttcccccagtttaattcagtaaatattaagtattaataacatgtgatggaaatagtatctgaaattctcagcctgtggtctggccttgctcttagaggaagaagatgcctctcttccaagttctgattatggtttatgtgacctttggttaataggttaggaggtcagatttgccagaaaaccagtggcaccgtggttgttccaggaggatattttgtcatgttcattaaaagtcccacaagaaaggtgacacatgcttatcccaactttacagtaagtcaagcaaaggaagttctcatgagaaagttggattaaacaaacagcagcaactacaatcatataaggtttagtggatttttactcctttccgctgcaaaggagtgcaaaagaggaatgtctctaacactaggtaattatgctttttatgttttttctcttgtgtggcactctgcctgattttgttacaacaaaacatttatgtttctgtattatgtgtgtgtgtatatgtattatatatatatgcattttccgtcccaccctgccaagtcatgatttcttatgcactgaacgtaggggcattagagtagaaggttgcctcaggttagttttgtgtggggttgaatgccttttatttctgacttcatttctatctgccaatggatcaatgcattttactctatattatcaaaatacaatatagtgtaagaagtggatcctggctaggtgcagtggctcatgcctgtaatcctagcactttgggaggcaggaggattccttgagcccaggagtctgagaccagcctgggcaacatagggagactctgtctctgcaaaaaaaaatttaaaaattagccaggtgtcatgagacacacctgtagtcccagctactgagaggctgaggtggaagagttgcttgaacccaggagtttgaagctgcagtgagctgtgatcacaccactacactccagcctggacaacagaataagaccctgtctcaaaaaaaaaaaaaaaaaagtggatactattgtcaaggagcttataatacaatttagtatgggctttaaaaaagatatctaataacaaaaagatgacagtgtaagacagtgaaaaagaggggccagttgcttatatctgataacatgatcttacaaactctctccatttaaaccccaatatgtctgcatttctccagccctcgtttcccagaggctcactttgctcatggaggcctttgttgccaccagctccatcctactttatatttcctcatagcagcacgtgccctgtgctagatttgcttttggtctgtgctcactggaatgtgagctgcatgaaaaccttttgtgcgctgctgaagctctagtgcttgcaaatgtcgggtacatagtagccacttagtaagtattaagtggattgaggaccatgatcattcattgacagttattaggtttgccttcagctctcagtcccgtgggggtacatggacacataaataggtcatccaagtttagtgagaattggtgggaaggcaagaaatggaaataaggaaggatgggcacttggtcaatatttacatagactttacccaaatattgggctttttgtaaacatagaatctgttgcttcttaaagcctaagcccgttggaaattggggtaatgtgagcaatttctttctttccatcaaagaggtggtatggcatgcaagaaaaagcaagattcaaaactttaatagcatttgtcttgatgtcttgctttagaggactctaagacaattaaaaaatacaataagagtaagaaaaaaagaaagaaacaacagtattagaaaagtgtttcttaacctgtatgttaagaaagagaaaactcgctgacagaggcaacctatcatttgggacatgtgtgtatttttgtcttttccttgggagctattcagaggaatggagattagaataaagtatctcccctctccctatcccattttatcctaatcaaatctaaatttgcttttcaggttaaagattaagtaacagctccacccccctgctgttgtgacaactcaaaattactccagacattgccaaatgatccccggggaggtggggtgggggtaggagaagcaaagtcatctctagttgagaactactggtctacaggaagtttttttgtaaatgattgctaacatgcatcaatttaagttttgaatgtataaaattattatcttggcttcattaaatttttaaaattatttgacataccaggatagtatttgcttctaatacatggattttttcgtgaagatgttaacagactttgggaagaactaggagtagaagtatttctgtagggtcaaatctatgaggcctggaatttggtttcctatagggattcccagagataagttatgatggaacatggttgtcctccttaatgttaatttcagaagtcagggatggagcctaaaatctcataataaggtccactgtagattttttaagacattaatttgcctaattcacttaaaagtttctgttaaatcacatttcacggtaatgaactccaaaattccctatattctccggagtttgtgtgaagaaataagtagctttttccccctttcaaaactcatctgtattaaaatgttaacgtaactacttacttaggcatttaagtttatttctgacatcactgtttatgcagtgccagaatttgctgttactactcctctttccaatcgctctgctgttttatgactttcgaattatgactttatgaaatctcataggttttaggatattagacatgaaagaaaacttggagatcatatggtccattcccatcattttacaaattggaaaactggctttttcttgatgctcaaggtatactaatgtttgtgaactgtactgtaattgatttctggttcaatagcaaactactttatgcctctgcaatcaagataggcaaattccaggccccaggagaaacctgacacacaggagaacacgtttttgtctcaaaaagccatcttgggtctggaaactgcattttgtttctagaatgaaaaagagaatgtgcggttcattaatatcatgccttttcaagtttacttaataattgggcaagaatattttccattgtgctgggatgaacgttttaacatctgagcagtattcaatctaagagtaattactgactttgaaagtctcataatgtagccaggaagtgcccttttgataaggaagcaacttcctgagtacaatagactagaaacgaaaaatattccatcaaaacattttctcttttcatttaagggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaaggtgagtgttgttatataattaagcccttttattcatgggaccaatgcctgagctacctctgtagcaaaggaaacaacaaactaggagagaaacaaccagggaatgtctgcatgccacacttgagggaggagggcttagatggcaccacctctggatggagggtcccatggctcccacacaaagttgggatgcctggacattgacctaatagatttttttgtatctttggctgttcataaatttcatatgttaatgattaaccttgtagcacttctctgagaaccatgttaaacattaaaagtttgcttaactcaggcttcctaactgtatcttgtactggagtccctttagtgtgatgttcctgagacagctttaacatctgttctttggttactatgtttcatgtaagagtatgtataagggaattgaaaactaagaatagcttcaaggcagaatagttgagcctggatcacaaagagctgaattataaattttgtagggaaaaagaagaaataataatatcttgatatttattctaagcattagtactgaaatcatgtcattttatacaggaaagaaagtaattgatcaattaaattttccagtatataagggaaatatggatgatcattcagggtaaattttcttgaattgctcagttgataatgccaagacctgaccatgcctgacttagatgttggcaaaagactgaggtttcattctttcagtgcgagatgactgcttctggacacagagcaacaggcttatcaaattctaggacttgatgctactaggaaaatggtcaaggtgaacatatttctgtttttagaatgagtagaccagaacacatatagagaaaagttctgtaatctagaaaaaaatttacttctttgcatcattatacataggaacataggaatattatacatagaaacttttaatctaatgattgttgagcactgcaatcatagattaggaaagaatattgaattggatgaagaaaagtgtggtaggataacaatttcccacttatcctatataatcaactcatacattactctttatgaaaaatgtttcctgatacctctgggctgaatttaccatttcttcctctgtgttcccatgaggctttgttaccacctctgctcttacacagatataatgatctgttcacatatcttttcttcttctggtctgtagggtcccaaaagctaagaaccttatttagttgacatctgatccttatccagtgaatgaatgcatgagtgaatgaatgaatatgttgggattttatatcagactgctttcagtaagcagcttattttttcttgcaagaccttccaagcaaggatgaactatattatccttgaagacaagagctgtaattatcccttacatatagaacttcatgttttccaaactgctttcgtaagtgttttatttgagcatcattatgaccctataaagtaaggaagacaggtattaccattctcaccttctagacgcaggcgtaagagatgttaggtatcctgccctagatcatctgcctactgagtggcagagaaaaggctaccaggtgtctttatctgtccttactccagtgctttatctatatgggcgcctcataagagaattgccatctgtgatggaaggggtagcttagaatttcgtagcaatggcaaatagcattagtatgcaaagaaatacactgctgctttattcttggcaaatttttgtgtgtcttttctatttaggtaaaccatattatcagattcagcctgccatgtaggaggttgtagatttcataacttcctctttaacctcatacatgttattgttttaccttaagcaacaaagagctgaaatgtggatcatgtctatatcatactacagctccatttatgttaaactttcaagaagataaactaaatgaaaatgtagtcattatgatagacttcagtgaacagagaaacttgtggtacttcatcattttgtttgcatatttactggtctggtgtgatcctctgggttgtattgagagtagttgaggcaggactgacttcagaaaggttttctttttatctggtaataattaggtctgtgtattaatgtattatagtagaacaattatgtgtggataagaacagtctcactgagacattttgatgtaatgtacactttctctcttcctctgcacagtggcccagacctcgctggtggtacagaatgtttcagtcatcctgtgtggaatcatcctgatgatggttttcttacataaacatgagcttctgaccatgtaccatggatgggttctcgtaagttctcaatgagattcttgatggcagaaaattgaatatctggtagtggtaaaggatgaaaatgctttgaagctatttttttttttggccagtgtgaccttttaatattgatttctgtgtctactgtaatatcccctatagtttgttttgttgttgttttgcccacaacaggcactcattaagtattgtttgaatttaaattttgtcctattggtttctaatggcatttctaagagtttactatagaattcagttgtttgttttcagctttttagtgacctatactttgtttgtgctatttaataaatgttatccatatctatattagtcagtcataattgcgttcctccaataataattgttacttctgtttgggaatgtcaaccagataacttttcatgttgtgatttcataagagcttgatggaaaagaggagagggatggggtgtggtataaaccatgcatctggtgtcatattgaatcttcttgtgtatatgtggattgatattatagagttgcaaagccaggtaggactttagaaatctttgagcctattcccttcattttattgaaaaaattaagacaaagtgaacgttagttgattgcccattgtcatgcaactagaaggtgtcagaactctgacttaaatacaggtgttttcaattccccttcaacattcttttcaaaggcaatatttgtgggagaaatgttcaaaaccaccactgtgttaacattttataactgtattcacctgactattataatttttgtattatgtgtactacagatgatctagatgatacaggttaggacattatgcccattgactactggtattcattcagtttcatatctataacgtaaaatgatttcttataaatgaaattaaaatactttttttatcattccaccaaagactattttaaactgccttgtttagtgacatatgtacagtgtggtaaactgacattataactcatttttttcttgtcattctttagacttcctgctatatcctgatcatcactattgcaaatattgcaaatttggccagtactgctactgcaatcacaatccaaagggattggattgttgttgttgcaggagaagacagaagcaaactagcaagtaatttggctttctcttttaatgaaatgagcatgttaggattcactttaaatcggtggtgataaatgaggctgtaagccttgtatttttgttctgggtattttttaagaatgataaattgaaagcatactttttttcttaccttattgtcagttttagtgctgatttatctcactgttacgaagttaacttataggatagctaacttctcttttatcctacacaaacttggcaaatggaataacttttctttcctctttttttttttaaaaaaaaaattcaatcaactttctaaatgtttatacttagaacagtgcaaatctgacatgagattttactggtcatacctatgaatgttattactggtgcttatcaatcatatggatgttatttttctctaaatcaaatggaaacaattgtaggagagactctagaagttaatttcttccatcttaaagttataatctataattttattacattatgtacaatgtaatataattgctgttacaaataccaaagaaatagaggacagaatatagtttttaagaagcttaccatcttagttgttcattgggaatataaacaagtggtcaaagaacatctgaagaatgcttacaaggcaacatgtcctattctgtcaatattacttaggctcagaataacctccctcactcattattgcctgccgtcccctcatatgacacacagacacaatttggattgacacaaattggaattacaattcccctgtgtaaggaggaagggtacacctccctacctgtcagatcagctgagtcaactctgctgatcactgagataatgggtataacaaacacattgcccaactgtcctgacagacaagtaaaccattcttgatgacttaaatggcatatcccaggatacagaaggcaagattatgtgctggggttagcaagcagctttgtttggaccatttggttaaaaaaaaagttagaaaggaggggtgagtgaaggagaacaaagtctgtggaaggtctagaagaagaatttgcctgaatcatcactttgtggttgcagtattattattgagttagaaattccacagtgattgatttaaaggatggtgtgtatgtaagatgaatttagcatgtgtgaatctgtatcacaggaaattctctctggagctaaaatcatgattctcatttacttttcttcctgtgatcatttataatgaggaataatttcatgtcttttttgtcacattgaactagatgataaggctttgtctttttttgtttactttctctttttaacaaactacttaaagcatgtaaaatatatccatgttttaaaattcaaagggtacaaaaggatatattttgacaatagatcacacatatatttgttggaatatacttagagaagaaagttgacttttacaatgattattctgtgatttgtgcagcagctatagataaaatgaaaataaaattattttctttcacttaactgattttaactaactcatttgactctgcaaagtctgaaatatgaaaaagaaagttagccagaatctttaacttgtcctaagatatatatatacacacacacatatatatacacatatatatatacacacatacatatatatagatgtgtatatatatacatacatatataggtgtgtatatatatatacatacatatataggtgtgtatatatatatacatacatatataggtgtatatatatatacatacatatatatacacacatcatataaatataactgcaaacatgccacataactctgggatttttctatgaagtgatgtccaagaataacaacaaaaatatgactggtcgtttctcagctgtctgtctttatattatgaattattgcagagtggaagaatctaggctattcagtctttttctaactttctgatgtttttcaagtaggaaaggaagtgagatgtttgttgaactcttgtccactctacattagcttttagtaagtggtgctctttcacatccagccagcagtgtgggctggtggactagtgaaggaaaactttctgcatgtttcaaaacaggaaacagaaacttctttagttctgaaggtcagaaagtatctaattgtggattttttgtgccatttctgctattgcagagttaaaggagaacagagaaaaaggaggaggataaaggaaaaatgggacaaagaagggggaaagtacatctagaagggactccacctgctgccttgggttcctatgaggttgtgtctcttatacacagacccacctactccaggcaggaaggatttgtgtttatgcaggctgatttttgaggttgtggcaaagaaacccaggtaggggcctaggccaggaaggcttcacctgtttgtgatatgtttagagggtgaaaggggaggggtatgcccatgaaaagtaaaagttttgagctggatgctgattgctcccatttcctcatcacagtgtttcttaattttagagattgttttaaaactagaagctgtatcactgagggtaaaagaaaaggaggaattttccctgccaaggttaaaaagttttagaatttcagtggcatcaggccaaaatacagcagtcattatccagtttggaaagttccagaaaaggtgttttatttttctcatgaatactgctaaccagttaactaatttaggtactttctaggtgcttgatttagtacagtgttttatgataacattctcttgtgccacgtttgaatcttacttccttttcccaggctttttaactccatctattgctttttttcctcctccatttcttttgaggatcactctttattagtatcttctgagatttttcttgcccatcatgctaaaaaataatctgccagttagcttgatcaagtatggcagataaattttgtgttcgtgtggtattgattaaaaatcgatttcatatatgaagtagacaaaactgctaggaaatttaaaagaatttttcttctatggatgtaatatacccattataatagaagtagttatttaatgtcatgttctgtgccacagctgtagctgagaacagttaaattggaatcaaatcaacacatatttgtgtgcttatgtaagactaaatataaattggtaaagagcgtatatttgcatattcataagactgattcttttctagcctgctaccagtaagatgattaagtcttttttttttttgagacggagtctcgctttgtcacccaggctggagtgcagtggcacagtctcaactcactgcaagctccgcctcctgggttcacgccattctcctgcctcagcctcctgagtagctgtgactacaggcgcccgccaccatgcccggctaatttttttgtatttttagtagagacagggtttcactgtgttagccaggatggtcttgatctcctgacctcgtgatccacccgcctcggcctcccaaagtgctgggattacaggcgtgggccactgcacccggcctaagtcttttttttttttttttaattatccattctgcatcagaaaaataaaagctgttttttaatacaacatttctactgacacctacatattattaactttctaagtataatataaaagatggaaattggtgacattgggaagctccgtgagctcttaaaaactgaagtagtgaaagggtaagaaataattttaactaaaataatttgttgttgtcattctgggactttaagattcaaatatatgttttctttagttacttgctttttggattccaattattgagttatttggataaattccacacttctctgttggcatatgagttggaaacttattagttagtgggaggcagatggtagtgaaacctctgcggtggcagtcaagtgtaagatcaatgaaggctgcctttgcctctcaagtgaaaggtgaaatatgtcaaagttctcctgttatcatatatgcaatatatactcatagggctaattggaaagcaattgaggaccaggaagaattacagaaggaataaaggcaatcttctgttaatgtacttcttcgtcacgtattgtttttctgttaaggtgacccaaatgattgcttaagacttgtctcactaattttcactctgttctgtgagacaggaagtgaaaaagtagatcactttcttcactttctttttgtcctaaaacttttggttttattttattttaattaattttttatactgacacataattgtgcttattatggagtacatagtgatgttgtgatgagatgagatggagatacatctccatcatctcaaacatgtatcatttctttgtgttggacatttttttaacttcctctttattgattttgtcctgcactctgactcaggaatacattcccgtagtcaaactctagactttgttatcaccactaaattctctcctcccataatctcagtcttaggcatccatattttgagaaatcaccttctgtctttccaccaacttcttcactaccacagcctcaacaatccatgtggttggcacctacaaaccattcattccactgccttttcactgtccatgatctctctcttgtctctttcttacccagcttaaaattcaaggccagtcatgattatatgatcatctcttggcatataccctcagctcagttggccccctctcgttttgtcacttttgtttggtaagactttggttaaatccaactttccacagtagagcatggctggaaaaaaatgcacgaacttgctcagcattctcacttgaggttcagggccacagagttggtcctttcatgcttccagataatcacactattttctctgattctttccttctccactttcctagaggaccattcacagttgtttctcctctctcatcacatgttcaagtcctcctcccccatcctcactttcgtcaatgacctggctttgtattttgctgagaaaatggaataaatgagaagaaagcttccatgtgattccaccatcatgtctctcttcctacctgtacctgaagccatatatgtggtctctactcttgttactattgatgaattgtgttcctgtctaagagcaactccttcagttatgcggtagattcagattacatcccttatctactgtatcattccaggcagcacataatcctgctctaattttgctcctcttaaaaatccctatctttagcacacttccttctctgctactctatttctttgttcttctttttgtcaaaacatatccaaaagacttgtctatttccaattccattttttgggcagtaccttgctttccataaggccatgggaagcattcacattgtgctccagggtatgactcactgaaaatacaaatggtgtcccctggggttggcaccagtctcttaaatcagctttattcaggcattgcccttatcgttctcctttttttgaggtctccagaatctctcttgtgaccaagctagtgtttcttttcagtgcttctcgttgctgtgatgctctttttttcagtgagtcctctgacctcgccttatttagaacattcccctgggcactctctgcccttttgcttcattacttttcaccatagtatttaataaacatctgacatatgcagtgtttgtgtgtgtatacacacacacacacacgcacacacacacacacatatgcttgttgatttattgtcttttctttcctgtgagaatataaactctgtgaagacagggaagaatgttacttttcttctttatagtgttaagaattgttgagaataatgactagcttataataggcatttaagatatatttgttgaaaaaaatgaatgtagagtcactgctgtattcattttaaaaagctattagactgatttatgcaattccaaggggattatcattgttgaggcaaatttagtgggacttgacccaaacaacaaatatttttccaacaaaatgtctttcttacaaatgtacttttagaaaaccacattttaggaatctatactcttggtttacagctttgtattgtgtaaatgggcagtctctctttgatgggtttgcacacttacctgcctctttcacctgcctctctagatatgaatgccacaatacgaaggattgaccagttaaccaacatcttagcccccatggctgttggccagattatgacatttggctccccagtcatcggctgtggctttatttcgggatggaacttggtatccatgtgcgtggagtacgttctgctctggaaggtttaccagaaaaccccagctctagctgtgaaagctggtcttaaagaagaggaaactgaattgaaacagctgaatttacacaaaggtaaactgaacacaatgatctctccttttgttctcatgttcagaccttaaatgttggtgaagatcaaaactattttgaatttgtatcaggttttattaccagtgggggccagatgaggttaaatatatcgctttggtagacgaggcaagagcaggcttttgaggatctagggaaaaactccgggttgaatctggtggggttagaatgggtcccctagccctcttccttgatgtgagcagtagttatagaggttcaattttacttgagagatagctgggcaaagctaagtcataggactgggaaaaaatgtggggaaaaaaagagaatgagagaatcccttggactctgtgaggagggagttatgtagtcatttgtaggacagtggaagggagtgaggacacaaagatgggtatttcactggagaagaggacgctgggcttctgggtaaacagaatcttttatccagctctgcagggacccagaaaataatatgctggttgttttttgtttttttgagacagagtctcgctctgttgcccaggctggagtgcagtggcgcgatcttggctcactgcaagctctgcctcctgggttcacgccattctcctgcctcagcctcccaagtagctgggattgcaggcatccaccaccacacccggctaattttttgtatttttagtagagacggggtttcaccatgttagccaggatggtcttgatctcctgacctcgtgatctgcccgcctcggcctcccaaagtgctgggattacaggtgtgagccaccgtgcctggccaatacgctgtgtttttttagacaattttaatattttatctggtgagttttcctgctgtttactttggtgggagtataatttctaagagcaagagagagagagaaaaaaaagagggatagatcaatagtattttgtttatttaataaaaatgacacttgatgattattccttggctggaattcttagattattagtaaaagaaaatacatattacaatgtctaaccaagggtacccattgggaaggggaatagaaggaaaaaaagtactactaataattggcttttatttctacatgtcctccccaacaaaataatggtatcttttcttaacagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtaagaaatctctttttatatattaatgaactaaagtgtctttttgtaatgtaggttcagagaatccattaataaatgatctgaaatgttccctaaatgttaatttaagcaaaatccactcttacgaaatttttattttacatatttatactttatatttattgtgttttttattttatagtttgaaaacctgtatttgtttactttattatatacatatacttaaaacatggttcaggcttgaaaataattttttctaaatgaatatcttaaatattacttgtttttttttttgtttttttttttttgagatcagggtcttgctctgttacccaggctggagtgcagtggtgcagtcacagctcactgcagcctcgacctcctgggatcaagcagtcctcctgcctcagtcccccaagtagctgggactacagccatgtgccaccataccttgctaatttttgtatgttttgtagagatggggttttgccatgttgccgaaggtggtcttgaattactgagctcaagtgattactttttaaatgtaatttaatttataaaagatattagctatattaattatactgccatctagtagagtcttgatattgcaataaccttaacaaaaaaactgtagtttagaaaatattcccataggacaacactaaaaaggtaatgtttttggctttaaaagaagatgtgaaagtgataaaaaaaatccttcaaaggtcttctctagccaatatgtatttattatatagtttgccacacaaatggattttatagccctggaaggaaacataaagacttcttacaaagcaaaatttaagtaataattaatagagtactgatgaattatctctgaattcagtcttgaaatgaaactgtttttatcttgtgatacaaaacagttcattagtttattgaagatattaatttccaggcaagacagctttattgtttgggctttagaactctagcagtaatataacaatggtttaaagtttccttacactttaaccataaccatttattaggtcatttgaaacttaaaaaatactagtacttatactataataggatttattatgtctctgatttcaaagttttgtttttgtagtatgaataatcacagaaaaacagaactaagaagtttgtagattagacttctttttgtctgatgactgtaaaaatcatttattgaggccactaataacccaatatttatttatgaaaaataattcttaaggcaaggctatggtatatttaaggtgacttaaagacagtcaggctaaaatgtatattttgcatatgtcaacagatttttatctgtgatttgaaatgtatgcctgtaaactaaaatctaatctttaaaaaaatattttattataggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaatttttcctgaattctgttccccaattatttaacaaggcttttgttacagaacatctgttttgggtaacttgtttttctctataaagggctacagtgtcatgatttttagtgttatctccctgttcatatttctagtttatggtggactggataaaagtgtagtagacatgaggcccagcactctttctttgactttgaatatgtcacactaagcacttttaagttctcacttctattttcccttctgtaaattggaaatgatagtaaaaacaaccctacctacctttcaactttcctggttgaatgaaataagagaagccatgtggaattacttagtgaactacaagacaaggcagcatttttactagaggttggaccttagtaatgacggggagctgaggagagatgtctgctgcctctagagagagtagagccacattctgcataaaggaaacatttattggggacttgatctaaactgttatcagtcctagggattcagactggactcagacatagttgatcagagcctcctttcctttctcctaaaattgagaacttgagagcatttggcatcgccctgcagctactgatctgttcatgatgtttgtgcaaactagatgcctctgttaggtttggctgctgtcttgaactggctctctgctccctcccacaggggtcaaggctgggattgaagatctgtcctgaatgtttgcagctgtaactgaaggcctatgaccttgaaaaatgaacagaaccacattagcaaggggaggcctcagctcttaatatgggcattttgccattctgtgcatctagtgagagaggccctgtgtaggaagaagaagcatggagttgaagagttaataggaatttttacagctgttgctcttacctttgcagactactgctcagagcaggaagaggaaggaagtggaaaagaatcactgctggtctggacagcctttgttgtttacttcctcagaccacagaagtagggcaggggtaggtgacctgtgtggctgtgttatgggggtgcttctaaatatggggtcaaactcaaataactgcagagccaattaggtcattaaaatgaatgaagtagatttgaaataggaaaatactcgttttatatgtaattgcattttaccgaagtatttaattttgttcccacttaaaaacaaattcattacattttttttcctgcttttctctgttgcaggcttcttacagttattaagttggttctttcagcatacacaccctttgtttgcatattaaacataggtaaatcatcttcatttctataaagaaatatcccccttttttggaaaatctggcttgattttttttttttcctttttccctaccctttaagaaaataaaagtgtaaataagaaattactttactgtttcccataagacaaaagacagtacaagaggcatgctaaatgacacatggccttggcagtcctactggagtggtaatagggtacacccaggttaacgggtcagctgtaagcactccccgttgccatgctggaatgtgggtcctgtgttgtcagatcttttgatcttcaaagaggagctggggattctggaatctccaaattcttttttgtttgtttgtttgtttgttgtttttgagacagagtctcactctgtcacccagggtggagtgcagtggcatgatctgggctcactgcaacctccgcctcctgggttcaagcaattcttgtgcctcagcctcccgagtagctggggctataggcccccaccaccacacccagctaatttttgtatttttagtagagaaggggtttcaccatgttggcctggcttgtctcgaactcctgacgtcagttgatctgactgccttggcctcccaaagtgctggattactagcgtgagccactgcctctggcctgggatctccaaattcttaaatattgacaacttatttgaaagtgctaaaaatactttgctagccaaacaaaatacatgccattttaaaagcttttctctc

SEQ ID NO: 13875 - DNA, 221545 bp, Human
taatgctactggtaattaagcttttactacctgcttttatacagtattctgaggcacagtttttgctatgtgagttctgatctagaaactttgtatgcatttagaacacaaataaaaggaattaggcctatatcttagatatagctaaatacaaggcagtgaaattgctttcttctgtggggggaccaaatcatgtctgtcatttttatattctgaattttaatgtggctgctctattttagtgttttggttttttaaagacctagaaaatttgagagggttaagggagttgagtcctaatttagtgaatttaacatacgatgaatatctgaactaatttattttgatctcaaagattatactatttctatcatgtaggacttaagatgtaaaaggttgataagcagtagagctgaattatatcaaaattgtgggtttttcactctccataaggtagcagttatctctttgccataaatagctggtatctattccaatgtacatttgctagtataaaaaaatcctgtagattaaaataggacctaagcaaactctttgttatatggaaattaaagacacggtgtacacaattgaaggaggaaaaaacacacttgtcctcttatatcctccttttatttttatttttttgaacacttttgattgagaattcttagttttgtaaattattatctgtttgaaactagttcttatagtgaccagactgtgtgatggtttataaaatgtttctgggttgatttttttaaagcatatagggtgccttatgtatagaaacaaatgtgtacactgtgttttatttgaaagcaggatgttttgggtaaaatcatatataaaattatatgcctcctagtttggaagcttgtattgaaatatatacatataattaagaatacttttagtgcactgtttagtaatgctctccctacaaaaaaaaaaaaaaaaatgctgtctttattttgtcaaaatgcatcgagagagatttaattcgctatttacccccacagccctcagactccccacccctaaaactgaagaagccaatttgtcctgcggctgtttaccgttgttttgaaaagctatgcgttgtatctatatgtaaagagacagtcgcaggtatagaaaggtttacacatataatttacttaggcattctttcaaattgtattgtcactatctcctcttctgtagttgtgtaaaactgcattccacctcagagatgacgatcccagttcacatgctcaaacaatttagaagaatgcctttattattattatttttaatgcccagcatacatcaggaaaacaggaaaagacatgattaggaatacatgagaaagtacagcaccaaataagccgcggcccccggtgtaataaaaacacagacaacggcaggacaaacttaattctctaccttccgcagaatcctttcccaaattaactgagagtctgcgtgagttctccttttcaaggcaaaagagatcttaggttagaaatcaaaggcaaatccctccagtgcttagagagttaagttagttatgtttcttttgtagcttcccagaagaaaaaaaaaagaaagagagagaagggaggaaaaaaaatcaaacccgagagtgtgtattgggagcgtttcaatcgctcccttctccgctccctttttctctgcccactctcagtttccagcccccttcggctctctgcaccctgcctacctgcctggctcctctcgctccgtgcagcctcccgtcgcctccctcctgattgggcagaggccccccaatcggctgcgcggctgggccggtgggactgcatatgtaaagccctacttcatattaataagctccaatcggggctttaagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagtaggtaccttttttctttcctttttaaactcgtcgtgggggtgcgggggtgggggcggacagactatatctttacacactgattcaggtaatgccctgggtattttgtgtgcacgactgcttgtttgtgtctgtcttgtgccttttgtgttgagggtgatctcctaattcagtaagtcgagaattgttctctgactacaatgttacctttgaggcaaagctcagtgactgtcagtaaaacagctgtgtgacagtcacttcttattcaggtgctaagaataggcacttggcacaaatgcttagtgaactgttaaaatgcatcttttactaggacccattttcccaaggaaagatgttttaaaatacaatattcaaaatgatttatactattgagggcctcttatgtatttgcagtttgacagatattttcagctccttgtcatttcttaccgcgcagagttagaggcaaaattgcacatttactaattctccttcagagaacaatttaaaagctagccctatgcaattctgagctagaataatgttatttgcatggttagcgttaagtcagcacttaactgacaaatcagtccattaagtaacatgagattttcacacattataaatatttaaggggggaaaaaaaactaaagaagaaacagtagtgactttaaaattttccccttaaatactgctcagagtgtggatttgtctcgtttgttgtgtccagaaaatatagaaaagtactttcgttcttacaagcagtttaattagtatttatggatatctttatgcacatggaaatatatatttagattactaaaggggggggagtgagtagggggtacgagaagtaagttaggcatttttgtgtaaatgagtaggtgataaacttaatttcaacctactgttaagataaaatgttagtatatcacgagagctgtcactggtttatctccctttctgttgagtcagttatattgctttgctttcacattacagtaataccaactgttataattctgaaaagagtgcccttggcaaacatttctctctatagattgtgaagaaaatatcaaactctagaagatgaggtagtgcattataggtagatgtccactagctgtccttagtgactgcatattgcattgctttgtaattaagtaagagatgaaaagtgacttgcagtctcagtggctgctcctgtatgtttgagcgtgagtgtgagtgtgtgtgtgtatgcacgctcacacatgcacatccacccacatccatgctcacacagggaatattagccaagagatggatttaggaggaactgaaagattataaggctgtgcttgcatcagtttgaaacactcaagggaagaaacaaccttaagatgtgtaaaaataaaaatgaaaaataaacaaaggtaggactgcccgctcaagtgtagtttgaaggttagtgtacttcgggctgtagaattggagagtttaagacgtcttcgtgtcaggaagaatgtcttatccaagcacgcccagattctgaactttctcttgtaaataaataaagaaaacaaactttaaaaatcccccagaggcttctttttgaagtagtttccttgaatttaacttcttatagctaatttgaataattcgtttagataagcctcttaaagcagatgcatttaaatgaagtcaaggcacatgtccttttggctttggcgcaagattcaaactagctttcttttgggctcaattaaaagtcatctttaaaaaatacagatttattgtctggatgcagttctgatggttacgtggttcactggacagacagaaagatctaacgctaagcaacgcatctgcctctctgtctcaattaataaaccacagaatttatacatgctattaatattcatagtaattgtaccgggttaaaccccatcacgtgtgtgtatacacagaaatgaaaccagagttatacagttttaggggcaaatattggacagtttctgctttggaggctgttaaaaagattcataccatttattgaccaccattaagagagcttaaaatgttaacctctaactatgtatttttttattttaggaaatgtgccagcacattaaagaacataatacttgaaagcttgtttcacatttaatagcagtaatagctgatagcataaatagatgaaaataatatatctgctcattttgacatatgtgtcagtctaatcattctaaatgagtgtgctcatcacatgaatccctttcaacctctgattaaaatgtaacattgactacaggattatagagcggacttaattttactgactgttttaacagttgtcacagctgttggaagaaggaaaggcaactgaaacactccaaaacagacaaggcgaggagggaacagtttagtaaatttcagcctgatcactgaagtccagacattgaaaatttaagtttcgtgttttaagattcgtgtttggagctacacaagttttattttgtatgtttcactctttctgtttcagggttttcatgttttttctttttctcatctcttctttttaaaatctatactaattaaaaaacaagacaatcccaaagtaattccataatgtcaaattataggtgataaaataggcagaaagaaaaaatttatacagtaacagtaacaacaacaaaaaagccgagatcagaggggatgccttttttttagggaatgataagagcttggccaagtcactttagatgtgatattatttgagaactctgaacagacactttaagtttattttttcaagtaagaatacttaaactctagacttggagctcacatgacttttcttcatgttttgttttttattttttttccctacaatcttgaaaacacctgcagccttaaaggtatgtggtgttggtggagttttcagatgatttctctgtaaactgcttgaagtgacaatcagctgcaattagttgtgagcattcttgagctgtagttttgtaaccttgcccattacattactaaagtgagcggattaattctattttcctaaaaattaagtaatcattgtacatgttccaaactatatatagttgaaatggccagatgactagtattatgtaacatatgattttctccttgaagtaaacaacaaaaaaacaactgttcctgagttaatgaaatatatattgaatgggagtggtggataaatgatgggtaccccatgttccactagccctttgtgtcagggtatttatgtattaccctatacacatttggtggtaagtttaaaaatcccttttttatagaaaggactaagaaacagctttcatttcctgggcagagctaagggtgatggtgttggctatttcttcttacagtgatggtttctcatcttaatgtgtttatggcactgctgctttatttactgagcctagtgtgttgcagcggtaattaacccatgttattagcaaagcccttgtggatatccattaattctcttgcatggatgatcatttttctagtgttttccccaaataaggtatcattgttctgtttttttccctaaattgacggcatttgatatatttctttgatttaatctgacctgtaatatatattggtcattttataaagaataataattaactcagcttttaaaaatgctaatagaagcaggaggaaagatttttttgttgttgttctttttaaagtgaaaaaagaaaagaaaagaaggtttaaaaataatgcaggaaatcagctttaactctaaatttttcagatcttacaatttataacaatttatatctttgaggtattttaatcagtttttttcttacttagttaataacacttcaggcatttttgtaaaatattgagccagcagaaaaatacttgtgcttcctggctgagaaaagataaggaccatctcattagccgggccatacttttgcaattaattttagatacctggtgctattcatcaaagaaggaagctaacttctctatgattctatttaacaatacttttgcaatacctcactcctgcaagaattacagacaaagaagaagccattcttttggaaggtaggcataatgcccaatctcaagtccgtatcacttacgaaaaattcctcaacatttgttttagctcaatgactaaagaaaatatttctctgtcttacttgtaaagtgatgttaagcactgaaggttttgctttgtattattttataaaataaattatatgctgatgagagatactttttcatacaaatggcaattaatagcaatgatttctattaaaccaattaatatcaaataaactttttagcatcacttatccagcttttagaaataagaggagaggatctgagggatctcagtagaactttagagtcattgcagcagataagctttgctctgaattttgcttcatagcaaattcatggaagagagaaacaatacaatgttgatctgttataagtgcgtatgagctccggccctagccagctctctggagaaaatctttgattacactggcccagtttgttccatttttatctcttttacatccactggcattgtattaaattgtcatgtcctaaagcacaacagatagaatgaattgcagttctctacattctctgacagtgagatatttagcctctctttctccaatcatacttatgtgtatatttgatagtgcaaggatgacaccaagcatctctgctgcttgacaatctttccattgcattttgtatgtttttgtcattgatttttttgatagccatgtatatgtggatatacatgaactatactattattaataaataaatacacacatggtactttaaaactcaaagcagtcgataggatacccaggagtatatttgtgtgcatgtatagtatgcatgtgaaatatgcatgtatgtgggaagaggtaatgtatacgtagattataggtatgctgctaaaagtattcatgtacatttatataataaagtagatctcaagtattattctaatcagttagttgccagttaaatttgccaggcatgattttaacctggaattggtatttcaggtatttacagatctgattttaatctgagtttacttaactactgtgtgttagacaggtaacaggtaacctagtaagtcaatttgtttctgattttagaattttcacattattgttattcatgtattcagtatctggaaatcataaataatttgtaaaataggaaagaaactactgatattaaatgtataatttaatggtttgggcccatatccaagaaacaattttgaattagctcttggctacattcttttcttacacaattgggcctgacaaatacatcttaatgtaaagcatgatagctttcaaacaaatgcaaaatatgaatttcctttatctgtactacataaacatatcatttgctctttttctaaaagcaaatatataaaactataagtattatatttctataaagtacattatagatttcagaattatttaattttattctaagaggtaagtttagaagtctgtgaatttacttagtaaatgactgttgagagaaagcacttatgcaattgctttttctattctaattcttgttctaattcatgttctttttaaaattcctagattcattgcctacctttatttatttgcataacattttaacaaatttactgctattgtgtttttaaaaaaattctgctaaccgcttctttatgccaatctatcagatcaaagttagctcctttattatctgagggtgggaaatgacagccttttgaaggatttacctggccttttattcttgtttcaagttcatttttagtcttgtactttgtaaggtctaggaaacctaagctaataaaataatttccattcagagttttagcacacacatctctccactctactttttctttccagaagtgacacatgtttcttgtcctatgatttggacaatatttctcagtattttccaaatgtgttttctaatcaattatccaggattttccaaaagtatcttccactcaattatccaaaactattgaattgagagagtttagatttattgagtgttgtatatatgtgtgtatatacacaaatttccccttataatgtttaaaaataattttaaatgtttgagggaaacttgcttttgatgttttgatttcttcaaatgatatgtcattttaatttatgacaatgcatgtatacttggaaggtaacttactgaggcaaaacaatgaaagaaaaggtacagttttaaagaaattggcttctttctggtcagttaaagtccatttcagtatactggcaaagatctatatgtgcatttgaatgtagctataaaccacgcaacactaacaattagaaatacaacctatggctatatggaattctttcaaacaatatagaaaaggaaaacacttggttttggcatttaaaaaattttaaatacctattaaattgccaaaacttacagggagcctacttcagattagattaaattctaaaagaagaactgaaaagtacatttatattttaattataaaaaatagtctttgtcatatatattcctctgtgacttctcatttttctttgagtgaaacaaaatttcatatatacttttcatcattttggttggaagtacacattatgtgtaatatgctttggcaggacttacctagccaaagaaaacaaattaatattgggcatactgagggctgtcaggcatatcacagacatgtcaatttaactttgcttcattatacaccttttctgcaaacagttggctaagatggtactaaataaaagggaagctaccaataaattctcatatcagattgatggctagtataaatgtaatgaaaaaacagcttgcttgcttacttatctttaaaaatgaactgtaggaatacagatagcatagatagcaataagtttccaagaaaaaaataaattaggttcattcaaatttttctactaccttgaaagtaaaataggtttagaaagacaaaagtctctgaagtggtgaacctcagtggctcttatttatgaagtaaataaaaacttgaagaagtggagaatccaaaggaacacggacaatccacctttatcaggggacacctctttttgttgcactttgcatatgttttctggaaaacaaaaaaatcttacgctttctttttgtatggcatattcaatatgcaaaaacaaaagaaaattaaaatataaattaagaacttatgtacagaaaataggcagaagcacactaaattctttttttccatgatcacaacaatacctttgtaaatgataattcctttttcatctactctagaaagattttactcatttttcatggcttttgagaatttgaacaaaggattcattaaagaaatatgtatttttttcatactcacaatgtgagttaaaatatcttaaaaggatacttttcaaggcagttattatgtaacaatatttataagaacttatgttgctttgaaaataatagtaaatgcatattagtcatatatccagaactgcatccaaaattaaccaaaataacaggtcatataaaaaattatagactgaggtactcattaaagagaaaaaaaataaactgtgaggttgttcaattgattgccctttgccctccataattccaaattatcctagtacattaacttctccaaaaatgtaagatgggcatgttaaattgtattcattttcacataaataaaagaatattctgataatttttaatttcttttcagccattaatccattaaaacagatcagatattttgaggaggaatatcatacccgtaaccaactgttcatgaccaaagaaagggaaagatgtatatggttggtgagaaccatgtctttttcctatgagaaagtgactgtatacagttggtgctgggtcctatgaaatgacggaaacatcccttttatccatagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggtgggagcatgtggccgcctttttctgttctctcgtagtcattcagcaaagggaggtgaggaacaaatggacaatttatgcacagaagctcaggcagagattctttcctagggtcaggaatttgttgttactcagtcattcaagtagatttccgatttctcttatgctctagaaatgtcattgttatctttcatgctccaaagtactacccgtaaatgattaggtgtgtctttcaattcgtatgagccatgacctagtttaagcattttttaatagatagaaatggagaacagatcatctatttacattaatgtgaatgatgattcttttttcatgtctttatattgaactattcagttggttaagtctgaagaataagacaaataataagaggttaaaaactcaaattgtatttttttatttctttattttcttatagtgaacaaaactttaatgtctagagcatttatgagggttttaatgattggaaaatctatcctgagaatgtggtcaccatatgtgacagccttgctttctatcttgtcttcagtttctggggtaagttcggtgatattgtctattgtcttcctttgcttacattatagaacttctctgctgccacattgagataacctgaagtgtggggggaatgcctgctaagttctaaaacactttcctaaacaccttcccttcctctatcccggcagtattttcctttacaatttctgtttctattcatctgttttattaaagggtcatttactttggtaaaaggtaagtgcatgatattcacccatatttgcatacagagtacacctgattttccctctgaattccaaagagattgccttcaactttttatatttgtttttctttttgtttctgtttgtagtgcattctagttgagtgcttttatagtgttttcttgattgttgtcagtttgggatactggaggctgacatttttgctaagttaatgtcacagcagaaaaacctatggtaaactggaatctggctatagtgcatagaagatacaacttatgtttgattgtgtgtaaatacagttagttagttgggggtttatcagatagcttggcagaaagagagaggagcagtacaaactgttttcagttaactgtgctgttcatacacctgataagactgagagagcttttcgaaatgctgataggctttgaataagaaaagaataatcacttctactggcaccagcttatcaggaatgaagtaaaatgccaacactgttacattagcaaaagtaaatgttttagacactctgtgccttttttcattcaagttaaataggaggggtgcttttgagtgtgctgttatgaatagagggatttattaccttgatgaaattacaggtgaatatgttgataaaagaaacttcagcatcaacagcagcttctttgataagcaggtgcgtctctgctgtacattctctggagaaattaagtactcctttctccactccaattctattaaacatcatttctgatgttagaagatgcagttatgccctatgtcaatccagtctccctcttttttcagcagatgggttacaggtatttgaaacttagctgatcagacttgtaaaatgctagtgtgctctggttaaataagttagggcatctgtgagttgtgctgaacgagcaaactcctacaggagaaatcttttttttttttttttcaagaaaggaatgagattaattataaagttaggattctttaatgagaagataaatgtatttgtccaagtaatagtccatcttaaagcacctccctttgaaaaaagagatattggtttttttcttcaatacaaaccattaactctcccagttctgccattttctcttctttgtaatttgacgcctacaaataatttggcgtattcagatttgataagtgatagtgcaagagcaaattgattgattttggattactattgattactctcaatgagatcactgtgacacactcaaatcaatagtattcgattaagcaaggcaccaccgttctatacattcagcagcagtggggaattcaggaacagaatgttcacaagctgataaattgacaaagcgttcagctttaaatagccctttgttcagtactagtttcttaaaatatatttcattggaaagttcgtttttgcaacttgggacctttctgtggaagaaaggtcatcagtttaaggtttattaaattttcactaaaaacaactgggctccatttaggtgtaaaataatttaagtacttactgcaggcaaccttcatgcttttaagctgttgctcaaaggtttcattcttttatgaagatgtcaattgtaaacataaaaatgcatcactggaaatgtaatggtttaagattcaacggaaataaaaattcctgcctgaggaaagcactataatcaaaataaggtggtcttcactttcttcagaagtgggcaagcttagcagcagtgctgggaggcagcagcaggtagcgcaccttgataaagcgcacagctgcttatatttttctccttctcatctgagggtattcatcacgtcgccaatactacatgcaaaacactaaatatcatttcatctgaaaaccgccactactgctgatacactgaaatctttttgtcctgagtaaacttagaaagtcgctggaaaaaaaattatccatgtctcaaatcctttagccaaggacctcaaggataagattttctatcatattccattattgtgcagtcttggcacttggaatgaagcatttgctcttccgttatatagcattgctaagtggcttcaccaaagggggaccatatagtaaacactccattgaatacgtaaatgttcttacatgcaaaaaacttcatttcacatgaaatgtttaccactagggcctatgtacccaagactttaataggttccagtcttaaaataaacttagataagttctctcattttgatattaattaaaaaattgatgtggctttctgagggaaaaaggaataggaaggtcaaatttgaaatcataaaattccttgatgaaacatcagacttttttgaatgaaagcaaggtaatagaattctaattatattagaaagaatcatgtgaagttgccatttttgtaggtcaaacaatggtcaagtatcagtaatttcatatgattcaacacaataattgaatttatttctctaccattcatattccataatcaaattgaaagcaacaacttttttaaaattatttttctgatgggctgtcacagatgatgggagacacatgaattctatctacaattataccaagtatattataatatcatttttagcaactttttttctctaacatcattacagagctgccaagtataaagtattgtacacactgaaaaagtttacatttatctgatatgtcttctgcggttgcttagcttcttttgagaatccatgtaaaatttgcatctgctgaggaagaccatgtcacaaatgccagagaaacctcctattagaacacagtagtgacctaggaagagcacattgctaagggtaaagggtttcaaaacaaattggggaaaagataccaacacctcaaatatttcatcctcacattcattcgttaagagaaccttaatatgctagttagtgctttttgtgtttcccccagagaagtattaaaactgtgctccatgaaatctgtgcaccgctgtggtgtgggcagctgcagaactccccgagttggcagtggagccgaggatgctttattggctattgcagtcaggaaaggtgccccaggagttgtaataaaatgatcccagagccaccatttgacccccagatgtgcagctcctattggagctgtcctgcagtggccaataggagctttccttgcccacctgcggcagaacctggctcccagataggaaggaaattggctcggtcgataggtaggagggaggggctctgatgccaccactagaaatgtcagcacaaagtgcttcttaacttagggtcacgtcaggactcagtacgtttttctcattctgggtaaatgcacgacagcttacatcttgtttcaacgagaagggtgggcatcgtttactgaaacttgattgagcgaatgcctctgcctggtcccactgtcagtcttggagttttcccttagtagtgcatttcccccctgtctgtggcactgaatttgatttatcgctggtactaagatcaaaaaagaaatcattccttttgatgtttgctattaggcgcatgcagtgcagcggggtgggggcggtgggaagagagcagtcttagtacacaagtcactgtcctggccacaccatggacaccaatggcagaatatatttattctctgttcactttggatgcaaaattccatgagtagaaaggttagccatggagtatttcaaatgaataattatgtttaagtacagattcttttgctaaggactcaaagtagtgactcacatgtacacctgattacaacagcatttttaaaaactatttgcatcaattttaccaaaagacataaaaagctcaggaatgtaaataacccaatggtggtcagacttttcaaaaaaagcaattggttgcctttttttgtttagtggcaggcaaacttgggacattggagccttatctgcaaatgacaggaaagattttgtggggttgtttctcttgtcttctggaccctgggcaggctttgtttccagctctgtacagtagcttttgtccagcttcttcattagttttagtgggatttctctgagcagcgtgagccccagcccatcagcaggctgctagtcagcagcaggtgtgaacaacataaaacaggattaacactgaaccgaagtgtgtactaaaaacagaacccctgccttgttttttaaaaagacggcaggactggaagatagaagccactctggacttgtacccgccttgtttactaaacagtgttcaatgggctatgtaaatggctctgtttaggtgcagagaaggcatgcgagggagcatgcactcattttctctttttttaaaactataaactcaaaacacatgcagaaaattcttctaagactctcagaagagaaaagcaaaataaaacaaaaattaggtaaatcctgaaccaggattacaggttaatattgcaaagacactgtccttatttacaaatttggtgtgttgtattttccagctctaaaaaaaattattgtttcgtttattctaagatttttttgtgtgtttaattatgtgacttaatttatattttcaccaaggtcggcaaaccacaaataagtacaatcagtaatttcattagagagtatacatactccctccaatttttttttttaaatcagcactacctacataggaaaaaaaagctggcaaaaaaatcatagttaataaaggggtctgtatgaattcagaaaatggatcattgcattgaatcatggcatttgagtcactttgtgaatattttgtttggcaaaaagaaggggggcatttaaaagtatgtttctctttttaaattaaactaattctagtatatattagattaaaggttggatatatgttttctttattaggttcagaataacatgtattttgaaacttcagacttggccatatccaggaaaaggtctgaaataagaaaataacaatttaattaattagagaaattgaatatatatatatatatatatatacacacacacacacatacacatatatatctgtacacacatgtacatacacataactcttctttgaacacatgcaaatgtaagctttttgcatgtatatgtattgtcattacactgatttcttttttttaaattatactttaagttctgggatacatgtgcagaacttgcagttttgttacataggtatacatgagccatggtggtttgctgcacctatcaacccgtcatctacattagacatttctcctaatgctatccctcccttagccccccactctcctgcaggccccagtgtgtgttgttcccctccctgtgtccatgtgttcttattgtttgactcccacttgtgagtgagaacatgcagtgtttggttttctgttcctgtgttggtttgctgagaatgatggtttccagcttcatccacgttcctgcaaaggatgtgaactcatcctttttttatggcttcacagtattccgtggtgtatatgtgccacattttctttatccagtctatcattgaagggcatttgggttggttccaagtctttgctattgtgaacagggctgcaataaacatacgtgtgcatgtgtctttataatagaatgatttataatcctttgagtatatacccagtaatgggattgctgggtcaaatggtatttctagttctacatcctcgaggaatcaccacattgtcttccacagtggttgaactaatttacactctcatcaacagtgtaaaagcgttcctatttctccacatcctctccagcatctgctgtttcctgactttttaatgctcaccattgtagctggcgtgagatggtatctcgttttggttttggtttgcatttctccaatgaccactgtcattacactgatttctaacactccaaaaatgtgtccaaatgtagacatttatataaggtggatctatttgtgaatataatgtaaacttaactaaaagaatactattgaaatgtaaaaaattaaaattttgtttataattctctttcagtagcatcttggtaatatatattacttttattatcttttatattccaggcttaaattgtaattacatactagtttcttcattctttatttatacttattcttttatttttttaaatggcttttttttctgagactttgctactaattttattttagaagtaatattgcctaccagtttaattacgactgtcttaacacacgttgaatataccaagaatattcaaatcattatgaactacataaattctaaaaattgtttccattccacagttgctatcttaaaaaattaatctaacaccacttgccttccagtgtattttttcttaagaaatgtttattctcttctgtttagtatttttaagtatcctccattatgtacagtaattaggttatgggtacatagcttaatgatagttaataaaatcagaaaatatcagtttaaaattgattttgaagtgtattccatataaccaactctctggtgtcaaattaattgcttatagtctcacattgcatcaaaaaatattacatgtgttcttttgcagtttttaaaatcattaaagctctcaatttagtgcattgaactgcattttcttgatcattcaaaagtatttggctatgtggagacactgtcttaagcactaagatcttgaaatgaatgataaaaatatgtgaatgcatgtaaaacatttaaaaatgggatttttcatacctaagtctccaatgtaaaaaggagtcagtcttcataaaataaattcaggacttaagtagctgtagttttacataaaacttcagcaaattgcaactttcaccctaactttctggttttggctttttagaactgatgtaaagttcccatcatgaatgtaattaggaattgtgcatttagatcctgaatgtggcgagaatgtgattggggtcttggagcagtcaagtctgatctggcctgtgttccttcagctaaaaggtgggcccgattatttttctttgtgaagacttgatcaccaaagttgccattaaatcttaaaatgctcaacgttacttgtatatggtttgatttttttagactgattaatgaaaagaaaaaaaaatgcttttaaagatcatgtaagacagtatatttcccaggtagcagagaaggtaagaaggatttgtttgaactctagaaggtttatgttgtttgactttgagggaaaggtttgaattagtaaactcattccaatcaaagtaaatgactattgaaaagtagtttttataagaaaaccttgcccttaatcttgagataatctcacagctattgtctttgtccagcattcctgcaacactgcctggtagttcccaaaagcctgggatttcaatttgcctgaggactcaaagattgaattcaaagcagttctctgtttgcagcatctcttcagtggatgcattttatttaggagttttatttatttatttttgaagatacagattggtttgctccaggtcattaaaattattgtgtttcacatttttagatgtttttaattagatgattagtgaagttaggtaataagatttatattgtcatcagttaagtttatagaaggattaaaatcatggtatcagggcaccattgccaatcggaatatgccagaaatatctcgagagagtttttgtcaagtgtttatgctcaattaaaatttatactacatgttactgagcgcttgtctcaggatagcttggcatcatgatgttgtaagtttccaattgcaagtgacatgcaatgcagtttttttgtgtgttatagtattacaggattgcaaactttggaagggaaatgccacacttttagaaatgacaccagaaatatcagacaaagaactattgcaacgtgggcacagccagcattttctgcaacatcaaaaggctgtaaacatatggtttttatcttttccactccatatatgcaaaggacctttatgtaagcactgcagacatgagctgagtcatctcacctatgtttttgcttcgtttgtgggtttttttgcaaaatatttgtgaacatgctttatccagccccccacccccgccatagtctttctgagttttcccatatcactccctttgaattctcttcactttttaaagctgaggtggactgtttaaaatggatgcattcttcgtcatgtatagtgccagaatgcttcggaaaccttcaccgtagtcttaaaaaagacaaactcactaacaaagcaacaacatgaaacatcaggggttgctgggggtgggggacgaggaggaagagggcagctggtaatttatgatttctttagtattgcatgtaaaggatttgccaatgccccacttccaccccacccccaaactacacaccgctcagtgttaggatgatgataatgtacctggaaggaaaaggcagtccatgcccaggcaggcagcatcagacagggcgccttgccatctgccccacctgctgcattcatgagtccatctggtgactgcaatagctcattgtaggcctcttctgaggaacattcgggctgaaaagcaggcagtgtgaattatttaggtagctagtataaataaatagaaggaaagaagaagagtaacaggggaaggatctgaaagaacctgctgctcccttggtcctgggtgctttggaatgctttaatgcatgaaagcattcgatttgcatatagatttagatgtatagatcattgtgcagattacaaaccaatgagttttatctagatttagataatgctcagcctgttttgcacttcaaatatgggcaattccaggtagggaatctttgggactttcaacggaagtgtaactgaagaaaagtaatatttttgggtattgatttagcaaaataaaacaactgtgtgtccttttggaaacagatttttttatagtggggataacacatttgactttttagtgaataatttacacagattgtgtcctttttttccttactagatataaaaaaatagaaaataatttctatgtcaattatattcgtttatgtggccattcagaatattttagttggctaccatgtacaaagcattgttttggattttgcatatatattaatatatactaactattaaatgaaagtcttaaaacgtgtaaatctctatgtaactgtgtgttttgtgcctagataaaccacatggacaggtacctacttgattagcccaaaaaagaaatacttaaagcgattgtaaactagagtcaaacaagtcatttatactgaaatagacactgttgcaatcaggaaagtttaaacatactatttttaaagacttactggtatcttttgtatctaacaagataagtttacaaagctgtagtgtcattgtggtctaggaagagctaatttatataaaaatgattataaattgtaaatcaaagtttagaactgtgaatggaattggtagcttccagacttgaatcaaattttcctatttttcttcctcagaatcattcagaacacagtatcattttgggctgtgggtagggggttttatttaaattatgatttaaaaaaaatctactcctccaatttttacattatagattaacatagacatatacgtgtggataatattatatgttatatctagtgattatatcttattatatcttatttgttaactgagtacctatgataaagtcatgaaaagagaatttttttttaatatttcctctggctccatatgtacagaaaggcatgtgatgttttacactttagaatttactagatctttttttcttctccttcttcctcttattttggagagagacagagttttgctcttgtctcccaggctggagtgcaatggcatgatcttggctcactgcaacctctgcctcctgggttcaaacgattctcctgcctcagtctcccaactagctgggattacaggtgcccaccaccatgcctagctaaatttttttgtatttttagtagagatagggtttcaccatgttggccaggctggtcttgaacgccggacctcaggtgatccacccgcctcggccttccaaagtgttgggattacaagcgtgagccaccgcgcccagccgaatttactagatgtttagggttagttaacagtatcccacttgactcaattcagttccaaagtaaatttaaaagatctgctgtttttgagccagtgaagtgctagccttcatttaaataagcaaggtctatatggggaacggaacacacatgaaaatgaatcacattgctaactcaaaaggtaaccagtaatcctttttatattttttcaatactttttacttcaagaaaatttatttatacccagccttttcccaaaaagactttgaggtgattgattcctttttacctgcatttaaaaccattttccagcaccaaataaaatgagatattttccttacatcaagcaactctgtaaaatttaagggccgtcaataaaattcaggtgagttaggcaagactgaagtttatcccccattcacccattcttttttggctctacacttcctcctttggcatcccagctctctctcttcccacccccacattcaacaaaaatcccactcctgcacacacacaaacacacagaaacatacacacacaaacatacacacacacacacacatctatccagctttgaaaacatgccattaaaaaaagccattgtctattttttccttgcacttaaaaaaaaaagcaaaaaaaaaattacatttatacagaattagtaacaaagaccttcacttattcttaaattaccttttcctgaaaatcaggctacttctcacagagtcactggaacactgtttgctactctagacaggcaaagaaggacaaagttgacagagacaaaacttaattaaaggtaacctttatcaagcttttccaacatatggcccaggacggctttgaatgcggcccaacacagatgagtaaactttcttaaaacattataagatttttatgtgtgatttttttttaaagatcatcagttatcatagtgttagtgtatttcatatgtggcccaagacaattctttttcctatgtgacccaggaaagccaaaagcttggacacccctgcacatgttagttgttggttaactgcaagaacagtagttggctcagtatttatttgacaacttcagggaacatctatagatatcttgagactccttagataaacaaagtaattaaatgtttaaaaaatcttttaactgcatctatacaagaatacttaagcttttttctcattgccttgattggtttgtattcaccacaactcacagtgctgatttattattatttttttaaaatttaagatatactggcaagaatcctcctgagcactcttttctttccttttttattctgctgttagggtattagaatttctctgatcgaatatggacaggactagaatactagaataattcacatgtacatgatttcaccaactcatgtgcttgagtcaactttgcctggaatatctttttttttttttttttttgaggcagagtcttgctctgtttcccaggctggagtgcagtggcgtgatctcggctcactgcaaccccgcttccctgggttcaagcgattctgctgcctcagcttctcgagtagctgggattacaggcatatgccaccatgcctggctaattttcttttttttttttttttgtatttttagtaaagatggggttttgccatgttggccaggctggtctcgaactcctgacctcaagtgatccacccatctcggcctcccaaagtgcagggattacaggcatgagccaccacacctggcttgcctgtaatatctaataacttactttatcctaagatcacataaaacatgtatttgttttgttgggggaagtctagagtgggtttattttcataaaatgggaactgaaacttagtaaatgagcatgaatcagcacagcctactggctgtgaatgtctctttttggcctcttatagatttctttcttcaccctctctcataagactagagaatctataatctggatgttaattttatttttatttgatcagcgttttcatcaaaggtgttatttaaaggaataaatgtcaccttttaaagaaagctatggtctaactatatgtaagaaattttaaaagggagatattataatttgtcaaggagatacccagaagaaaattaattagcgataactacttgcttttaagaattctgactttataattatctagcaaattggtaagtctagtgatttcattagaaccaaaacataaataaaacaaatgtgaataaaagcctttttgtaatatatatttcaaaagtaaatctccttttagtggttcttcttgaaatttgccattgacagtttagtcaaatcagccatatttatgatagtctggctactttaaatactgctctctaatagcagttatggtgtttttaattatatgggataagtagcaaatagtagcatccatgttgcttcttaatagcctcccataaagaacttcattatcaaattcatagggaagaagggagatgcaataataaatcatgggcatttttatggattcataagtcaggaggtaaggtgaccatttggggtttccccaaagcaaggctaataaatagggtggtatttacttaagcactgaagacagtcagcatggcctggtgatcttttgttttgggatgtcacagctggtccaggcataatgccagattcctttgttttcttaaaacatatagattaaaacctagttgtatttgcaggagagaacccctggcgagagaggagacaggtctgctgatgaatgcaaacagaaggagcagcatctgtgcatagaggaacgaagcagttaagagaaatctatcaggtcctttctgctaccgtttcctgacaggatctcacagaatgtcagactgttaatctcagggtcatacagtaaggatgatattgggtgcaggttttaaaaataatgcactttattttgggaagcaagatagtgtggtgcagactatgagtttgaaagccagagaaatttatgctactgcttaaaggatgttaagtctagcgatttcataaaatagcatgcaaaaaatgcttggcaaaagcaggcactcaataaatatttcatacccccccaaactccgcaaacttgctcttaataatggggttgttaatagcactagaaggaaagtacaaaactgagattttacttctcaaagccaaattagcttcttacctcaaccgacaaattctgaagtcgaaatgagtcataataaggattagtcagggaagcttgaattgaacctatttctcttgcatgtgtgactccttatcagcctcacactacttataattgctggattcactttctgaaattagcaaagggggaaagcaaagtaaagacagaaacctaaccactcactggtttcttctctgcctagagtgttagggtaagaatacgactatgaaaatataatattttctgatattaaaggaaatgtcaaaataaaactataagtcacctactaagggtactaaaggagaaagtgtagactctagcagattacactgagattaaagatatttgaagaggttctcatcttcagtttctcctatcttttgaaatgcataggaataccatctttcatactaatccagtaaacagtactatctggctctgatgttaggaggcctttacgaaccttgttaccagtagtacgagagtccagcttatatgtttaagagtgagcaaatgagtgcgtaagtgtgtgtgtttgtgtatgtgtgtgtctgagaggtggtccttaatctatttcaggtgagtttcttgaaggacaggttaaatcaactgaatgagctgattttatcatcctgtggtgatgttttatttatctgataaaatgcttagaaagtacttaatttgtcacggaaacatcttgctactgtatatttgctgaatgtgtgataatattgccatgatacaggtgggaaaatgaagttttttaaaagtgaaaatagccagagtcttcctatatttccatcagctcatttttactcagacttccctctttaaaagcaacaactttgcaagactccccgcttaatagttaagcgaggtatctaagctagtgaggttaaaaaaaaaaaaggtgcggggctgcggggagtataatagaagcagcggagatgaggtagtagatgttggtgcttcgttctctctctctggaccaacgatgactgatacatccattaaatttcagcccaggctgattgactgagtggatttatataaattaaaaaatgcaggtcatataccttttctgatagactgtaaatgagaaataggaattcctttaaacctcaaaggaggaaatccataggcgaggctttctagtcaataaagctctacagcatcactcttcttgctgtgtttgtacaataagttttagttaatagacaaatattatgccagcctctccctgactttttcagcaagaggtaatttgtaaattaactcacatggtgttgaaggttttccagcttttgttgcagtttgaactcctgcattttagacatgaagggggcagaaatcatccctcgttccattttttttttcagtgtaacaagtgaaaatggcattagttaaggaacaatgacttattcacacccattctctcagctccatgtccatttgtccattggaatgagccacttatcattcttccaggtttttcctctttcaacatcaagagttatgaaaagaaaattccatttttttctggccctccatgacaggtagactgaagattgtggtcatttggtttaaaaacatatccatcattaccagccggcaggttattatgatgtctcctttgaatatatgaatttcatacactgcatgttggaagtctaagaatgccaactttttagataaatagttatcccattggtgatgtacagcacactgttgccatattttctcacttttacagcattcttgcccttatcacccataatataaatcttttgctttcatatttaataaaactactaggtaacaaccccctgtactcagtacaatcaaccaatcacacaccatcatttggctatcattatttgttttcttgtggcagatattttagtagctctataggttaaatgtgacagcatatttgatacagcaatgcaggtaaataagcagatgaccttatgtacgtgctggcgatggcctcagcacgcagccctcagcctcgtgaggttccagggatagaaagatagatgaatgaataaagttcacaacatcagtcagcattataacctgaactggctaatctgtcagccaaaatttggagagtggagagaaatatgtacatgtgggcgtaggctaggatgaaagtcgccatttttcaagagattgtttttcctaaagctcagttccctgaggcacagacgctttggttccttagacactggagagaggcatctcttcgatagaggtttctgaagtgatgaaaccaaactccttacttcatttccatttctttctctgacaccccgttagtttatttcttactatcgaaaccatcatattgtttttttaatctgaaaagttaatgcctctatactcaccgttgcttactgtttggtttgtgattttcccataaaaaaagaggcttagttatgagcagagtttgcatggggacctatgtgctccaggaggaaacttgcaaatttttttttttttttttttttttgagactgagtcttgctcagtcgcccaggctggagtgcagtggcgtgatctcggctcactgcaagctccgcctcccgggttcacgccgttctcctgcttcagcttcccgagtagctgggactacaggcgccccccaccacgcccggataattttttttgtatttttagtacagacagggtttcaccatgttagccaggatggtctcgatctcctgacttcgtgatccacctgcctcggcctcccaaagtgctgggattacaggcgtgagccaccgcgccccgccaaaacttgcaatcttatacatctaactagttagctaatatgtaacattggccaagtgtttcatgagatggattgcactaatttttcctttcccgttttccctcaataattcctactgagcattggataagaacaataaatatccctgccatgtctaattcccttctggaaactgaacagatgaactgtcaacatcttaggggcaaacggaggggacaggggcttaagtctctagggtgtggccagcagctactgaggctgagaagtgttcataccgtggattgttaaaggaactccacagagaagtttccatggctcttggttgagactatgcctttattcatagtagtcatttttatttccagaagtagtgacagataggtttcacactatcttgatcttgtcttattttccttgtgtttagtggctaagatggttgaatgtagctaagcagttttagaagttgtctccacattttcccctgacctgtgttaaattaattgttatccacatggaatctgatggagggctctaacctcgttagtttcttgcataacttccacacaaccttaattcttagcatggctattttgaccttccctgaaattcaccacattttcctttggaaaaagacctcattatcacagctagcaccatgccttgtgcttcaaagatactcatagaagatctgtgtgttgactgaattaaaactgctataaacacctagcataacctcttaatctcaggtactgagaattaaggaaatcatttggtataacattgtgtaaattgatgaaagattggtaaaactcagactacattactaaagtgcttaaacaaacacaaatcacaacaaatctcacaaattgaataactttttgtgagtattccaggtaagtttggatttgtattacaaaatcagatgcagattttaatacttgattattccaaaaattaaacatgatatttggggccaggtgcagtggctcacgcttgtaattccagcactttgggaggccaaggcgggtggatcacttgaggtcaggagtttgagatcagcctggccaacatggagaaaccctgtctctactaaaaatacaaaaattagccaggcatggtggtgcacgcctgtagtcccagctagttgggaggctgaggcatgagaatcgcttgaacccgggaggtggatgttgcagtgagccaggatcatgccactgcactctggcccgggcaacagagtgagactctgtctcaaaaaaaaaaaaagatattttattctacaaatttgtagtagtactttaattttgcataatgctttaagcttttcaaaagatttgatacctattttatcttgtgagtctcaacatttctgtacattagataggataggtattagtaccccattttatttaacagatgactgaggcacagtgagttaattaatttatattaattatacattttaatacagttaattaatgacagcaactatttggccaggaagttctaatatctagctccagttttccatggtgtgaaataagtcagcttctccttattagaagactctaattctgtaccaattagggagtaactatgatataaataatcttagtatgttttattatcctatgatataaataatcttagtattttttaagttgctctgtaattttgacttttcaacactattattctttgttcttgggcatttatgaaggactaagttaccttttttgtttttattttaatttggtcacagttttgttattttggggtcaaatagtcaagacaggtacatcatggcacttactgagtatacagttgtttaagaaaattaaagaataaaaaaatctttagaagattaaagtgttaaacatacgtatgtctacagttgacatattaagttggctgctataaaatattgatattaaatctttgaggtacagcattttgtagtgcagagtgaaggatttcaacagaaaatttaagtttgtttctggttcaactacagctttctttcctcatctgtaaaatggagataacactcatcttacaaggttgtcttgagaaccagtagggttgtaatttttttccctcagagaaaagaaaaagaacaaactttccgtatatctttttgggacatataaaattatatcagtatttcttaagaacattattttgagaattcaccatacactgtgagatgtggtggcagaagagagaatcatccaagcatctatgccagcatcttcaacgatctaggttggtgtaaatacactttaggatgttctcataaggaaattgcctaacagtaactttcccagaacatatccttgttgataaataacacatggctgtatacatgcaatgcttaatgctttgtgagtccccatgctaaccaccttttcacactggtgaaatcttcatgatcttgacttcatggtatctagaatcagatactcatgattctattatttaaactaatgccataaacatatatttcagacatagaaactcataagatcaggttcataacattagtaaacagagatgatgtgtttatttgatgtgatgctttgtaattcattcatttacttattcaacaaacgtctcttaagtgacacatttattaagtagctgacatgaactcagcataacatgaagtactggggatacaaagtcaaatatgatctatagtctagccctcaaggaaaatgttaattaaaaaactttttattttgagataattatagactcacatgaagttgtatgaaatcataaaatcctgtttacccagtttccttcagttgtaactatttgcataactattgtataatattacaaccaggtaattgcagttcatggacttctcagatagcaccagttttactcatattcatttgtgtgtgtgtgtgtgtgtttagttctacataattttatcacatatgagatttttgtaaccacttccacagttcaagaaaatgatcagctccatgacaaagcattaatttgtttttatattatataatatattaaaaattgtactttgtcaaagaaattgtagcttgactaattattatatattatttgtagaatactaggagtgcaaaaacctcctccgatgattcccataatattcatctcctttcttttcattctcttttccaccatcttagttcaggccttttcctcatgatttatcttcattataaatgaagataatataatagcttcatagttgggctgtaaacaccgagttcaaagatgtggtctgttttgtttaccaggttataggcttaaaacatgataggaatgaatgagtgaatacatggaaaatgctggagccaaaacagtgtttaacagaaacaaaaaatgggccaggtgcagtggctcatgcctgtaatcccaacactttgggagagaccgaggtgggtggattacttgagtccaggagttcaggaccagcctgggcaatatggcaaaatcctgtctctatttaaaaaagaaaaattagccaggtgtggtggcacgcacctgtaatccctggtactcggggctgaggcaggaggatcacttgagcccagaaggtcaagaggcttcagtaagctctgatcacgccactgcactccagcctgggtgacagatcgagactgtgtcaaaaaaataaaataaaataaaataaaaaagaaaagataagaaaaagaaaaaagaaaagaaacacaaactggctgatttcttttttctccttagttaccttcagtagcttcccattacctacaaagtgacatctaatctaggtagtgtgatatttcaaatcttctgcaatctggccccaatggacttctgaacccatttctgattccatatcccctacagtattcttcagcaccaccccctcctacattctctgagactactccctgctttctcactttggggatcatcctccttcaccctaaaatggtatttttcttccttgctcaatgatatccttctgatttaatgcaaataatttttatttaatcttcttaacattcacaatgagatataccttccatttaacagctttagcaaccaagtcttgtagataccatgtcagagtttacctttagcaaatgacagtgctggtgaactcaaaaccaggccttccagttaaaaatcttataatcattttactacttcacacagcaggtttttgggttttgttttgttttgtcttccacaaaattgtttttctatgcttaatgctttatttcacagattcttgagattgtatgaacaacacttttatttaggaaatgtgtgatccaacatttaaagtccacaactttttttgtgtgtgaattcatggtttgttcatttactcaactacccaggaacagggttaaatagaagtataaaacaattaattcatagaggaaggatggaaacataagtttgtacagtcatttctccatgtctgtgggctctgcatctgtggatttgaccaactgcagataaaaaatattagaaaaaaagtatgattgtatctgcactgaacatgtacagactttttaattgccattattccctaaacaatacagtataacaactatttacatagcatttacgttgtattaggtattacgaataatccagagatgatttaaagtatatgggaagatgtgcataggttgtattcaaatactacatcaatttatatatgggacttgagcatctgtagactttggtatctgacgggggtcctagaatgaatcccccatggatactgagggacaactgcacattaaaaaggatgttaaaactggatgtggtgactcatgcctctaatccttgcactttgggaggccaagacaagaggattgcttgaggccaagagttcaagaccaacctggccaacatcgcaagaccccatccctatttttctttaattacacacataaaaaatttttttaattacacacaccaaaaaattttaaattacacacacaaaaaaagatgttaactgtaattatagaaataggctcatagtattatgagcctaaaggaaggagtgtcaggaaagacttgctgaggaaataataaccgaattgtacttttactgatgaatagaagttgcgcagaaagtgttgccaagggcaaggaagttgaattccagagagaaggaaaagcagtgtgaaaagctgattagcatggggacttacaaagcgttaagcattgcatgtatacagccatgtgttacttatcaacaaggatatgttctgggaaatttcttgttaggcagtttccttacgtgaacatccaagagtgtatttacaccaacctagatcatatagccccctacacacctaggctatgtcatataacctagaggctacaaatgtgtacagcatgtttctgtgctgaataatgtaggcaattgttacataatggtaagtatttgtgtatctacataaggtacagtaaaaatatagtaaaaaggataaaaaatggtacacttttagaggacactgagcatgactggagcttacagggctggaaattgccctgggtgagtcagtgagtaaatggtgagtgaatgtgaaggcctaggacattactgtatcctactgtagactttataaacactctacacttaggtgacagtacatttatttaaaaattttctttgttcactggtaaattagccctagcttactgtaactttttgattttatataaactgctaaaatgttaaacaactttttgactctttttatcataacacttagctttgaacacaaacatgtacagttgtactttttttcttaatattcttactctataaggttttttctatttttcagattttttttttacttgttaaactcttttgttaaaatctagacacacacacacacacacacacacacacacacacatacactagcctaggcctacacagggtcaggagtatccacatcactgttttccacctccacatcgagtcctactggaaggtcttcagggcggtagcatgcatgaagctttcatctcctatgacaacaatgccttctcctgaaatacctcctgaaggacctgcctgaggctgttttacaagtaaatttttaaaaaaaattttttaataagtagaaggagtacactctaaaataatgattaaaaagtatagtaaatacataaaccagtaaagtagtaatctattatcattatcagtacaacatactgtacataattatatgtgctatacttttatatgactggcagtgcaatgtgtttgtttacaccagcatcaccaaaaacatgtgagtaatacatttcactgtgacgtcactaagtgataggaatttttcagctccattataattttacaggaccagtgtcgtatttgtgacctgttgttgactgacgtgttgttacatgatgcatgatagtttaagatacaaggctgaggttgaagagtaaggccaggtcagctcagggaaggccaggtctggacacccagattaaaagacctggtatcctgtagcatgtgtgaagccattgaaagggatggatggtgaacttggccagatttgtcttcagggatatacagttttattattctacagaaaccccttttcaggaaaacatgaattagctgtataattatgtcgtttctccttaatactaaatgctgtaacctttgtgtgtgtgaaagttaaagaaggcaagaaatgtgctctatgatttatttcctttcctgctaaggaaagtcatctaggtgttactacatcagaagcatttggcaaattggtgataaaataatttttaaatttattccagttgctatgcaagttttcttacctggtagcctcttagaaattatacatttcttttgaaatgtatcattttacctagtcaggtttcatatgtggtatttttctccctaatacgttctactttgtatgtatatacttatagcttaaccatattttaaaaaatcaaatgactatcctctttttcttatttctacttcctaaatcctgcatttttctttattctatattctatagcatctacttccttattgccaaagccaaaccaaaggaaaccaagaaaatgtttaagcctaccttgactggcttacactgacacattgtgactactcacacattgcagatttcctaaagccattttattattggacatattttgagggaagaaaatggcaaatgaaggcaggttagctttcttttcttccaaaatatacacataaatgcatttatgttatgtttacagttgcaaggattttataagtttttaaaaacagaatatgaaaagcattttatcattcaagtcagtgaaatatttttcactgtaggccttagttaagaaaagagctggcctaagagatggaaatctggactttgaactgggctttgcctgtaattctgggagtcctttaaagttctctcacttccctagtccattgtgtgtaaatgagaggtagaagtaggcactgataaaagaatattctagatctggttatttacgatctggtacagggcataggaatcaaggaaaacttctggtaatgcatagttattatgtttaacccattgtttaaaattttttttagattaccttttagatacagtttacaacaagacatattttctgtgcagttagatggggtttaacaaatatgacccatataattcataaaaccaccagcttccctatgttcctctctaggcaatcctcactccttgctccagaaaaccactgtgatttctattatgatgattagttttccttgttctggaacatcacagaattttacagtatatattcttttgcatctagcttgttttacttggccaggatgtttttaagatctagccatgtcattgcatttatcacagttcatttctttttatctttgactaggactcgtttaagcacacacacatgcaaacacacacacacacaccacacacaggtatatatttcataatttgtttatttgttcatcagtgatggacagttgatttgttttcagcttagggctaatattatattataaataaagctgtgatacacattcctaagcagttctttttgtggggatatgttttcacttgtagtgaatatctaggagtggaaatgctgtgttatggtgtccatttaactttattagaaacttccaaacttttttttccaattttataccctcccagcaacatatgtgattttcagttgctgcacatcttcctcagcatttattgttgtcggtcttatgaattttagcctctcttatgtgtgtgaaaaactgaaaattttctttaatttggagctgaaataggaactctaaaaattatggaatacatattataatttagagatatcagaattagcacattacttattgaccttatgttttttcatctgtataatctttaatcagttatatttgtttatgacatccattgatgtttttatagggagtgtatagataatatgtttgtgtgtgtaggcatatttattcaggtctcaagttttttgtttgtttcagtgttataaaacagtttatcttctttcataatctcccatatctcttaaaaatcaggcttttattacctctaatagttgaaatccaaatttttaaaaatccaaaaaatcccaaaattttggattttaaaaaaatgtattaagatactaccagttcagccacggactttacatgttaaagtcttctctataaaaatgtatttatggatgataatcaggcctgtgataaatacaaattttatatcacagtctctccaattatttctgaaagtaagggaatgatattatgtaacctggctgatgttctataatactgggttagagaacaaaacggtaattcctgtaatggtcataggaaacttaggtagtgagccagttgactaaatgtgtaatcaaaactcaccccagtattcacatggtaccttttttgcattttgtaatggatgcctgtggatctttatgtactattgcctttagagataacaaatttccacagacttggaaagcaataaaatacatttaacactaaatctttactgagcatagtttaatctttctctgatgcagaaagcactttctaattttatagttctgcagactcattattgcgaatgccagttattatattggctaagagtagaagcaatggcgaatcaaaaggatgtgctaatagaatcttagattgagggaagttaatgtgtgtttacccatatgcatctctgtattttaagatatatataattgttttccatttctatttctcctaggtttttccaccaacccttctccactctttctgaatatatacaccactctctcgagtttccttaccaaaaatacaatttcagcttttctctgtatgaaagcgatgacaaagtgattttatagccagttctgaaagtgactaaacttgacaaaaattgtattttatgacaacctctgctttcatgtccccggcctacttttatatcatcttttttttttaccccaaatatgaacaatttcatatctctgcattggctgaaaacaaatccccttaccaggaatacattttaatggaagagagcctgcttcacataagtcaccagagccttaacatcttaactctgtaatattcaatttctcactcactgagaaccaaagccttgttttttgttgttttatttttgttttgtttttgtatggtttgtgttcataaaggttggggaagaattagtattatggaactaaaccagattaagggggaatgtgaattagatttggtaacagatggtgctgtggaaattaaaggttctttgcgaatggaagcgacagcagcttgcctctgttctctctgtctctcgttcgtgcacttgatagacgggtataaatcacaacaatcctgtcttgacagccaatttcgagaatttgatctggttaaagacatggctttcccgctccactcactgaaacctgcttctattttatttttacacagcaccttgtcatatttagaaaagcaggctcgcctgctttctcttaatgaaatttttttcttaattacagttttagctgtttagtgttaattactttttcattcagcctgaattttcataatatctctcagggattcttttttctttttttctcacccttttcacccatgcatattcttttgttttttttcccaaagatccttttcattgtcagaagttgttgtcagaggcactatttgagacacctaattaccaaagttattatttttaaggagaaggactttgatgtgatgtagtaaagttaccaaatcagaaaaatttttttaaatgccagaagcaatcaccaaaactagcactgatttcaacaaaatttcacaaaaaggtgaatgacaacacttattttcacctaataagggctgcagaaatatctgttctgttggctaaaataaaccccaccatgtaaaaagacacggccacaatgtggcagaaccacttcatgcctgtgttgaccttggagtggtctagagattctgaattaaaatgcaatcttcagatgtaggagacgctaaatgagagaccaggagcactgaacaaattgcatggatcccttgcatccagattctcagatctgacaagcttaggggccaagtactaaggtttcctcttacaaatccacgtggcatttgggcttccgacatatcaaggaatggtaaatagaagagagggaaaaaatcactccaaaaatgaagagaagattctttgagcgagcaactaacagttggtagaaatgaagcttcctactggcagtcaaatcaaatgtagtaacaactcaacagctccccgctgcttgctgacagcgtggtgtcgcacactgggacaaacattcacttaaacactgattgcagggaattgcccttccgccaacgcctcccaccaaaaacgtaatgagcaaaagcagaaccatttctaggaaaaaaccaagagtcccattccccagctcccataaaatgatcacgtctctgtctgtctttttgtagcccactgggagtgagtcttcagttgaatgtggttgctgcagtttcattgttatgtagcaagttgcttaattattctcctgcaacacacacacagacatatacttcacacacacacacacacacagacacacacacacacacacacacgggccctgccatgtccctgaatggtgactcagtgcagtggcagcaaaggaaatggaagtttgggagtttgaagagtgctcctcggtgcaatagtccttgctctcaaggtctaaccagacttacaagccagtgtgttttttatctgagtagaatatatggtttttaaacagggctgaagttgtttacgaaacacgtaggcaaatgctctcattttataaatgagaaaactgagagtcagggtggtacaatgacttgcctcaggttacacagtgcctggatccagagctagaacccatgtctcctactctgtcgaatactacaagaagtcagggctccctgggaaaggagaagagaagaaaagcaagcggcagaaaccctggtatagtctttttttttagttgattttttagaatggcattttatatttagaaatttttctctgcatgtttgcatttggacttttgaatgtgacaaacgacaagcaggtcctgatttgaactcttggcttttcagtggcttctactggcttcactggatgctatgttgctgctgaataatcctttcttttttttttttttttttggttaacaatacctgtcatgctacaaaataaatccttagtcatttccatggcttgaattaaatatatgtgcagatatatgttattttcccttgcctgcaaatagtggcttgtgtattttagctttacgttctcttcaagtaactagcttgatgaaatgtttatttaaaaagaggatagaggaggaatttttaggattaataattagctgagttcccctcctccctgtctccccactactctcctacttcagctggacaacacctgataccaacaatataatgtcacctctgctatagatcaccgaagaccagctgcatttacatccagatgttaactactgcagactaagctattaaggtaaaaatataaatatagtttaactgctacccaacagatggggtttattatctctgattgtgctgcacatctccatctaacacagaaattttcatatgtgcttgaagcaacctttatttcaacaatgatttcctagcatttagattttctcaacactgtgattcactcagttgcagagtaccttttagagttccactcctggtgaactgatctatgtctatagaagcagctggtttattggtcattgtaattgcttttgcaaaacattatcttaatgagtaaagaatgacatcaatactgtgatctccatatccttatatcaacttgtgatagcatttgcatttcctctttcagtatagcagagaataggaaagggaagttcaggaagcctgagctttcattgacctcgatttgatttgtgaactccatcactggagcgtctgtgagtaaagcatctatattcaatgtaatttgtagagatcagtgcatagactttctatgagttgaatgtctgtttatttcttctctagtgcggtgctgtgggaaggtcttcatttagctgtcagtccccttctgtgtcgagttctctttggtgtgctccttgactgcttgaaaacagaattgtctgaacacaagcaaactttattgatccatatttctgtttgaaagaccagagatttgtagaagtaggagactattgctttcccctagaaagcttactgcagaggaggtctgctcatggcatagtaaacctctaacactgaataaatgttacattcagcatatattgtaagcttcattttaatgatttatcttgggtactttttttttttataaaatctcatagaaaccttttgttttagtggtggtgtccacccattgcctagggctgttagactctaccctgggcatagtgacctggtcaagactggggcatgtactacccaaatggttgactatagcacactgttcgaaagcccttcagtctttaggcttttggttcgcagaagagtaacttgtgtaaagtaagaaatattttcagggattggagacaaaatgcttgtttttccatctgctgtgcatgtttgtttccgtctaggaggttttcgagattctctcttcggatccattggcgtcatgtagttgagcagttgtgaggatatagttaattaagctgcattagggcaaatatacacacttgttaaaacacttaatttgcctcaataatattgattacatggcagaagtttatttaaactaaatggtatttcccccctactgttacagtttttgagtgcaatctgtataatagctaatagccatcatcagttaaatatcatgttagttataaagtaatgtcataagaattgatttggacttggcagtggaggagagctctcccttcaaagctgatgtagatgattagccagagttttaagcagaatcacggttcatataaactgtgtatattttatagacttatagctgctctatattacatgagtgcccattatattaaagaaaagctcagatggttaattatgcaaaacatcatgtatgcaattactcggcattattatgcatttaacagttttattgatttgtcagtaactcacttactgtatttagagccataaacaagagatgctcacccccagattgaaataggtccaagaaaacaagctaaggataagttgcactactaagcgcctctgcatcagatcgaatccttaaatacagaaactgtcaacaatcataatgtgcaacacattgtgatatcacaggaccatttcttttcccattaataaagtttatcaaccaggaagcataagaaatcacctggcaatacaaattgaagcaactgcaatttcctacatctaaaatagtctggatgacttaaggaaatcagcagtcacttccagcttgcacagcatagtaaaatgggatgctgctgtgtccacagacacttacactacatacatacttgcaacacccctagtcctaattagtttagtcgatcttattagtgcatttctcttgccatatttctgggcctccattgcaagaaatgaattgtctccatttcaaaatcccttatattttgcaagagtgaagacataggattctacaggtatctttatatgtcagattgagtgacaaaccatcctggtttacctcggatttaggggtatccaggacatgggattttactactaaaaccaggatagttgaccaacctaatattagaaaaaaattaaatgagaaaggaccattgaactctacaaccctaaaagcagatagggtttcagtgaggtcctgctgttaagagtttggtcagtaggtatgaaattataatgcatgggacacttttatttcgatgatcagccagaaatgagttgaaggtcttgattacttgtactgaatttcctttttgcttgcagcagagagccttttacagagttgggagagctttcagctctgatttttctttatagggggctggctctatgtccccacattacatagctctatctcttgtcagcaactcaggcaccagctttgagggcagctgttttcttactcttgttcttcatggagtaagctagagagagtcttttgaactaaatgcacaagttatttgttcaaagaatcaagaagcagcattactaaatctaaatcattctgatcctggtatacagaaatccattctattagatagggctcaatttttattaaaggaggccttaaaattatacagaagtatgtgtgcataagttgtccatgtgtttttatctttctgagcgtgtgggtcaggattcacaattctttctttacaattaatgatctccttccgttaggttaaccaggcagaccttaagatatttcttattaaaagaaaaaatcctttctcttcttttcccaactaagccagtgtaccttaatgcaatgatgatatgttagacccagcagttgtcaaagcatcgtattactgtgatgccataatgacaccctgtctctgtaaagtagtcatgttttctcaaatcacacgttgcaccgttgatttctgacatgacacttcattcggttgctttccctttcttcagcatcaccattctctgacaatagcagctggtgcccattttgttactaagtgattcacattttgccactttacgagagtgcaattagttgaagcaggggggaaaaaagctcattgtaaagtagcgtgcttgaagttgtaactcaggctgccatgggagctgctggggtcatgggctctgaagcctgtacctccgggagctgcaacactagtctagaggttttcttctaaaagcataaaacacacacacacacacacacacacacacacactatagagtattaagagctttttattttttaaaacacaaatacttaaatatttaatctggtaatttcagaatgtagaaaatcaaccagtccccatagattcatttttgttttgaatcagtagtgattaggtggtgggacttgataaccttcttttctgtccctgaaattctgtgattctgatgaatcacacagaggagctgaggactcttcttatctctgtatttgtatgtaaacttggagattcgctgcattgtgtccttatacaaaaacattggaaataaatttttaaagcatttggaatttataatgatgatgattacctttccaggcccttaaggatgacaaagaagaatagaaattgtgttaacttctttaattgacatttatttagcctaccaaagcgtttactattggtatagatatagtaaaagttgcagaagatattgccttagtataacacatgagaagatctaagatgatctgtacacacattccttatgagaattttatgcacccattttcccatttatttctccatttgttttagggtggaaatacagtagcaaatgaattcaagatctgtgtaaaattcacatgatgaaatacagctgcttgttaagaacttgtatttcggtgaaagggttaataatgtataaccctatggaacattattgttattccagagtttaacaaatacaagcactggctgagcttcagaccttccatcgaaatgcagaccactttgaacatcagcacgtgcatgtgggaattcaaactcctgacggttcattcacgatcacacatttacctggatgtaggtagaatctccgaaaacaattaagcttgataattacaatagaaattgaacattaacttacagattatccttttctcccccacagcagcaactttaattgattcttattctttctttctctcactctctctatgtgcacacatatacacaccattaattaactttcaaaaattacttctttaaatagtgaaacaactaagacattttatttggctgatcattagtatctaatgccaaagataattttcacccttgctgaccctaagcagggctaggaaatgacatcctaggttgaagtatgatcatcagaattatttgatgctatatctcaaactgttttgaaatgctttttaaagtcctgaaatttcaggtaggctgttaaattcctcaaacctagtgtctcatgcaggaaggggaacatcacacactggggcctgttgtcgggtggggggagcagggagggatagcattaggagatatacctaatgtaaatgacgagttaatgggtgcagcacaccaacatggcacatgtatacatgtgtaacaaaccagcatgttgtgcacacgtaccctaaaacttaaagtataataataataaaataaaacctagtgtctcatatagaaactaaaggttattcttgacattgttatttccccctctagtttattctcagggggttcattcagaggttttgggaagggagttagttagctggtcttgctccctgttcatctcaccatttctcttaaaataataatagtaaccatactaaggctttaaaataaatatttcccacatatttcgacacatgttatttctattcataattcttaactaaatttagatttttattaatccaatgtgacttaaaatttctgcattaacagcacaatgtggaattgggcttattctctttggctacagataaagccatcattttgaaaatggctctttctgacaaaaaggtgttcttttgaaataaagtcctattcactacattcctcttagagttaatgtgaattttagtgcctctaattttagattgaagtgaagtctagaataaaacccaccagctgacaattgaatttatagatagttgtgaatatttcagacttgaataatagagctgtagaatttcagagacagagaggcagagaattaagactcgctgtagttttaggttataatataatagtgtctaggaagtgttcagtgtaatgagctaagtagtaattaggagacaactgtgttggttcagagattctgtttaggtgtcactgcacaccctgggtgggtgatgcagtagggcagacctgcaaccagccaaccagcgcagtggccccttcaccccttttccacttatgcgtgggctgtggatataattgctgagaaataaaagtagtagatctctgcgtgccacctctaccttgcttgcttgcttatttattaaaattgagtaaataaacaccattaaaaactctgttgtcttcaagacatttctgctctggtctttgaagtcaggcctgagttcagattcaggctgtactgcttcctagctgtatgaccctcagcaaattttgaaaggtctgaggctcggtttcctaaagagaaatacctcccttacgaagttatcttggggattcaatgaggtaatatttgtaaagtgctcagctcagtgcctggcacataataagcacttgataaatggcaattctgacttttattatttccactgggcaaaagatattaattaaggaaacagttcgtggcaggccaaaaacacgtacaacctacagcacaaatccagttggttcactttcatgtatggctccagtggccagaccttgtttaggagaagacagtgcttctgttttaaggacctttctggcagcttgtacgtcccgaatttccttgttttatccagcctattgccaagttatggactgagattttcgatgagacaacttgctggagagtccctatttttcagggactttaacaacatgcatttgacacataaatatttgatggcttagcaaataactgatccataaatgggagggcaatttctggccttgttctttaaatcaagagttctgcaaattttgcaagtccatgaggaagagcctgaaaaaaagaaaattggggtgaaagtgaccatggaagatacaggaaaagagagagagggaaaaaaaatttaaaaagagggtctgaagatcaagcagccccaagcaactctcctctggataaaaaaaaaaaaaagaaaaaaaaaattccaaattaaaaaacggtgccttgtaggcagatggtgaaagagttaattgtcatagctgtgggaaattcagtgctggagagaggaaaggggagcaagcatggtttagtaccctaaaaacttctaactctagtctaagatcataatgtatgtgcccacagtccagtaattataaggtaataagtgaagtggtggtgtaagtgctctaaattaaaaggaattcacagggctgctgtaagtcagtgccgacccgctttctttcaaacgatgacttgaggaaagtgcttagcccagagtgctaaggagacaaggagagcgatctattaattacaacgttcattaacagtgacgggtacaaggcagcagatgcagaagagagaggacgccgtagttcaggctggcgagggggatatttttttctttcgctagttcttgaggaaaggacaacacaagtgggtgggcgaaagtacgaagatattttcgtggctttcgccttcctatttgctttcttcacatcctgatactgcttgacttcagaaagctgtgcaagatttctcaaagtgaaatatctttggtaagaggcaaatcttgcctcaacgctttgctcctgagaccgccttcttggaacagttaagtgaaacttcctgccagaaaagttccatatttttcttcattttgaagtaacagaacaatggaggacctggaggagggcatgaaatttgtgcaatgatcaaatatcattagatttatagtgaaagagataattgcatccctttggttatcctgtgacgagtcccccaaattctagtgaatgaccattacccagagggattcccataaatcaattttccactgggaggcaattatctaagtccctttcttgactgtcacctcttctttctgtagtgggctctcagaagcttcttagacattttgctaaacgaggttttgcacaatggctaaatgaaaagaaaataggaccaattatatcttttcatctaattacctttccagaaattcggtcacttgtgagaacaacaaagaaaaagggatgaagtgtttcttctagataagagaaacagtgtgtcagattagatgtttcatcatttttccttttaggaggtataatgttaaatggcaaaaagaagtgggggaaggaccatcacaaatatattttttaggacaaaatatgctacatttctactttactgaatgtaaatataacatcagattttatagtatcagataatatacatataatatcagatttgtggacttacaggtatactgaaggctcaaatggcttttactgattcatctcttaaataatggcaaatcacacacaagaaacacatgcacgtatttattaatgaatgttggtgatgagtcactaagttttgcaggctctaggaataatctttaaatattggctggaattttatacttgatgtctttctatattgccaaatggctatgaaatagagcaatttaaataaagaaacaaagtgattgaggatatattccctatgtgttttagtcagatcaataagacacagttatgcttatggaagcgtgctgacaaacagtaattacagagctgaggatcatctgttcagtcttgaaaataaaagttttattctgctcataataaaatgattgcagcatcagaatgaggaaggaaaggtagaatgaggataaatacaattttagaaatggtatagactttgcaaatcaccacctcttccattgataaatttagaatctagagttgagttagatattgacactggttctccaagagaaaggtaaaataaaagcaatcggactctttagagcttttgtttatggcctgtctgggccctttgttgtaaccctgtcatgcccttatgctgattaccttcttgtagaacaagaagtattgactagagaatgaatgatgtgtagtccctagcccttaggaaactctctcaaagagcaatgtctttaacatatgaattctgtttttttcctccttttacctttccctttccctttctctatttttcaccatctcttttgtttctacctcttttggtctctgtgcttgacactctctcctctttctgtctctctttgtatctcctcaatctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggttagtgtcggacctgggaatactctccccacttccaacctcacatgatgggtttttgtttttccttattcttattctcataagtcaagtatcatagttttaattctctcttgagtagaaaatggaaatagattacaattgatagtggaagatttatagaataaaatccccccagatatactccatatctattaattttcctcttactgttaagctttaatggtgcaaggataataaactttgggtagagtttacaagagcatagttattattagagcaatgtgggtctatatagcaactgtacaaatgcacattggactaacagtgtttttgacccctttggatcttcttacagatgcatggaaataataaatactttagaccagtgatttccaaacttgagtgtgcattaaaatcatctggaaatcttgttaaaatgcagattcctgggtcctacctccagaatttctgattcattagatctggggtgggggcctgcctgagattgtatatttttaacaaattttcaggtaatgctgatgatgctgccggtccagggaccaattttaagaatcactgctctagacaaatttaattacctactcatctttcttttttccttatggttggatatactttttctaacttttaaatgaatttatattaaaaaaaaccttccaaattataccaataaaatggcattgaatgataaaatatacctccaacatatataagtgatatataccccaaacttcatagatttcagatttataaataacattatttccgccatacagtgtagaaaaataggactgaaatttgtttatgcccttttaaactggtaatctacagatctagaattcagttcatgaaaaagctatagatatatattctggcaaaaaaattagatttcacgtttttaggtctcttgtaattcacttttgaagaaaataggggaagaaaaaaatatattttgaggatccacagcacaccaatggttctgctcagtggtttacaaaatgtgtcttcctaacaaccagttatggacacaaagtctatcttcccacatatcagtggttctcaagcttgccagctcattggaatcagtggaagacttaaaaaaacatgctgatgtcagggctcatgtccccaaattctgaattaattggtcttgggtacagccagggaaaggggggtttttgaaagcttcctaggtgatgcttaatgtaaaggcaaagttaagaaacactgcactgtactgtgttgtattatttgccaacagttctcaaagtgcagtggctgtaccagcagtaccagcatcatctgggaaaatgtaagaaatgcaagttcccaggccccatcctgtattaactcaaacagaatctctgagggtgggcctagcaatctgcattttaccaaccctctgggtaatcctgatgctaattcaaatttagaccccctgctctagaccatgctactgctgattcaccactgaccatagaccatcatcatctaatggccccttgctggacagaactgaaactaatttatttggagccttcataattttgtgacgtactagttttcaaagtacaaaagaagtaatgtttgttaagtgctaatccttttaaatattttcacaaaacatgattctgaaaccctttatgtgtacatagagcagtctcccaccttctcccccttttttttttctttttgaggcagatttttactcttgtggcccaggctagagggcaatggcatgatctcggctcactgcaacctacatctcctgggttcaagtgattctcttgcctcagcttcccaagtagctgggattacaggcatgcaccaacacgctcctctaattttgtatttttagtagagacaaggtttcaccacattggccaggctggtctcgaactcccgacctcacgtgatccacccgcctcagcctcccaaagtgctgggattacaggcatgagccaccgtgcccggcccaccttcccttttaagagcatctggaaattcaactcttcttcatcagttgcactgaatattttagtgacaatccttacttgtactggctctcccttgcttttttgttgtctgttacataacttccttgatctgtggctgatgagaacacaatcaaaatgtttacttagtcaggtgcagtggctcatgcctgtaatcccaccactttgggaggctgaggctggaggatcccttaaggccaaaagttcaagagattaatctgggcaacaaagtgagaaccctgtctctataaaaaatttacaaattagttgagcatggtggcatgcacctgtagtcgtggctactggaaaggttgaggcagaaggattgcttgagcccaggaattggaggttgcagtgagccatgattgcactccagcctggggtgacagagctagacacagtctcaaaaaaaaaaaaaaaaaaaagtttacccaaagcacaatttctcaagacatcatactcttacatagtagatgagatacttaatcctaatcttttcatagcctttcatagttttaaatgaagagcacaaaaccaagttagtatgcagtacatatgaatgtcctaaacatcttcatagctgtatctttataatttctggctcatcgttgctatatttattgatattttcttacaaaaatctttcatttactggatttttattttctttatcctcatctataaattgaaggcattaacctcagaatacttaagtttaaaatgaaatataaaatcacatggaaagcgagaaagctaaaaacaatggtctgtgcacaaggcttttcatcacttctgagcatttgagaaatctcttcagtctatttggtaacactacaaaacttgagaatgaaagcacacctcaaatctttgggtgtttaccagccattgttccacagtgttataatccttatggttacaaagtatatacaattcaaactgttattaatttgattttgttaactcagtttacacagctctgaattttaactacacaaagataagcaaatattttgggataaattcatgagcactgagtgcgctgatataagcaagaggttctcagtgtgaaaaccactcccatttattcaacgaatatttactgagaacctgtgattcagacagcaggctggttggagtgtcctcttatccacattttattaaagctttgttcccaaaggttgtggattgagatgaattcctctaacaaatgtctcctgccttgaggaagtaacaatttttagggttgaggggattaaaccctcgagtcttcggtatgttttgtaaagatagaataacagtgtgaaaaaatttcctaatacatgtctcaaaacattttataggttagacattaatagctctgcaatagttatttactgagcaataattagaatagagcaattggaattctatgcatgattattctttaggatgctgaaatgctaccaaaagcttaacagagcaaagcacagggtgattcttggcattgatgtatgtgctcagttttactccgtattggagagagcaagtttcaaggattttgagcaggagacagagatgtcactgtccagattagcactctggacttgcccacctggctgtgcttgtagctggcagctgcgcagcacttggtgaggctaccctgctagctacatcatcagacatcacactgtggtgctcacttagccccaaaaaggcagtgaggcaaataaagggattaaattgtgaaagtataatgtaataattagagcagtaattgtaaggaagattggaacggcccctcctttctgtggccaaatacggtagtgatagcagttgaactccaaagatgttgagtgtggcccagactcttattccaatgctgaagctgccttagagttcattctcatgccttcagacagcattgcagccaaaccacccttaacagatcgtagtctctccctcccctccattaaagctctccaaggaaaaggaagagattatgtaactccccttgacaacaagccttgctagactagagccccaatggacaggccgttacataaatgtgactcctgcctcaccagggcctggttctactctcattgacttaagggacgtgtgcatccataggcattttcatgtacaccatcatctgttaagatctttcctttttaatatatcttcttattatttttgagacagggtctcactgtgttgcccaggctgttgtacagtgatgtgatcttggctcactgcagcctccacctcctgggctcaagtgatcccttcccctcagcctcccaagtagctggaaaacaggcatgcactaccatgcctacctaatttttcactcttttgtagagacgggatctccctatgttgcccaggctggtctcaaactcctagcctcaaatgatcctcctgcctcagcctcccaaagtgctgggattacaggcatgagccatcttacttcttattttaacaatttatttttaggattggttatcgagtgtgtaataaatatatacgtttaaaaagttgggaaaaatacttcttaaacttggcaccaaaagaacatatatccagaccatatcttgagaaaagtaatacaaattgttcttttcagagctgaatgtgctatttctgttgtgaaagacaattaatcatggatttcaatgaaaggtaaatagaaaggaatattttacttgttgactattttcaagttatcattgaaaaactattgaattatgtcagcatttagttgggtagaagccaaagttttgctgttttgtttttgtttttggctgaccaaaatactttttacaaaactttgacagctctaccctgtcatccaatagggttacagtggcagcagtgatttcacgtcattttctaggcatagtaattttggggatgtgatattgttattcttctgattttttttccaattccaattttggccttaattcataaatgattggagtctgccttctttccctccttccttccttccttctttctttccttccttccttcttttcttttctttttttttgggaacttctcattaagagtttcccctagactcttgttaaggaggcaagagaaggaaaacatccttatacccaagtataagtaatacccaagtattacatatttcattatttaatagacaaaacactagcctcctgaagtttttatgtccatataataaagaaaataattttataaatagttttctttgtgtagataatatagccattctaactcctcattatagtgctagaaataaagtattcttctttcccccacatttaaaaggtgggaaattgtatatttaaaaatatgagattttaaaaagatgttcattatagcatcggttttggatttatataaagccaggcccaagtctcagccacttaccagctgtgagaccttaacccctcttttcctctgtttcccaagtgatgagggttacatgagagaatgaatatcgaagtacttgacccatagtaaatgtacactaaattattaactttggttgatattgggaatatgactgggatacccagaggctggatggttcgtgtaatctagcacagagttatccttgatgctaaactagaaggacaggtatgtcaccttccagagctcacagctgtctccaccctttagctatgatcgtaaaccctctctccctgtagccatttctcactgatggtgcctttatatgattggaggcatttaggtgaactgtctggaaatttgtttagttatatttagcttatcgtgctcaattaactttatttccctgtgaataagaatgggaaactgcatacatcaaaaaacaagcctgaattttggaacttgcataaaacataaaattctcagtttagcttcacttgtgaaatttaggcactgaagtagtagcatatcttccctgtgtgaggtgtgggagtgaccattatggaactaagtccgctctgaacattgcaggacctaggacaagagtacagcaagcacccaaatactgcatagtatatgtaaatatgttaatgttataaatcaagataccaaatcactaagtgaaatttgttctagtctcttatttgaccaactataccttcataatagcctgggagactgactttttattggtcagtctttgactccaaggaacaattttctgtcagtgagaggcactgcaaggagagctggttcatagcctgcagcccatcccctttctttctctctcctctatctcccaatcttgtacatagtgtggacacccttgcccacatgtctaaggcccagtgaccccttccaaacagctgttccttgaccacgcccaggtctaatgtgcacaccagaagggcagtttagtccagtctagcttccagagaacagacccaagagagagtcccgctcaggccctggcacttccatgggcttgtggtgatctagccagggagtttgagggtctcaggtactcaggatcaaggtgtacgcaggggacggctccagctgggcttttttcccttcacactttgagtgggatctttgtgctacgtataccttctaaagcccacagccttcaggcaagggcttttcttgtctgaggctaaagtggcattaatgtgagcctaaatctcaccttaaacatggggcattaagattagtcattttcctgcaagccatatgctaaaggcatgcgggcatagcccttggatctgatgcaaccaactgctttactacactgaattgtatgactccttcctgaagcaggcagtgtagtcctagaggatctttcctggtattgcatttcttttgccatcatgtgctgtttcagtcttagaatgttttcagccatagagaaaataagaacttacaaattgagtgtacatgatatgaaccttccaaaggaaactaataaaatgtatttaacccaaatagtgtctagagaaaataactacctcagtttatagtaattggtagctttaaaactctaatatgttataaaattgaaatccaaaataatatggaaatgtctaaattgacttgatgaatcgcagtgattatcagtttgaatgcagtgttaaattaaatatagaagtaatattttccaaagaaatgttgtatataattcattgctttaacttttttttttcttttttttgagacagagtctctttctgttacccaggctaaagtgcagtggtgccatcttggctcaatgcaatgtccacctcctgggttcaagtgattctcctgcctcagcttcccaagtagctaggattacaggcacacaccagcaagcctggctaatttttgtatttttagtagagacagagtttcactatgttggccaggctggtctcaaacttccgacctcaagtgatctgcccaccttggcctccccaagtgctgggatcacaggcatgggccaccgcgcccagcctactttaactcttaacttgcttttgttgtaagtttgacttttccacttcttgcatttgatgccagttgtgtctgagtttttgaaatgcattaaagttgccaaattataaataacaaatatcattctactcttgctattttaattgttaggttcagtgtttattttaatagtaaaatattgcaatctttcttttttggtgaagaagtactatatgaatgggtgtcctaaaacagcataatttagtttttcttctcctggttttgacttactggaaccacttcttgagacaaatgagtagtgattccttttccacggtttgttctgacttgggaagtcacctaaattatacttttgaggttgtcaaagagctactggtcagcaggcattttcaagagacagataataaattagatagtttaaatatcttaggttatcacatatctcaggatctgtgtgccacatgccttctctgttccatactctttgttttgttttttttttaagctgtttaaaaatataaaaaaacactctgagcttgagggcattcaaaaacaagcccagacctggatttgacctgttggtcgtagtttgggtaacttctaaatcaagacaccctatttttcttccttgcaggcaacattgatgaaaaagatttttataccaaaggatttcctaggcagttttgtgtacatatcatttataaaattgaaacccaatctctatcataatgactttttttagtctattatttcccttttcagaatatttttacttcttcagaattttctagtctcttttctctgtttggatatttcaagcctgtttgaactacacatctgtgagcactataatatatatgcgtgaatatatgtgtgtgtgtgagtgtgtgtgtgtgttggctagctaattagaaaacagaatcaatgtaaattaagacaaagtaacagagtggctgatgaaaaaagatctttgggttgtgcaaaatcagagtgattattttcagagattgtatttcatggttgatctttgatcaaggaaagaaaaatagaataaaatgtaatgatcctcactagatttttgtccttcaaatattagaaactccagtttgcagaaaaaagaatctctggtgtgatttacatgtttattaaacacatagcattatgttactctattttgaaagtcatttaaaataggcatatcattttagctttgatttgtagggtatattttcctgttgggtgacactacgtaagagcctatcccatgtaaggggtatatgccaatggtattcaggatggacacaaatttgcaacaaaacttttaatgcccaactatagctcatgtcagattaggcaaacaaaattaattttcctagcaatgtatttgcaaaagggtaaccttctttcctactgtctctgttacttcacagtgatctggaagaagtgatagaatgggtttcatattcctctgctgatattaaatatttatttatttatttatttattttttgagatggagtctcgttctgtcacccaggctggagtgcaatggtgtgatcttggctcactgcaacctccgcctcctgagttcaagcgattcttctgcctcagccttctgagtggctgggattacaggtgccagccactacacctggctaatttttgtatttttcagtagagacggggtttcaccatgttagtcaggctggtctcaaactcctgacctcagttgatccacctgccttggccttacaaaatgctaggattagcgtgagccaccgcgcccagccttatttattttaagtaatacactttgtagtagcaatatcactaattcatgatagttacatttaataaagggataagctttttcataatttttcaacttcgttctatcttttttttttttttttttttttttgagatggagtctcgctctgtcacccaggctgtagggcaatggggtgatcttggcttactgcaaactccgcctcccggattcaagcgattcttgtgcctcagcctcctgagtagctgggattacaggcatgcaccaccatgcctggctaatttttgtacttttagtagagacagggtttcaccatgtttgccaagctggtctcacactgctgacctcaggtgatccacccgccttggtctcccgatgtgctgggattacaggcatgagccactgcacccggcctaaacttagttctatctttatattttaacagaacttataaagtacctgttacataagcccatatttcatggattctactgtgtgatatggcctatgttagaatccaaaaaaaatacggatgtaattctggaataaattctctttacacacgcatacttaatcaaagcatgtactcttatttatttttcctttaataaaaccctctgcactcagaaaataaaatcaattccctatagatctcctgagctagtgtcctcggacggagtagcgtggatggaaagctgcccttcaggtgctgactgtgggtgcagctggcataagacctggtgcctatctggttccagtgtgggagcatcccctatcctgacccgtctaggttactcaaacgtacctgttcccgattcaatcattctcttatggaaaagaagcccttgcattaccatttcttccactgattttttttggggggaggagagttctcttaacctgccccaaactacaacctgttaagtctctgagctctcctagcgagtaactgttgagaaggaagtttgtattgtttttatgttccagtctaagggacttcacagatcacttccaattaattcttataaaaatgccattgacttttctgccttttgcaaggtggaattttacatttgtgagtggactttcaggaagcgggtgtggctgactctttgcctacagatcactggactttccccagaggacatgccatccataatctctattatctgatgactatttgttttgatgaaggtactggaggcagttctttgattacaagataaactcccaaacaaagacatgagtgcctttcttagcactctaatagctttccttcattcctccttgtgctcccttaacccagaaccaagtcatgacaaataaggctgcttcagaccctgctagaatagcctcagtctactgaacggcatgttaaatgcttgagagcaaaacaataggaatgatactttgtgctttatatttttcaaaatgcatgtttttgtacatatgttcaaatagttatacaataaaagccattcctccagtgaactcaaaattggttatggctaaagccagatagggtatattagaatgttcactctaaatgtaggaaagaaaacaaaaaatgaatgatgagagttgtgttgtcagaagttcctattgatgtgggtcacttttgcttggtaactagttgtgggggaatatgactcaatatgatttgctaaatctgtaagaaagggagcatcagttcttgttaaaagtcaaactatagaagctgttaggtaactcatgaggtatggctgggtggggttcagaattttgacatgagtaaaagtcatgggtcaggattttattttctttttttggtaaagcccagggcagtgatgtgttttcctgatatactactagatgaacttagacaatttcttagaagttataaaacacattaactcactcaagttataaaccacatgaattcactttcttttaaagttgctgataatgagacttcagtgatgtgacggcctagtcattggagctgatttatacaatttaaaaagtttcacataagctcaaaattaggtacaggatgctggtgtagtattttagcttttatacttaaaagctaatctgtttgtatttaaaagaactgacatttaaacttaaaaaatgtggtaagaaacataaaatttaccatcttaaccatttttttaatgtgtagtacattagtgttaactatatgctcatggttgtgcaatagctcacgagtctttagtatttcatcatgccagatgtaaactctgcactcatgaaacaactcctcatttctccctacccccagtccctgctagccaccattcttctttctgtttctatgagtttggctgctctagatatctcctataagtggaatcatgcagtctttgtctttttgtcactggcttatttcacttagcataatatcatcaaagttcattcatgtcattgtgcatgacaggatttctttttaaaaatggaataatacaggagtcccccattatctgcaggggatgtgtaccaaggcccccagaggatacctgaaaccacagatgggactgaaccgtatagagatgaggattttttttttctatacatacatatcttgataaagtttaatttatagattaggcccagtaagagattaacaaaaataactaatactaaaataggacaattataacaatatacagtactaaaagttatgtgaatgtggtctctctgtctctcaaaatattttactgtactgtaccttgggtaattgaaaccgctgaaagtgaaatcgcaaataagagaggactactacattccactgtatggatagaccacattttctttgtgcattcctctcttggctgacatttatgttgcttccatctcttggctattgtaaataatactgcagtgaacctgggtgtacaaatacttgtttgagatcctatttttaattcttttggatgtatgcatacaccaagaagtgaaattactggatcacatggtaattctatttttaattcttagaagaactcccgtactgttttctagagcggcagtacaattttatattaccatcaacagagcacaagtgttctaatttcttcgtattcttttcagtgcttggttattttctgtttttttttttttttcttcagtagcaaccatcctaatgggtaggaggtgaatgtttaaatatttttgagagattttatagatatgccaaatttatatatacaccaaagttctaatcttttatcaccttaggcttatccataagtaattttatatatatggataatgtacatagctgtcttaagattcctgagcttaatgcaatgcctttaggtgaagaatttgttaaccaataatattaatagtaataataaatatattagtttaatttataataataatgaatatatttgattttgcaaagtgtcacacattgttctatgtgctttacattaattatctcatttctttaatcatcccaatgaagtaggcacttctatcatgattatattatcttctattatagatgtggaacttgaggcacagagaagtaattgcccaaagaacaactgggtccccgaaatcttgaacccagagcctgtcctcttaaccccttcattacactgccttgtatattttaaaagcttttaaaagattgaatgattttagattgtatttttcttgagagaattttaatccatgggcaaaatcgtttaagttattaaaataaaaatgaggaattaagaatatgccaaatgttatgattagataatattcaaggtttttagaaaggagacagtaagaactaagtcttaaaaatacctaaacgctttgcaattcatttttagaaatcccttaaatgtgaagcttgagagcgcaactcttcagtgccaccaccatttccatttcctgtgtcagttctctggatttttatcatctgacattcctttctccacccaatttttgtttgttagtcttaaactgatcctaaaaatctgtcgccactgatgacacttctgtattatttaattatttattttaggaagaaagaggcttatttctctcctgttttgatgtgagaataattgtccatttgcataaactttgtgaccactccagaaggcagctcagaatcagtccctttttgttgttgttgttgttgttgctcttggtctcttttttttgtttttcttatgatgaatgatagaaagagaaaaatttttttaatctatttttaacaaaaagttgctgtattatttggaattaaatctcattttatcttggtttgagcagacttaaaaaaagggcatctctgataatactagaaagaatactactgagagattatttagttcaaggacatctttgttaatttagaatgtagagctgaaaatatgaatttacctttagaatgaatctgaatacatatcccaaatctacattctgatatccattttcttttcagtgcatactatttacagtttccatttgaggacgatcagagataagcacaaaaatcttcaaaggaaggaatgtagcccaatgtgttgtcctcaagtgtacttttttttccctgcttttgcctccagagcatcttcactacttccaaagtacctcctgcttttggaaaaacctcactgtgccccagagctttcgcctatgttttatatggaaaacaatttcaaattttgtgatacttaaagtaaaagttttccaactcattcttccatctgttcttctcagttattatcaatttacaaagatttctttaaaaagtttctgtacctaacttgggggaaactaccttacagagtcgtgagcaagaaaggaaataatggataatagactgtaaagtatttttgtcgttgcagccttttgtccatatggtttagacaagagatggctaaaccaaggcctgcgggccaaatccattttgctaaagaaagttttattggaacatggccacacctattctagtatggtctgtggctgcttttgtgctacagcagctgagttaaggagtcacagcagagactgaatgacctgcaaagacaaaaatatgtacaatctggccctttcaaaaaagcttgccaaccaaacccctgctcttctgtggaagacttagagttaaacaaatatcccacagtggaggaggcattttcatcctatgtcccttggacaatcatcaaacaggaacccccccactctccctgctaagttttcctctatacttttctttcttactcttcctgggggatgcgaggcacttatctgaaatccctaacatagaagacagttcaggtatacagattttattttaaacttcaggtacagactacatgccaggagcttccattgttttctgggctttcctcgcctttctctcaatccagccagcagtgctatctgagttccctgacccttggggtaattactgttttttgaatgttttaccttcttttatgactgagtccatggcatactctttggttggtttgtttgcttttgcttctcacgaagtgccttttgactcagacatcagttctttgtcttttggctgacaagcacaaggccagaagaaattctctggctagcacttccttacttctgtgctgagaaccattacctgggcacttcttgagtccctcttagctctttctcctgcattccttccctgagtacagtaatgatgttgtaattattgctaatattataatcaatactcactccctgtcaggaactctgctaagcatcttaaatacatgatcttacttaatgttaatagcaaccccataatgtatcaattattattacccatccacatgtcattcataaagaaggtaactccaaatttaagagctgctccaaagtcacacggaaaatggtagaacaaggcagcccaatttgactccagtatgttagctcgtaatctatatgttatactgcctcctacagcttacacacagatcaattaccattacttatgtcaaggagttccccaaatcagtattaattttagaggatgcagatatttgttgaatatatgaacttgatcttaaaagcaaactctaattccattttttcctctctgacaaacaaactttgggcacattgatagcatccaagaacagaagtacttagggatagtattagaaagggttatacttgtttaaggtagaagggaaatctcaagaagtaaaatttctatttaagaatcaactgcttttatcatatagggtatcatccaaatgcccctaactggtcatatggacttgtaccggtctgcaaaagtcaccataaaatgtacacattgaaactgtttctatccaaagatagtgaatgcattagatgtaattagcattgctttcttttccaagaatattttattaacaaggcttttgttgttgttgcatgttttgaaagacagataagcagacttgcatcaaggttgtttaaaattcacaggtagaagaataacatgtaaaaattgatgttggatagagagcacagcaaatttggaggttatagtcagctcagacattatatatttcttgtggcagtggtcacctttaagctcttttataaagacttctgtgacatgatctgtgtactataagagcttaaaaactaagaagaagagactgtacacatcatgtaggatatgcattttacactgtaaaaaacagttgccttttacaagaagacatcattatatcagaactaaaaacattgaatttctttagtccttggatgagagacatttatattctccatcattttcaccaatgtatttttattatacacttaccagtcctttttaaatgtatttcagaacacaccctcatgattatggattactttttttttcccatcaggaacaagaacattattttgggattgttaaaatgcattgtgtacaacctgacacctgttgctttggtgacatgctctgtttggtttctgtggaattaaaccagccaccaaccatactggtacagagacaagttaagggatttctttttgaggtgttgagagattccgttctctaaaagcaaccctatcctatcccacagctgcccttacaccataagtctgacaacagcaaaagacaatgccaagatccaccctgaacctatcactctcaggctcctatgtcaggcatcaaaatttcctttctgactggcaacaatagcaacagcaacagctacacaaagtgctctttcagaagatggaatgttcatttttatttctattctaaacaacattcaattaattacttttaaaagattagagttaggcagcatgcctcatatttaagagcacagactttggatccagattgcctgggttcaaatcctggctctagtgcttgttagctatatgattctgggtatgttaccttattctctctctgccttaaatctctaatcacagaatggtagttcataatgtaaagcacatcaaagagtacctgtgagtcttagtgtttgttattctcctgttcttaggtattgatatctaagtatttgtggatgcatttaaaggccattgaactggatgttgggatatctcagttttagtctcatttctgcagttaactagcccatattcttataaagagggtggagcaatcataggttctagtgataatagataagtccttacatatttaccccttttatggtcttctatataaaacaagggggctgaagcaactggaatttagaatctctttgaaatcaaatatcctataagtctgtgttattttatgccaaataatatagtactagtgaattgctaacacttttattctaaatttttaatgaataatttgaagctaaacactaaaatgggggaatgaataacagactcactaaaaattaagttgacaaatgaatgtttcctatgggtcattgacttgacctgacactctcttggacacaggggattctgaaaggagtaagacgctgccctcaaagaatatacagttgggacaggaagggggcaattccacagatacatataataaagtgtgttaagtgctaagagagggactcacctgaaaggtaagtacgggatgaactagttacatccacaaagacccctaactcagtcttgggagccctgggatcatctcactgaagaaatgatagaagcagcacatagagaggagcaataggaaaggatgctgctttctaggaacttcaggtaatgccatgtgggtttcagacaagggggtgagcttgagatggggtagaagtcgacctgggactgtggcaagagataaggctgggataaggtttttgaagagctttgcaaatgttttgtcctctgttctaatcagatcatacccagcgataggcactgtgtgtgctccaaggtagagacaggaagtgttcatgagatgtggttgatgcctcacaaactcacttctcagacatttcggtacttttaagaacaactatcttcctttccttctcaatatctgtaaaacatagctaaatattctgcctagaagtgttgcaaggacaaaatctttcagtgtttctgagtgaatggcatattcattttcacatccttgtataaatctgaggaaggtggttttattttataatatttgcaaactggagagtaaagccttaggattcaaggtaaataacaataaatgggatgttaagacagttctctcctttttcctcagaaaagggaccaaaactgtatgtatatgatcttaatatcttcatttcacataattcttacaaagttataaagcagatatgattattcctcttttgtactttagcagactgagggtaacaaaggcaactagttcaagttcacacagccaataacatggtagagctggaacttgaacctaggtttgcattttctctacttttcttttcttttctttatttctcttctcttctcttctcttctcttctcttctcttctcttctcttctcttctcttcttttactttcttttttggagacagagtcttgctttcacacccaggctgggctgcagtggcacgatttcagctcactccaacctccgccttctgggttcaagtgattctcctgcctcagcctcctgagtagctgggattacaggcgcacacaaccatgcctggctattttttttttttttttttgtatttttagtagagatggggtttcgccatgttggccaggctggtttcgaactcctgacctcaggtgatccacctgcctcggccttccaaagtgctgggattacagcatgagccacagtgcctggcctctttcttttctcctcccctcctatcacacattcctcctcagacatttttctcaactgtatgcaaagtaatatgctaaagattgacatagaatggacatacaaaaattttgtcctaaaatgaacatgcacaatgcctagtgtttagttgatggttgtagaattaaagtgataaaggaatgcccatgtttacaaagttaggggaaaagttaggggaacctgagggaagatgtagtttttttaaaactggaaaaaaatcaaggctaagtaatttgtcctcattttatagcatttttaaaagctaagcatttttcattcaatacagtggaggaatagaatcttattgttagaaattttgcacagggaggtggccagtactggcacagactgcagccttggtgactctcccaaacacaggacactgtaggatgaaaccagagtgtgtgatctccagtcactagacattgctgagggtttaaaagcctgcctgcttgtgaatatccttccggtcttttttccttaagggcaaagcatcatccattcctatttggaagtgaggcttgagtttcaccttgaaaatgcagcaatttgcaccgctatgctgtatgcctcttatatactacatttatgattgtcagaatttaatcctatagaatgctaaagaaccaacctgcaaaaggtcttgtctataccctcctctcccccacctcattttttatggggtagagagacagtgcagaggcaaagagcatgagacttgtgcacactcctgtgtatgaaattgctttgataagagccaactctaactattatcctgatgtgatgctcctctcctcccacttcagtatgccacaacctcacctggcaggtggtctggggtcccattagtagagtgatagtacccattccttatagtatttttggaaatcctcttttagagcctgagacagagtctcacaatagcttcagtgatggcaaatcattgacctttaagggtagacttaaaatttagtaatggacaaaaatcatcgggcttcatgtcaaaatgcaaagggcaatacgtttgggtgaaaatgaggtataatatagggcctcccaaaccctgtttataccttgtaaagtggctctggtggcagttctaaaggaagcaccaaaaagtatttggtggaatcccttgagaacagatgtagtgttcctacacaacttatttaaagtcgaactgtggacgccttctttgaaaaacaaataactcccttaacttacatgtgcattgatgtaattatgactttttaaaagttacagatatagaataaattactattccataatatgaatctcagctatagatagtattattttctctttcaggtggaaatgagcacagaatagctagaaacgaagcattgaaaataagaaagaaaaacaaagaaaaaaaggaaagttagatcactgtaaaaatggaaaaacctttgccactatacaataaagacagagttttctttctttctttcttgtttatgttttagggcctttaaaacaaaaatactacagattattgcctgcatgattccaatgctctgtaattgtgtactgaggcaaatcccattatttttaaatcacttaatgttgaaaagcaactggataaaccccacttggagtgccctgtgggtcattgcaagctatttagttctgttaataaaattaaaacaattgggagaaatatacagatgctttcaaattggctttacaattatgatgtctgtatgtatgaaaaagaggacaagtcttaggaactacataaatccaaatgcatcattaccatgtgggagtgatgttattcaggaataaagatttgacatatatttttattttgagatgccatgctaatttacatcattcagccctttcactgccaaactgtaaaagtccattaagtgactgaaaggaatatacaaattatccactggcgctccaggctggagttttacatacaccctgttattctatccgccagctagctgcaagattctattaagcagtaagtgagaaaattatattgcctgcaaactaattgcacaaaagactctgaaataagtaatcagagcccgggactttttgaaaagccgccaggagatattataaattgctctatctttcttgtcagcctggtttaaaaaccgagagcttccatgttgatttggttccctctgcagcagagcacacttccctagctattgacaaaactgggaaaattccagttgtgtcatcagtagctgcccaattcagtccctggtgccatctaacaaatgtgtcccagaaaatagcaagctataatccaagaaaactccgtgtctgaaatgaaaatcctatgctgtgaacaataacttctgcatcctcctgagtgaatatccagtgttcacattccaggtgcccatagttgctattggaaatattttcgtctagtttccacttttagagaatggaaggaaaacaagtgccccatagagatcatatggtctactgggagtcatgtctttgaaccattaccaaaatagacgtaacattgttacccaggtgcttggggcagcacatttttaggataaaatgctttctttattgaatagaaaaagcaccagggaaggtttttcaagggcacaatctctgtagactctaacatggatcaaagactttgttgggtgggtgatcatagccaacaacaatgaactaagtaactcaatgggagggcctggaaattagagaggttttcctccagcaaataaagcaaataagttatttagaatgatgttgacttgtttttcaagatataaaccagagtcacttagtgaaatcaaggttattatccgtatgtgtcaaggcaactttattgaaagaaaatatttgtgaaagagaccccgtttatcagaaacaatttctatacacttcagctgaaactatatcatttgtgaagatgctaggaccactgatttccatccattcatggtgaaatttttatacatatgttgtatttgctgtcgctctgggaagagtcctttaccccagtgtagtcatttctttacttttcatgtcatagttcaagcatttgcccctatttggagaatttgctgatcttcctaagcataattcctgtgtttgtgggaatgtatgtacttgccagtacgccagtactgcatcctgaaccatgacaccacccactaaaatgtattgtttatttacacgtcttgtctcctctcagtggactctttaatatcaggaactacctctctctaatccaaaccagccgtaatacaaaactcctggctcattgattagcactgaggattcaacaaggaataacacagaggttctactttaagacttcattctaacacactaggaaaacctcccctgcttttacatttctccttatcattgaagaattacagaatgtaatggatagaaaggagaccagagtcctttaaatgtgatctaaaactctcatatcattatttgacagattcccttctgccttttgaagagatttaaaatctttacgtaattattcctagatgagtcattcatagatttagctactattattgaatcaatcctaaatattttctccaatgtagctccaattataaagtaagataaaaattatgtaactcatttagcaccatctatctgtattattttgttttccttttattcttatcctattcatatcagtatggatttttatttcctgtacatataatttcctttatgatttcctcttttattcacactttactcctcagaagcttttgtatttttttcataatctttccccttttgccacactttttttccatttttgtcaaagctactgttgacgatttcaaaaaattaactagattttttttttttttttttgaaacagagtttcgctcttattgcccaggctggagtgcaatggcacgatctcagctcactgcagcctccttctcctgggttcaagcaattctcctgcctcagcctcccacgcagctgggattacaggcatgcaccaccacacctggctaattttgtatttttagtagagatggggtttcaccatgttgatcaggctcgtcttgagcttctgacctcaagtgagtgatccaccctccttggcctcccaaagtgctggattacaggtgtgagccatcgcacctggctttttcttctatttttaaagttatttgtggaatgattttcctactgttcttaacattgcttcctaatgggacatgcagctcacttgatcctgtgacactgcattataacaccataattgatattcataataatgaccctgagataagaaaattctaagttattataagtatattcttttacttatatattactttttggtggattttttttttttggagggtggggatgaagtcttgctctgttgcccaggctggagtgcagtggcatgatcttggctcactgaaacctccgccttctgggttcaagcaattctcccacctcgaccttccaagaggctgggactaaaggttcacaccactatgcctggcttatttttctactttttttttttttggtagagatggggttttgccatgttagccaagctggtcttgaactcctgacctcaagtgattcacctgcctcggcctcccaaagtgttggaattacaggcgtgaaccactgcacctggcttggatggtttttatactgcattagaaatgtccattgtcctctagtgtcttaccatccaatgggtaatatgtgtatgaaaggtataacaaaatattatctgtctggatatgatgagagtacctgaaaaaatatgaaaaccaagaaatcgttttctgctgggatagtcagagaagttttcatgaaagattgggatggagttggagttgaacaaggaggcttggaaataattttaagaagaaaaagtggcaaagatagataattctcagaggaaagtctgaaggacacttagcaaaaactgaataaatcaaattggctgcctcaaaaagttcatgtcaggtaataatagcaatattgctggaaaagtaaatgaaaggctgggagaagaccctgtttgtaagccttatagtttatatttcattcaggaaggcaaataattctattgattttttaaaatcagcataatgacgtgatcaaagcagtcctagggaaaggaagatgacagcggtatgccacatggattagagtgggtcaggacggaggcaaaaagcccagggaggggataactgccatagtccaggtgtgagctcacacatgcctgatgtgcattcttgtcagaagtttgttgatgtgaaggatggggatacagttttcaaagaggaagtggaacaggttttaaaagaatgatgattatgtttgtggcagtggatcatcctggtagaagtttttagcactgggttaaaggtgcgtaggactagcactcatgccttgataagggaagtgatgaaagtgttacttcatactgacttttcaggcagaaaaaaggaaaagaatgctgtttggtaaacttttttttttctttctttctgatccttttaagcagtcactgttcagtccttcctaagacagcaaaggcctgtttctttttaagtaagtatagggggagccgaacagggtggaaggatctagtagtagaatactaattaacccttagaaaattactagcaacactcttttgatgcaaaataaatattcagagatggttgaagaaactctgcagtgaagagtggttcatctaaagttcagattataaatccttttattcttagctgtgacccggccaccctggtttctttgacttatccttggttttctaagagtatagcatcagtaatatctccaaggaaggtgatggtatatacttctgttgatgcaatgaatattactcttattatttaacctcctgttaaaaagttgttgcttttattattataaatgccctgaattagaatgctaatttaggcaattctgataggctatctcaaactataatgtgtttttttcaagtcatgcatacttaaccagttttcagtagttagaagtggttaggtattacttcttgttgaattagcagttgctgagtagttgagtctttgtgctaccctgcaatccactaatgtgatatttaatgaggagacgtcagtctgaagaaaggtagtcaatataaatcagtgtttacaaagtgtgattaactctgaaatatttcatcaatgctgtggtcccaggcagactctatgctaattactagaatctgcgcatgtttcaggggacttggacggaccctgagttttgcaaacatggagcagcaaaattgcaattatgctcggaccgtctctgatgagaatttatgcatttggtgtgatgacctcccccttcccaagagggcaataaacagaatgcattttcattaagatactaatgcacttaatcacaaggggaaagggttaggaagtaacgaaagaccttcaagcactatgtgacagagctgattggggagaaaagctttattttaaaggcagcttctttacaaagctgtaggcagccccagagcacatcccacacactgccattggtactaattgaaaaaaaaatttagtttggatcttcttctggtttcttagttgccattttaaatatgtaggtactaccataaatgatacaaagtctaatcttaaaaatatataatttcatagcagtttattctttgttctaacatcagggaacttcagtgtttggaattaattatgcaaattatgtaacacacatcatgatgaggatgataatgatgatgaccatcatcttcattatcatcaccatgatcagtaagcatttaccaagcacagaattgtgttgtaaggctctggtaagtgctaaagcaacaactatgtaatttctgtccctaccctctaggagcttactataacatgccatatttgtttacatatcattttccacagtgaagtttatactgttcagtgtcagaaagacaataagcctgatgcaccaaagtattaggaatcagaataaatccaggattgacaatccaagaatctggttttgatatttgtgttttcatgaacataatctattttgaaatttcttttggatcataagactctggaagactcttactttgcatgggtggactcagcataatgttttgaaggctaattttaaacttcatcttttgaagcatttcaccatgtttgttctccttgccccatgtatcttttgtgattatagcagagcatccagcttgatgatatttatgacatttctcttgagtctcatgtgacattttttggggtgggagagtaagaataatagagttgacattgcctttgggaagctaatgtttcctggatcttgtaaatatgacaacttttcttcaaacttgtgttttaggcaatatagaatacagctgccctgccacgaatgaatgtgaaatcacaaagcgcagacgtaaatcctgccaggcttgccgcttcatgaagtgtttaaaagtgggcatgctgaaagaaggtaaggctctttgctagtgcccctgaggttttgattttgctgtggggatgggaggcaaaaaattccaccagttttagagaaaccagaaaaagatgaggtaacagtaagtaccctgactctgatggcagaatactcctttatacctggactttctgataacttatggctaaccacttcacattgacaggaagggacaaggtaggaggatctgatgtacagcgaaaacacaccaggtatgcttgaccgtagtgcttttatcttctttacaatttgcagaaagcaaaggatgaagacaaaccaagaggctactgtcattgaatttttggttttcttctcattactaggtttgcagagagattttttttttttaattaatcttgggtttaaagcactctttgttctttcccaaccttatcttttagactttattttctattacaaagaacttaaaatatgatattaaaattgctttctatttgctttcagttggggataacaacaacaaacataaaatagcaacagtgacatgtgttctgtgctaaacaaattgcttaagctcacacagtttataattggtggagccaggaactgaacctattgattctagatgccactcaactattccacacatgtcaaaggtcctgaaatatttgtatatttcatcatttctagtgaaattcacatgttagcttggagatggataaaaagttttctttacttcgtgaggcctgtgattcagtttttgttctttaatgcattgctatacttgtgtgtgtgtttgtaaatgtgaattttacatgctgcatttagaattttctgtttccctttcttcagaaaattcaccagagtttgaaataaacacagttttataaagtaacacaatgaaaagatggtaattaatgtttgacagaaaattagattcattaaatatttaaatgtgtaacttctgttgcatcatagaactatgctttgtttctggggcttgtcctattattatattttgttcttactggagatcccctattttttaacttttaaatccaaataggctcacatattaattcaccaagagtgaaccagagtgtcaatgagtgtgtgccatcacgtggtgtcataatttttcctggtttgttcttctttcaagatttttactgtgaacaatattataggaagatgagtggatcagattatgtttggatatatggaattcacattgtatttctctgactttcacttatcaaataggaacaaagaagacactctcaaattcttctagtcttcaactttgctcttcccttgagaaagagctatacacaaagaagtgtataatgttataataaagttttataaaaagatgaccaagatacattactaagtaaatatatatataagaacaagtttattaatagtatgattcattatatatgtatgtgtgtgtatgtatgagagtgtgtgtgtgtgtatatgtatatatatatgtatatagagagagatggaaaggagaatggatggcagacatcatacacagtgatggatatacatgtgtatacatggagaagtggaaggaaggaaggatacctaaagattggtgacagtgtcacattggtgaatgaaaatgaggatgggggtactttttatggtatagcctttggcccttttaggatttttcagagttaacatgttttacgtttgtaatccttttgctgaatatgtactaaggtcttcccatgttccaggcactattccaggctccagtgatacaacagtgaacaagacagataaggtggttcttgctaaagaaaacttatgtgaaattgccagaaggacaattttgataaaggaaaacatataattaagacaacaacaacccaacccacatgacagagtttttctttcagttaggatgatggtggtagcttacgtttgtgaagtggagctctttatcttagccattgccttaacccctatagcagagtaacaaacaaaacatatttctgaaagttaatgatcagtgattgacagtcaatttctggccttaattatatttatgttgccacttagttttgttgtagagactcaaactaaacttatgctcattcaaagggaattaagagtgatttcaagtccttgaaagttgaggaatcattatttttcaaaagcaaatccattttttaaaaagttctaaaattaatacaacaatgaacacttgtattgatgtggtattgatctatatttaggttttattttgaaaaactgaattaatggagacacttctccaattttaggaatatataattttttattaacttgatttactgctatgatttacataccatttgcttttccaggtttaaagaagatatttttccttaaatattttttccattgtgatttctagcaggaacaatcctgaagggcggtaagagtgaatgaagaggtgtgaactgtgtttaattaaacattgttggtgaaagtgaatgggacagtgcttatctataattcacacctcttcagttgctgttatcaagcaagtatctgttttctagggaattgctgctgttgctgatatactcaaataataatttattttcctttacttcttaatgcccacttcgatggcaaaatatcagttttttaaccacctccccccacctcccacaaccaccaaatcgaaaggatgggatggttatgagtaaatgtggaatattctttttctattatactttaaaaatgcagtgaaatattgcattgtaccctgcatctaaatgcacaattatgtttggccatctccttggctcaagacttgctttctaagcctggagagaatgatactgtctgaaatgtatctttatggatggagagggatttcagtcccatgaagtatgtcagagaacatgatgtagtaaatctattcaaatgtaaacctgttcaattcaatttccagtctgtaataaaatttgctgctacaacccccgtgttgaccacagcagtccatacaggctgatggcacagcaggtctggaaattgacagacaaaatctatttaaacaaaaaacaacattagttctagaatctgaaatgaaatcagatttcaacagcttcgatgggaactttctctcctttaacaggtatttttattcaactggccaaatccattgtagataaagtgttgcctgaaggaaatgaggttttcattaaaagggtagttgatagaaaaatgagaattacactgttttaaaaataataatcgttagctttattgactggcatttctattaattatggcatctcactttgagaagatatctgagcgttggtgggagtgtgaaggagaaagtgatggtttagtaggtaaacaattccagtttcatcacattgtacataattaaaattcttataagatatgctttctcattagcaagcaatggaattatacttgaatacactacatttgattttaatgttagaatttttcaaaaaaaaattgtatcagttgaagaaaaggaaaatgtgttgtcttagagaaagcaacaaaatgctacactacaacaaaactttgagaagtacagtaaaacaaatgataatttgttgaaatccaagtggtggcaccattcagcatcctgaaaaaatcctctttgtctttctctctgctctacttagctggtaagtgtcacaaatgatgggccagcattatttttttgtcattataccatactgtatgtcagagaaagcccatctattatatgatatctggtctcaacattcccttttcatttttttcaggtattgcttatttgaaggaaaataacaagaactaatcaaggtgcacctataaatctggtcaagatttatttttattttgatctctctccttggttatttaaaggctgttgcaggacatactagctcagtttgctcactgtcagtagcaaacagagacattttatgaaagcaataatcatttcatttaggtatagaattcactgatcaaaggattaaagggtgtcttgatgtttattggcatgatggctttcaccttggcaactcaaatatttttcttttacatttgcaggtgagcaaaagactcacattcacgcacattatattctttagccaggccagcctgcatgccaaagtgtaggtgaaacaaggcaacttagaggaccagttttgttatttcatgccaaaaaagtgtgctttttcctttgccttaaaaaaatgctacttaacttttctaatctcctattttgtcatctgtaaaatgatggcaccaataatagtatttgcaaacaacatgttataaatagccaatgagatactgcaggttgagagcttagcataccatgtggcctagtgtaaggaagaggtcaacattagctactgtggccagagacagtaagggtcaagcttcagggccaggtggcttgtagattcaagccctggttctaccacctctgagacttggagcaagttaaagaacttctctaagactaactcgctttagcctatttatttataactatgagactgaaggtggaacttagtttgtgaggtttttgtgaagaccaagagatttaatgtagatacagggtctagtacatgcttagcaggagacactatgagcttgacttgctagaccaacccaaggtcatgtaatttgttatcctttggcaatgtcaatggccttaggggtgctttctaaactttttatagaagcacatcaataagtgaaaatttgctcagaaatttcatgaggaaatttagtctttaatatctgaccttaggtcaaatgaagagagacaacagtataaaaaggaaaaaaaggggctttaacccaagcagaggttttcactaacaatattcgaggtgaaggaagctttaaaattactggtttagcttcagaaaggagaacttactcctttgtcttgaaaggaaaaggaagaggaggaagaagagaaagcagagagggaggagaaagctaatgtcccaccaaagaaaatggacaagtggcacacattttaaaatgagcaaggagaattgtaagaatcctgttaacttcataagtaaatttttgtgggcatttttttttttttttttttttttgagaaggggtctggctctgtcccctaggctagagtgcagtggcatgatcttggctcactgcagccttgacctctggagctcaagtgattctcttgtctcagcttcctgagtagctgggactacaggcccatgccaccatgctacttttattttaattttttccttagaaatggcatctcactatgttactcaggctgttctcaaacacctggccccaagtgatcctccagtttcggcctcccaaaggactaggattacaggcatgaaccactgtgcctgggcctacgctttagtttttaattttgatttctcgtctacctaatactgtgatgtgatttggagcaagtccattcatctctaagagtctccattcctgtatcttcaggggaccagttagactatattctttcttaacccttcaaatctgaaattatatatattttattaaaaatgatataatgcctatagaaacattattccaatatatgacaccaagagacttataattacaatgatgatgatgatgatgatgatgatgactatatcaatgaagctggaactaccataggagctctggtttgatagctatggataatgagatgttctatttgtgaattttgtcttaactgaaaattcttctgatgcttttcatctacctaggggagcaagaaatatgttatttttttcaaagttaacagatgtgagagttgaaggcacagtagagcaattaataggtatttaaataagtaggaactgaagtattgattgtgtatttttgcctgtgtgtgaaaaacttttgctttttatttcctcacatttccttccagctcttgtcaatatattgaagtgcagtcagtatggttttatttctgtgggcatctgaaatctcaacacagattgctgtgattgctaccagtcagattttatttgaagtttgttactttttaaataaaaatattgacagcagtaggaaaggagaagagcaggcttatataattttaaatggcttctaaatatttcctctggaggaaacaataagttattaaaacaagcaaaacaaatcagatagttatgtgttttattgatacccatttttgattttcatacttgatttgatctctttaaagtatctttcagccaggcgcagtggctcatgccagtaatcccagcactttgggaggccgaggtgggagggttgcttgagtacaggagtttgagaccagcctgggcaacgtgatgaaaccctcatttctaccaaaaaataaaaagtaaaaaattaacaaggtgtggtggcgcacacctgtagtctcagctactccagaggctgaggtgggaggatggcttgagcttgggaagaggaagttgcaatgagtggagatcgtgccactgcactccagcctgggtgacagagtgagattctgtctcagaaaaaaaaaaaaaaaaagaaagaaagaaacataaagtatcttttaattacagagatgctcagtgttgtgtgtgaatattttctccactttgtagaagtctagaaaatacacacagtatgaagattccaggtaggcagtgcaaacaatatagtagaattgtgagtgcccatgttccagatgaagtaaaagcagaggttgagaattggcatttgcaataagtcaccatttgtggtgagacaatacatggtattaagatttaattatcatgttaagaccccacccagtatagaaaattgggaccctgggtatcagattctcattagtcagataaggaacccaaggtcagagagttttagtgacttgcccacggccccactgcagataaagtggaaatgggattaaaagccaagtatgtcatatgcctaggaccttcctgtatctatgccaagctgtgtggcagccttggccaaataagaggtctttcctgctccatgcttgggttgattgcctgcatctgttggtaggccaagagtgacctgaactacttatttggtgggtggacaaaatgggaaaaagtcctggaaatcccaataagcagcagagtttatgagtctaacaaggggttttgagcttaaggtatataaataaatgacataatttaggaggtgacttttccttaggattctgttctgagggaaccaggcttcttacctaaagtttgatgggactgctgaagtcagagataatgatggtgattggtccaggaaaagtctttatgggataactgagcaggctagagtattggactgattgtgagttagagaaggcagtgtacatcaggagtcatgaaggtcaaatggtaaggttgaggacactgtatctcaaaagggtcacgccatttttgcacagcttaaatcctttagcttgacaaattattttaaatccatccagaattgccagtctctatgaaattaaaggtcttcatctttttctctgagtcatagattaacagtgctgacctaatgtttaggaaatccttgggtggaagaaatggtaggagtatggagatcctcttcttttacattagggaattagttgtccagatgttctgtttattctgagtgatctcaacacagtccatggagtatattttctgtttccacctttttagagaagacaatttgtgcatgtctacatatacacacatatatgagagagcacagattatacatttactcttttaactgccattacatctctccaatcagctgggctgagcctccaggatataaagaaaaattatcccagagctgttttgctggaaccacagcttgagtcttgatttatatatggcagtgggaactctgagagtcttctgagtttaccctatcagcaggagtagcaaagagcaacttacttgtctaattacccttctgtttcatattttccattttaacaaaatgttcatttaaagagcgtagtgttttccaggtaggttctctttaaaaaatataaagctacgcaggtcatttagttacaagtggatttgtttttgcttagttaaagagcctacttagtataatttatcctaacaaaatatcttttgtaaaaacctctgaagaagacattgccaaggtgattttttttcctcaagtctagtatcattatgctgccaagtcaaaaacagaaattattggtagggaaatttgggctcctactgccttcaaaaagcagaacaaagaaacggagaaagctttaatggtattcaaggaaaatatttctgtgttagatgacagttaatagaactgcgttgacctcacaggtatttcttgcactctctgttgtaatattatcctaagaagctccctcattaatgcagagtattaaacaaaactcccaagttataatataagcaatagcgaagagcaccttctctgtgagcttcgtcttgacattaagccatttgggaatgtacttaaggtaccacaaaaagttattttatgtgcggatactgcattactagatggtgattttttttcacgttttgttgatatgaaacttgaatagtcagtctcaaaatgaatagtaaagattttgaaggtaagactaataacacagatttttgagagctgaatataccttaggctatgtgctgtgtgcttttgttggggttggttaatctttataatgacctcagtggtagctatttccccatttcacagagcaaagggaagcttagagagattctgttaccttccagtgttctcatagtgtatgaaggagtctaggttctgtagtgggtattttgattctactgcctctgctgtacatttatttaatgtagttattctttgggaacatcagaaatattcatgtatgtatttggcttgggattcttcagaggctatgggtattatgagatactgagctcttaaaagatgacttaagtaacccatcccccattttttgaactatggctctcttcagtgctttgaattcttcacttaatgtccagaaatagaatgaactatgttggaaggcaataagtttcccagcactgtgagagatgttgtagggaacaagttcaagtatcatgtgaggattagaccagactatcttttacagtgacttcccactcaaagtcctgacatcccaacataaactttggaataacttaacagttacaaactatgtgaataaacatcagtagtactgaagctgttcaattcctgggaactctatttaggggtctgtgtttttgtcagtgtatgacatcttatttaaatccaaattggaacataaagaaaaattttgccttgtggcatagctttagtctctggctgagtttttagaaaatgaactatcagaaccacatttcttataagttgtgcttttgtagagaggaatgaatctgatccactgactttgtgcaccatctgcctcagttgttttgaggatatggccatagtgtaccactggagtattataatctcatctattatataaaaggggaaaattgaagttctaatgttttaaagatttgtccatgattctgcatgtaatccgtgtggctcatagaagactatcacatactccttgcatacctggttctccaaaacaattttatatttatgtatatattttaaaatcacaattacattagaaatgaagtagatagaatctttgatgtgaactaaacagttgcagcactacagattatttcagctgaataaatctgtgctccctgcatttgtcttagagaggacagagagaaaggctgaaatcctaagaaacagttcctttagctttcttccccctgatttagtagggatactattaaaagttaatcatttatttgattgtccccatttgtcatttccatttgtgaacttgaattaggaagccagcatttatctaatatgttacatatttttattctttttggattaaaaaaatccctgatggatttagccccaagcaggggaaacctgcttgaacatttgctcaggcactagaaggccagcctggtaagtggtgaggggtggccagaaccatataggactctgtttaatgtggattttttccccaccagccttcaaacaacagatttttgttccttgtcaccaacgcatacgtatatcaatgtgacattgatgatgatgacattgtgcctgaatgtaactaaaggaattcaggtgtacacttgaataagactcatttaatgaagtgcttcatggttgtatttcatttgggccccattcctaaatgctcagttacctttctggttaaggctatgcagacttctactccacctactaatatatcaggtatgaggcacgattttgttcatctctaagtccccgtaactgacactgagcactggtcattttttgagagactgttctgtagttcgtcctctctcgctttctctctctctctctctctctctctccctcacttagtaggttgaggagccaccaaccagcttccctaaggcaagctgtctgcaaaggaacaagccagctggcttggccaaggttgatcaatgatgagaagcaggctaggttccaggttcacaaaagccactcagtggagagtaggtcagcggcttccccaaagccaattagctggcagaagtctgaggtgcccggtgctagccaaattccctgagcctgatggtactagtggggagtccatccttgggcttgctggcaaaccagacttaagtgaatggcagattgtgctttttgagagccagtgcggctttgtggctactagaacaaatatcaggacctgccactgccactcagccttacccaagtagactgcacagccccagcacagtagtaactgaccctcaggtgtgatggatttcagctgattatccacaacataaatttgtttttaccttactttggcttcagtgctttttcaagttgacatgaatatgaatcatgccattagaagagagtgatatggaaatggttttggaagcaggaaacattacagagccctttgacaggaatgtcaggacttctgctattttaaaagccccaactgtaagatactcttcttttatagatgactatctgagatgaaatgggacctatggcaaaacccaaagggagggtatcttagcaattgccctttggttaacctgtttctcaaaagattatgtgtatctaggatcaaaatccctttcctatttttctcaagaattacattttcatctattaaatcttttctacataggctgcacaatcataattttattatgtctgcaccattttactagcgtttgtatgtgtcttggggatatgggaaatttaaggagtagaatgtgtaaaaatgaggtaatttacattacttggtttaacttaatatgtgtttctacttagacctggtttctgtaccaatttctggttttgtgtctcagttcaagccagcatgttgcccccataggaggtcaagtccgttttccctggcctccctctcagttctcagctgtaagtgttttccttgaggccacctgagcccttatttagtggcttctccctggattgtccaattaatatcccccaaccaggcttctgcacacagaagttttggagcaaatacaactttctctcccttcaccctctccaccccattaagtttgttcttttttgggagcgggtgggggattgttgttgttgttctcatagtttcctctaaaagccaaatttcttcacaaccctactgaattaccatttggtgatttccaaacttgtgacttctataatggtcccctccctactcctgcctcccattaattcacctctctgctctcttagacatttgtctccaggcctattaggttcttcagtatcaacattatcataatcattagtatatttgaagccaattaaatggcaattactctgaccttagccagtcttaggttattatcaattcatacgtaatttggaagtatttggaaggaacgtggattcatgccttatggtttgatctgtgtaaatatttctatctgctatggcagaagtacatcctgttctttacaacatctagagttggggtgaggttattctgcccaggagctgttttctagctatcagtccaaataatacacattgtaagtctatctccaaacttttattcactcatccttgactcatccattcaacaagtgtgttttgagagctggctccataccattcactttgtgaacatggacaaaagagtttctatccttgtggagtttatgatccttcataagcctaaagacttaaaattacagagatgttacccttttcagaatttcaccagcgtttatattcagtttcatactgtttagcatttaatttcatgttttccacagagggaaatagagcataaagattaagagcatagactctgggtcaaatggagtctgtgactattgattgagcccttgaaatgtgtctaatgcaactaaggaagtcagtctctaattttgtttaatttttattaaattaaattaagtagcccccacatggctgatggctaccatattggatagtgcagagatagactcagagttcactgtcaggtttactacttactagctgtgccatctcagacaagttactttacctttttaagccttacctatgaaatggagattgtaattatacatacatcagaggatagctttgagggttaaatgagataatatatgtaatattcttggtacagcatctggtaaatgacagcattaggaaaataataggtattattaatttttagtattccattcttcacttgggatgtctcatggagcaaagcataaacaacttgagaacaggaactgtttgtattttagtctttcatggcacctagtacaataatgatcacatagtaggtgctcaataaaatatgactttttttttctttttaaatcatacttcagtatacttttcagttgcatttttgtaatttgggtgcaggaataatttttcataaataatgatttttagaaagctttcatatatgcattacaaataaatgttcttttatattcatatgaccatgacagaattgtatttcagaagtcctgttttattaaaagtatattgactacactgacaatatagcaattggtatccaaaaaaaggagaaaaaaaaaacatgaggaataatgttggttttgatctgtcttctccatagacatgtgataagttagtgaatataaatgagataacaactaagacttattctaaataacttgataaataacttgcccaagatcagacatctattaaatggtaaagccaggattcaatctgaaattctctgactctgaagctcatatgctgtactgatatttataatgatgtcttttggttcttctcttaattaatcttaccagagtgtcaaaaggtgaaatatcctttaagtcacatggaagctgctgttctctgctattacttcctttgtgagcaaggagacctttattttagggaatggtcttcgtgctggagctcttacaaagtccagcatcatttcttgctgtaggcattctaaaacaggagggctgtgcaataacaagaacattttctgatttctgtaaatattgctctttgcaggactagaatgtgattgctgaaatgtctgtatagagtatttctgctttatcctagagatggtttgaataatatttgagctacgtatatttctgagtggcaccccttccgtgtagactatcatagcctattgtttagcagaagaggttctgccattgcccagcgtctgtccccgagaggctgtccaggttgctgtctgattatttcattttccgtttgtagcatcactttcatgctctgtagataactggtccaaatttgtggtccatgaacaaatgtacttctcaacgattctgtatatgtctgcaggtctccccagcagtcattaattaggatctggaggggatagtgtagaaaaataaagcttcactaatggtgacaaagtaaaaggaacagaaattcaattcaaaccctgggtgcctaagaaatgttagagaatctcctgcttatctcacaaatctttaactatttggttatgtgctccagcagagaaaatctatcaaaagttttgttaaggtaggaaagaacaaaatcccccagcttttacaagtaatgctatttctattttaatgccactcaggaactggcctctttgaaagttcccaagcttgtaaagctaggaattcttcccttcctcacctgtcttacttaacttgcagttctagaatctaacttgcagcctcagttaatgcattgattttaactggaaacccaaaaggagacagtgctgtagtcagctgaactcttaaacagtcctgggagaccagagtgatttgcacattagaaaatagctaatgggccagagaagcagaggttagttgcagggcctttactactgtctcttttcgatcacaatgagagagatcactgaaaaaaagtatctaacacgaagtgctaaggcataccttattctttttctttattttggcttttatttttcttcagggctgggtattttaaagaaactcaagcctgagaaaaatggaggaaaaaattatggtcattaatttcttctcccattgcaaaatttcagtaagtagtataatatcttacaaagttacaggttaaatacagttgaaaaatgaagaggatgcatttggaattgtattgtaaacacattattccacatagcatactagtaagatcatagaatttgctaatagacagccctgagttgctattaagtcgccaattactggcaagattctttatgtctctagcctcagtttcttagtctgtaaaatagtgataatagtaatggcctatcctacagagtttgctctgaggattaaggtaatgtatttaaaatgcttagcacagtgtctgacaaatattaagtcctcagtaaatattcattattattgtcatcactattagtttgttgcttgaatgtttaggaccttgcatagctacaccaaagatgaattggttctgcttggtctcaaatgtcatcttgctggaatttttttccctccaaaatgaccaagtgctatgttcacagcaggcttaggttgtcttcacattgctcgctgtccatgtctcgctggggtcagaggtccccgataatgctctgtgtgactctggcccaagaccctttcctgtgtgcaggagagctgaaggtgacaggcagggtcagcaaaacctgccagaattacagagacccctcagtggattgtgaggagacagcaagaaagtctgtcatggaccagaaacaaatgaccttgaatccatggaatcacttctcatccggacattgctaactttttctcaggagtaatttatgaaggcatctacagttacttttgcacatgctaatctgttcattcagttctagcatttcaggacaaaaaaggtatattataggtgaagaaagcacttctatcaccacctagaatatttaacaaccatattgtcccttaaaaaccatttgctatagttgttgtttttaagtctctaaacaacttgggttcaaagctgcgggtagcttagaacctgtgagctctttacttgcctgctcaagttctgcctcaaaggcattactctagccagagaagtagcaagtacaaattgttcatgcatagcaattgtttccctctcttctctgctctttctccttcccctgctacctttccacccttgtattgacccctgaacatcaaattaatggcagcatatcaggattctgtgtggcacttatatcctttgatgctggttttgtgcctgtactacagttctcatggcaatggtttcatggtttcagtctcaaaatatggggtttggaaggaggcttggtggagagagagagagtagagagagagagagcaaagaaaaaaggagggaggagagagaaaaaggaggggaaacaaagaaagaaaaaaataggcttccatagtgcagatgactttgttttctgttccccttaaaacttggattctttaacacactttctgttctttttctgtatgtataatggtaaactgccagaatactgatcaggccagaatgatgtttgaatctttctctgtaacccaccaacccacacgcatcctcccattttgttttggggaaggaagaaatgtatccacgcccctgtctgtcccttcaccagttgcatcagtgaggtggagactgtcccccctgggcagtctgctcgctgggtggacgcactgcctgtccagctattctgcactggctcgtctctaattaaagtacttgctatgaacgatttttaagtactggagcttaatgaagttagaaaaaggatttggatgcagtttgtgaagacttcaaattgtttgagttttttctctagggagaattgtaaagtctggaggcattctgaattacttacaatgtattccattttgttcttttcaaaaattctctcatagtggtgaatagctgagaaaaaaaaaaataaaagcccactgcccatcttttcccccaggagaacactgtaactcttgctttgcaaagtggcttcttgggaatttacaagtctttgaatactgttatctaattaaagggatctttaattctcattggcaattctacctttgaccctacagtatctaagagttgaaagtaaaatcacattcatccaagataacccgaagcttgtacatttggaagcttatccctgtcactgatacctgaagcattatgcttcagagatactgggctgagcgtggaaaaggaatgatcagtatagttctatgtagatctatgaggtgaatttctttgtccattggtggtttactgctgaccagtaaaatgctggctaataccttctgttagagattggagttgcagtaatttgtcatcaataactgtaattaggtttatctacccttttaaccaataccataatctttaccaaattgttattgtttagagctattgagagaaattctggaaaactattttgaagattgatctcaaagcagttcaactctgtagggattcttccttttatccatctcttaataattttcttctgaaatattcaaatgctttctcagaataaaatgtcatgaaagcatgtcatgtatctgaaaaataattaaaataattgacaggaatgtcagttttctggtgaggtgtgtttctcctaatcccactgtgcaatctttaatattgatccaattgttaggaaatcttgtcactctccactcaccatacctgggctaaatattttcagaactgaggatcctgaaggtatagaatatttacatctgtatcataatcatcatttgacaaaaagaggtttcctttcacttatgtgctggggcattgtgtacataatatctatgtatgtaagaggtatatgcagcatatgtacaatgcttgctcggatttgacagtttattcattgtgtacattgcatataatattgcaaatgacacatcagagtattggaatctaggcaataggagttcagcactgaaagtgtccaggttgcacctgaactagttggagcctgccagcccctgcaagcccactgagagcatctgtctcgccaccaccttgctcatgctgtctcctccgcaggccctccgattcttctgactatgagcataaatcatccacctgtcaggagctcttgctgcctggattatgcaatgtgcctgccttcatttggaggtggtgtgagcaggagattgctgcaaatggtttgcattcattttaatgccatcccagcatttctttagctttaatgaggggattagggtggtgacaatgactttcagagacaatgaaagtcttcaagattctggaatttgctttgtatgttgaggatagctcaatttgagatctccctctctctctctcttcctcttaaaaaagaaaatcccaaatgaaccaatagtttaaacatttaggcaaaggaaaaggatattatacaaagccagctgtctatagctctatttattgactttataataattccctccagctgacaaacttaaaatcagtcaaatttattgctgattctcaatgagttactttctttcgggcattgactttatacatattggggaacctccccacttttttttctttgatgccttttcttactctggaattaaaaaaaaataaaaaaacctaaaaactcttcaataattttagcttcactaactgttgactagtacaggtaaatcatacctttacaaaaatctctattttgtgttttaaattttaatccttcctggtatacccaggataatctctattgcaaaaattgagatccccctcctcaaccaccaaaatatattaatttttagttaagaaaacattctagtcatgtcagctttgtatctatgatacatacaaaaacatgaaattatcattttctttaattaataagtccttttggcttagtcagacttcaactcaaatgagatataactaggattgtgtttattttacttgaaattggaagaatgaaaattacggttgttttcttgcttatgaatagcaaaaagttttcacaaatgctatcatcacctatagatacataagttgcatagaacagatgagtgaaagaaaatattgctttgaaaatgagacttaagtcagtgagccattagctaaagtcagggtagggagacacaaggttatgtatgtttggtaatatctttaaaaaagtgttttgatatatagtttaatataggcatattggtgaattaaatgacatagtagtacactggatagagtatgtgttttctaaaatataagattcttttattgtcatagagttttagataaagtaggcattagatttacatgtctaccatgttttctttcttagaagccttcgggacctcctgtatgtgtttatttgcttatggtacggagggcacctcaggagggagagagtgacagttcttgctggcttcctgtccccctgcttcctcatcccaatccttgtcccacctcttccactgtcaaagccagagagcttctcagttttccttgggcccatgcatgtgaatttcatcaaattctgagacactagtattcacaaagaatagacagttgtattatttctactatgtgtgtatgtgtgtgtacctgtatttgtacctatgtatgaatgtatatttcatatacatatataatataggtatgtgtggtatgtattttatatatcgtatatatacttatatacgtacatatatcccttttgaggaaagacctaaattaggttttttgcattaacactgaacacactgagatttggtctacattggagagggaccaaaggaagaaaattaaatgatgtttagagagcctgggctgtttataagtcttcataacacaagaataattatttttcccttgacaatagtacttctaaacatcttagtcacacacaaaaatctttaatccattgaaatatgatgtaaatgcattttccaagtattcctaaaacaaacactatttaccaagacaataagtagcccatgaatcttgaaggatgagctttctccttgctactaacatggttacagattttcatgtgcactgagaaagtgactgtatacatacacagtttgaacgtagcaacttcctgtgactatttttggggatgcaattggccttatgagtgatgcatacagaatctgagttccatccttgaaagtttatcaggtgaggagttaacaagttagccttctacttttctgcccgtttttaatgtgatagaaaagtatcaggattttttttttttttcttttccctctgtttaacctgatggactcagcttcctagaacagaaaatgtgtttcatcatcatttttccccgtcactgacaaatctaaatttatgtatatttaaaaaaagaaaacaggaacatttgaagagataaatgcaacacaacactgacaaaatctgatgaaaaatctcactcttttatctatggagaaattaggtttatcatcaggacagcattctcttttcattttctgaaaggtgctttttgacagaccctttgcagtggacgtcacactcacaaaacatgctgtcacagggctatttgaatatggtgacaggctcattatcatgttgaagactcctgacaacactgcagaggggaaatggacagggctgccaatcagctgttgaaaagactgtggttgaaatagggttttttgttcagagaacagtagtacaaattgactgcattaattctttttattatagctgtgcacactatagttaagggctcgggagggtttccattatcaacccctgttttcagcaggtttattagctaaccataaaaatttgttcccagctgaaatttggcagaggtagacgccttttcctataagatttaattgtgtgtgtgtgtgtgtgtgtgtgtgtgtgttcacacgcacatgtgcatgcacatgtgttagtcttactaacaattttaaaaattgtcaaaatggagtttgatgagcaggtagacatgacttccaaagtctaactgtaattcagtcatcattctgtgttgaagggaaaaataattcaggctgatagtctatgattgtgatttagagcactgaagtctctctgaccagagaatgaatgaaacaaaatgagaatgaaagtaacaaacgaaaattcataaatgttgctgtcatgaagcaaatagtttttcatagcacttcccctagtatttatttgtcatctaatcctgacttcgtgataaggaaagcaacatgtgcctaaaagtcaagttacttccccaatgttttcagtgacttcaccagggttttacttaaaatggtggtgtcaaaagttttcattttcgtgggtaatttgtggagagggagttggcctcaaaaattactgtgtatatgtggccctttttcttttaaaatttttacaagcaaagaattaacttgggaacattattctaacagtgtttgaagccaacaatagatgagaggaattgtaaactggcatttcccccctcttaatttgagctctgtgactgtgggtatgatttggtattttgcctaagtctccaccccaaggacaccaaaacaaaatcatcaaattctaaccttcacataaagcaagggtatttctgttcttaagttttgcataactgtttctaatgatccctgttctattcagtgcgcaagttacttcctggtggtaagacacttcaggaacccacaagaggaacattaattctcctctgccatttggtgtattgcagcatctacacacttgattagagtctgctctggtgaaaaaaagttagcattcctatataagagccaaattctccccagggagtgacttagatattggagttaataagtccaatagggaaattttacttatttttcataggtattccattctgacttgacttgctaactatgtcttaaatttgcttctcagggtggtgtcttatatccatataaacccaatgggcaaaattatgtggcttttatactttatgcttaagaaaaaaaaatctttccttcccacttttgtctttaataaaacaaccctgaaattttccactgtcagcttattggtttatgtgctgatgtttctctcatgtcttggtttcattccttcctttatacattgacttatttagcaaagatatattgaccatctcttgttccaagtggtaatctaggtgatggagagttctaggtgaacaggagtttgaagagtttgccatataactggctgtggggtataggacaaagtggcatgggagcacaaaggaagggcatctgtcctagtcttgtgatgtgcaaagtgagacctgaagaatgagcagacattaactcgtgaagggtggagggaaagagagcagatattccaagtggagaggtcagtcattgcacaagctcagaggctgagagagagttttgctccttcgaggaaatgagagttgttacaaatggccaaagggtcatggatgatgtgaagaagcaggttactagtgatgaagatggagtcagggacttgataatgaaggatcttgaaatcaatttaagggttttggactttgcctgaggttaatgagaagttttgaaggttttgctttttcttgtttgggatcatattagatttatgttttagtaggaacactatggctacaacttcagggaatgaatgaatgagccaatggtgttggcatcagggtagggtatgcctagacttgttgtcattttcagaatgaattttatttctttccttcctagttgatttctatgatctttctgtccccaatcaaatttaaaaataagactttttattcatttgatgataataattggccccatgtttattcacatatttctcaactccagaagtaaaatcataagggaatctactccaaattggctgttagcttgagtctttaggatttgatccttggccaagcacagtagatcgcacctctaaacccagctagtcaggaggctgagaaaggaggtttgcttgagcccaggagtgcaagtctgcagtgagctgtaattgtgccattgcactccagcctgggtaatagagtgggaccctgtctctaaagtgaatgaatggatgaacaaataaataaataaagattggatcctatcaggttcaacagagttatttgtattcattgagtgtacactggaagtatagaaaggacatgaattaatatttgtggctctagactctaagatactttctagacctaaaaatccattattctaatcatgaagatatcatacttagattcatcaggatacatctgaagaaagtacaccatcaagctctaagttgattgtgtagttcatacgcatgaatattgtaaaataactgtctagatagaggaatatatgttttccagagaatcatacccatgcctttgtgatgaaattaattttcacatggttccaagtataccttgcatactgtaaatacaaaaacaagcataggaatactttcattctcctaatagtttaacttttgtcattcagtacaagaaaaaaaaaataaacttcttaatggtccctggagcatatttcacaattatcaaataatttacattaagaagactatgctaacaaagcttaaataacagagaaaataatcatttgccttttatttcttgatggagtagccgtttttgagcctaatgctgccattggattgaacatgtttccactttcttcacataagcatgctcgtggaattctggtttctgtccaggtatttgggaaatgatacttaacttatctatcaaaggttaaagtttggttttgtttcaatgtttatatcttgaccctgcgcagcaaagtagagtaagcaaagctggcaccatactgtaaaaatcagcattccactagatggagcagagtggaaatagaactaaacaggactgagatgtgttgaggaagccgagctggcatctcagagagtaaaaaccagatacaatgtgaccaaaaagaaaaggaggggaattcaggaatggggtgcatgggaggtagaggcagagggacctggtaaaagagaaaggattgagtgaccaggaaatttatacattttaaaaaatggcacctatgaattaagaggtttccaagtttacagatacaatcttaaaatttgtagctacaaactagttattcctatctggattcgagatgtttattattgatttctacaaagaacaaggctctccgtatcaaatcatgccatcataaccatatgtaacatttcttccagttctggaaacaagtcccttgaaaatgggttagaaaatctgctttggaggatttccttgccgtttaatagactttagtggtcacaaattccagaaatactgcttatcttatactttaggtcttttaggttctggcagagccctgggcacaaagatagagaaaaataaaccttagctccatggaataacttacagtgctgttacttttgattctaatctatttggctatctatgccctgactctctcatttttagaacaatgagtcagactgcagtgtggccaagggataaggcagcgggcaaggccagttacaaagataccagcgaggaacctcctgcaataatctagggtagaaacaacgacagactgaaataaaatattagtcctgccttgaaagaagtgaacagagtggggaggtagtaagacagaggaatgcaccaaatgtggcgggagggttgctggactaggacagggacaggcatctctgactgtcaatggtgctgcatttcactgccccagggcacccaagatgaatgggatttggggagtgaaaggggagaaggtatgcatatagcttttgaagtactgagttggaagtgcgatagtggagccacagtatccagtaggcaggatggtgtgctagaagagatctggactgcagatgaaactgtggaagctgtcagtgtttggatgggaatgaaagatagaagtcatgggaaaaatgctttaaaacacaagatgggaagtgagttcaggacagaatcctgggtttgctgataataagccgagggtaggagaagaggaatttaaaggagatgaagattggagttgtaggaagaaaacccaagagaacgtggtattgcagaaactcaagaatggagatttaaggaagaagtagtaaaaagaaatgtgaagcactgcagaattgtcaataaggaaaactgaaaatatcactgggattgccaacaaagaggtcaaagctgattttggcaagaatggtttcattagaatggtgtgggcagaaatcaggtgctttgaggaatgcatgggatgtcatgaagtagaagtaatgagaatgaacaactctttcctccaactggattgtgaaggggaagaaaaacagacagagggagtgagagaggagtcagagagagaaaggcatacggagacaaagatagagacagtaagacagggagagatataggaacacagaaagacacagaaagaaacagtggatagtggctaaaagaaatacataattactgaaaataattgagtgagtaaaatgccatgtccacctctaagcactgtatatgtatgtagaagctcatttgattcttataacaactgtatgaaatagatattattatccccatcttacagataatgatggacacgaagacacagaagttaaaaggcttgcctgagctcatataacttttaagtgctggagatggaatttggagttgagcagtctactccagagtttgaatcttaattactacaatatattgcttcctatgttatcatctctagacacctggaatttagtgtttgtgtagggaagcatgatgtttccaggtgaaaataggaaaagcaagacgttattataaggatcaacttcatatggagaacaagtgttaatatagatttttttttttttttttgccaaatgagcatcagtaaagagttttcataagtaaagtgaggacaaaaatgatcaaatggtactattgggacatttggtaggtgataaggattgataagcagggtggacccagtttagagaaacattagaatagatgtggtagttaagagttaatataacaacagttttgagccagtacgtgtttctgagaaaggaacaaagctattattattgttattatttcatgaatactaatcctgtagaaatagtagaattagatgaaaggggaaagagacagttcataattgggctaaaagaggagacagtttcattggcccacgtataagatgatcactgtctgagggtggtagcattcagagttaaatctgacagagtctgttatgaaagaattgagatatttggtgagcattttgaatgaaggttcaatgaggggaacaacgtaagacaactcaattatttcagagaaacaaagtagggtaccggaagccaagtaacagaattgaggaaattgagagtagaaactcggatgagaagaaatagtaatttacttaattaatatttagagtactttctctgtttcttataagccctctgataagtactgaacttatattcatcatgagtttagttaaggtatgctgggttttaggtaataatggggtgtccaaatcaaaatgacttagaagcagttaaaaatttgaagcttgaatttgggtgagactttcagggatggagatattaacctgagaacagaggcataaagatgaaggttcggttatgtattagctcacgaatagcctaaactgagaaagaatggcagtttttttccctttgtctctgtgtgattttccatgtggtattgaaggcaggtatgctgaatattcatttcaaaagatattatctgttccaggtagggcgtaaaaatgatgtcttgatcagctgtcatcaaatatctcatgacacttttttagagttagcacttggacctgagggtcatggccacagtctactgtagggtcattgtttcttacctctgggatattttgacaggtttcttagagggctggaattatttctgtcctaaactgtctactattattagacaccgttaagtatctgaatgctttttcatctttgcaatgataattgaacacagtaacagaaactcacagtattgctggaaatgagcaaagacatgtttctattcatgttctaggaatttattcctctttggccttttagagctctaacactctcctgcctatggcttagggagaaagagaccaaggccggcctttgttgattgctcatgggttttttgtgcctccctgggtatttttctaggtgttagtgggaaccatattggcttagtgtatcttagaggaaaagagagtgttccagatcttttccaaacattattggtcttaggtatggacttggctagtagagtttgagtcataaataatgatcccactggtgtagtacatttggaccacctgaatatatgcccttgagtgcaatcaatatctgctctcggtgtagacctgtctttgttctatatttgtttgtgtttctgggcattttgctatgtatgcacacacatgggcattttcctttcatgcccattccagcctgtatacaactctagcaaatcctcagtatatttttcatatttagttattattaactttaacaccatttagaggttatgtctcctagaaaggtcggtatttaacgtgacattgggtaagttttcagtgctacatggtctagttattcttatcagtatttgtaagcatttggctagctttgttttatgtttccttacaccctcagaagttgataaagtaactcttcaatttccttggtccctcaatagtatagttttgtcactggtaccttttctctttgccagaagaacaggggcagggaatattttatgttggtatgttctggtctccacatgtgggtgtgttatttacaggatgcaggaatttagtgcgataaaaatggtataacctatatgggtgatgctaatctatataatgctgcaagcagtatcttccctgttctatgtatcatatttgttcttaaaagttagagtttaggtcaggagatcgagaccatcctggctaacatggtgaaaccccgtctctactaaaaatacaaaaattagccgggcgtggtggtgggcccctgtagtcccagcaactcgggaggctgaggcaggagaatggcgtgaacccaggaggcagagcttgcagtgagccgagatcgcggcactgcactccagcctgggtgacagagcgagactccatctcaaaaaaaaaaaaaaaaaaaaaaaagtttaatgatttcagctgatgacagttttagtcataagttgcattgaactgtaactacagaagtaaatattttgtacttccagaggaaaaaaggatgaatattttaaacatgatgatatcttctataagaactgtttagcttacttcacatggttgtatctccctttttcctttatttccatatctctaataaatgctaatcccatctaaaaatagagagattcctttcaaaatatactagtaatttattttcaggcttcatatgctcaaattaatgtagagtattttgataaagaaatgtgtaaccagagtggttgatacgcatctaaatttcttcttcaggaaaattctgagcttataaactgagtttacaagaagcagaacactgataaaaggcatgccctaccaatgaaataattagatgcactatcttatgggaagcgtgtgtgtgtgtgtgtgtgtgtgtgtgtgtgtgttaattttcatttgttttccattggagctacttaataaaaagaagaaacatacctttctcttaatatcatagtaaacaaaatttttacaacgtgtaggccattctaacatgtgagggaatttcaagtatggagtctgtattcctaaagggctgaaggttcagttgagaaggatcagagaatgcctaaaagaaaactaataattcaagaaagcagagatgagtttccatttaaaatggcaggcaccagccatcagggttcggttcctgaactgatttaagatgaccagagtgttttaagcagtcctttggaagtgaaatttctactgttcttaaataaatgttagttcttagaactgcagaggtcaagacaaaggactttctccattgaggtcattgtggtcaaatgaagcctcagaaggataactttcatggtgttttcctgatatagtaagtatcattttggctagagtcaagtttttgtaaaaggcagaatttggagctaaggatagagaagtagatacgatccagctgatggaaggtgttgcttgaattccatgccaactattcactctgtagtttgtagacagtagtcatccagctcaggcctttgtgcagggaagtcacaagtgcacgtctgtgatggcagaaaggagaggataggcgcagtctagtaagcacatcactgcagatacacaaagtgtcaaacaatgagggccctcatcagattggtggcagtgggcctagaaagggaaagatggacttgagaaacattcctaaggcagaattaacctgacccagtgcctgactggatttgggaatattgttggaaggagcaataatcacttcatgaggaaaatcagtggagccatctgttgcaatagactaatccccatatgccatcagtctgcagttctgaacagcaaagccaagatgactttggagagtaaaattttgtcttcagtggttgatggcctgccccagatggcctgatcagtcatggggcattcagtttcctcaagatgacaatgtagaaatgggactatggacaacttgagatgttgactagagatgaggagtatcagaaggaatcctttcttctaaggggcgtggctttaccatcacatacccaacacatgtgggctaagatctttctccatctcctttttccttacctagcaacaaatgggctgcaaccaacagtcatcttttgattcaatgtatggaactgacaaaaataattactctgtgtggctcttgatattgcacatctttgtcaaaattcttttaagcacagatcactgggatggttcttttagtagtgccatgaactagacaggcataattttccaataaaacatgaagaaaaaaatgtttaaattggataataaactgaatttttgcccatttcgatagggtaggtcaaggttagtactttgaatgtgttagcctagaataagtaagcaaaattttatacataaatatcacttatttgccacttacattaagcttctactgtggatacatatctggggctgcttctaggatcttatccatattcattggatgttgtaaaagcaaaatgggatgggaatcttcattggaaaacaccctgcatcttgacgtctggtgtccaaacatgatgtcaatattgatattatctcaagggatagcagatttcagattggtaagccaaacatatctagagattaattcctttttctatatcattcaaaatactgctttgccttgaactattttcttaaaacagagaatatttaagtagcagagatgttccaaatggtaactatagacacagttcaaaggacagtggataagggtatattgccacctatcagcaatgcaccttcttctaaatacttacatattttttctctaggtcaaataaaatatgtcttaagcatcgtcctgggtcacatataaatgactaaaccccttattcattttgttaccacaatgcaatgtgaatgaattagaggtgaagggaggattggcttatattagtcaatgactccagctcaccaaagtgcatgcttattgtcacaattaggcctcattaattctttttataggtttgccagtccttaagtggtatatccttctccaaactgtttttgagaaaatgaacaatggaataaatgagtggatgaaaaattaagtagataaataggattctctgagggcagtgtaacagttaaactagcaagttggtcctgtggtggtggacgggtctaaaatatattagataatactgatggtttacaattagggctgaccacatgttctaaatgctttacacgtattaaatcatttcatcctcaaaacaatgctatgaattagatacgatttttaacccattttgtggatgagaaaattggggaactgagatattagataatttgatcagaatcacatagctggtaagttacacagtagggattgaaacccagaaattggcttctgagcctggacttaaaaaaactacactatattctttgctattagagtgtggaaggctcctaagttataggaaaaatttttctctacatgtatttatgtagatttttagtacctaataacaggattatgtttgacttgttgaaatttcgagaaagatcatagacagagaaagtgtgtgctttcaatcttcttgactcggtgttgcctacttagagcttttctaattcacattgaataggcatattagtttgaaaacattttaaggcattttactgactagatatttgtagttcagcttgactctcctggccacatgcattgggtgtactccgtggattattcagttatcaagtcaattccttaggcatctgttaagtcttcaactaaacaaaccattctatgttgtgaaaaatacaattggattttaatgttaacctcaaaaattatggttgggaaggtaagcaggcttcaggaaaaggacccatatattacttgtggtcttttgtctcctgtcactgttgcatatatttcagaacataacaatatttgtagcttagtattagataccgtttcgaagagaaaaaaatactgcccttcctggaaagctcttacggctgccatatgaattgttgctcaagcctacatatttgaaagccaatgaaggtaagagatcttacttcccatttctttgaagagaggaagcaggaaccatgaagataatgggctgtttgatgaattggtgatccacaatagaatgaaggtggcccccaatatttccaatgatgtcttttctttgcctatttagatagacttctggaaacatcatttgacattttgttttgtatttaatatttttaaataaatttctgattataggaatcattaatgttccctcttccacacatgtgagcatgcacacatgtgcttaagcatggacacacatacacattccaaccaccagaactgtgcaatattaggaagtctttcccttctctgatttcataacattagatgtagttgtaaatgcattaaacaaggaaaagagctaagaatgcatatgttggtgtgacttttgtattcatcatgggatctggtggagctgaatgcctcgccaaattaatttgccactcatgagactcaaattctgacaaagcctacagggttctagtggatgtatttgccagtaaatcacacgtgccaaggaaaccacagtgacctgtgtcaatggcatgggctgttctcagtaggcttggtcgttgaccccaggccacccatcttctctgagtgcctacatatatctctctttgagaatttcagtgacctactgttcactcaagttcattgaatttacagtgatcactcctaaccttaaacatagaaggcaaagaaaacaaatcacaccattttttttgaggtttatgctctcccctggattaggaaaatttcgaaaattattttctttagcattctaagatgcagtgaaaatcaactaagatgctaaatatcaaaattgttaagggctaccacttgcataaatactgtcaaatattgaaaatgaaagtaagccacataatgtatacatacggatgtctgaatcgttatatacatattacttatttatatatatgtaaattaggtagatgaatatgtaagattgtagctgaacaaaataggacatggtaccaaatgaggctaaggtggcagattcaattcctgtataacctacctagttaattctgttctttattcatagattgaacccctgattcttagtcagatcttgtataatgtttataatgttgcagctggtccaaaaaggcagtgtgaatgaatcagtgcaactcgccccactattgggaaaacacgcaaatctatcagggtatatccataatatatctgttcttttgagggcaagtgtaattttactctcaaattcaatgtgtgattttgatattactatgtgagtcttgttaaaatatgtaaatagggcatttgctaaactgtctttattcagtgttcttttaagtgatcataaaattttaatgactattattactgatactctaataagtacttcaatgaattttttgatggttaaatataatttgtatgttactctagaatctcaatatggggattttaatattgaagcattaccgtaaaatattcatgccatcaaccttccatattgctgtaccatagaataaatgcatgttgatttgaacttaaatctttctgacatccaatggtttgggtatcacaaaatcttgtaaagcattagccattcagctgagggaaagtgacttgcattttcagagtatttataaattgatgttaaaaaacattttattctagtcaagcaggctcttgctttacagtctaattttggacatatatgtgggttacttaaatagagagataacattaatctttcaggagcaacaagtgctgggtggggttaaggccaagagattagcatttctgttatcaacatgctattgttggacttaagtaccacaatatatgatcattgcagaatgttcaaataatttagattcctttgaactctgctgtatgatactacatttcctcacatcgtaagtccccatcctcaacttttttttttttttctaaaggccaagcagcaattagtaggaaatgttacatctaatatgcctatgatttgcttgaggccaaacaaagcagctcatgatactgcgttgctgctgctatttatgtagacattaggcacaggagcaggtttttaacaataggactgcttgggctttatgttacacatcaagaaacattttgtttatgctttataaatagtgtcacctatttataaccttcagccacgattcttttaatggcattctcaagtggcgtttggtttggttaacatcagccactcatgccttctgttctgttgcttgagaagttaaatgggaatatgtgagttttagctggccaatctaataaaactctgggaaatcgttagggtaaaggaagttaagctataattgacatcatataacaaacattgaaaatgttgaaaagaaacagattggatgagttttatattatgaaaatgtcatctgacagatgcagtacagtagtttcatttgaaaagatctctacatacactgagtcttctattccattaaaagaagaaaaaaccctgaggtgacaggagattcctatgggggattagctgtctatgcatatctcagggaatctttgggggacatttattctcatcttggaggtagaaggaagattttaaagttaataatatttctgccaccctactctttcctcccgttgtgcttacaggcaaaggtgaaaacctgccctgtatctcctgtgtctaatggagaatctacatcaaaagcaggaagtgcttttagagataatagagagaagagggaggaaagtgagatcagctcagtggtttgtggcggcctataaaatcagcaaaggcctttacagaaacaggagccagacagaactcacaaaaagtaaaggatgtaatctgttcacaaatgcagccagttggcaagcctgaatgactgccctctgtcatcacagtaggtacagatcaacacacaatcctaacacatttgcatttataaacaaaatgtagagaaatcgatgagagaaagagggaaacaaatcaacctttctaaaatttttttaatcagacacgcttgttttttagtctggcactttttgatttgagaaagataattgtgaagaggacattagctaaagctgcgtttttctatgtcactgcgcccattcccccaaatggttcagagtagagcatgtatcttgaatttactaccaatctcctggtaggctttcactgttaacaaaagccacctgcacccacgggtttgggtagctttgaggtagttactttccaagtctctgtgggcacacagtagtgacagccaggatccagtggaccctcttctgtgatcatccaccacagcgaccctagtataatcccaacacattgggcttaggacctggagccttcttatatggggtgagatgctttatcctggctatagaaagcaaatgactgacacccacaatgtgatcaggctgaggtggagaccttgcctagaaataggcaaggttggctgggcctggtgctcacgcctgtaatcccagcactttgggaggccgaggcgggcagatctcctgaggtcgggagtctgagaccagcctgacccatatggagaaaccctgtctctactaaaaatacaaaattagctgggtgtggtgtgggtgcctgtaatccctcctactcaggaggctgagtcaggagaatctcttgagcctgggcgacagagtgagactccatctcaggaaaaaaaaaaaaaaaagagagagaaataggcaaggtctgctggtcttatggacagtatttcttctttccacatatgggtaacactagagtgaggacagcattaaagcctggagaggataaaaaggtctatgatggtagggggagattaatgtttctcacaatgccatataccaaacacagagttgacttttcagtaccagctgaccactctgaaatgccaagaactggggtcttccctgtagctagctgggcttctgatgcaaagttattaacagagattgtacgtcatgcaggaaagctaccttaaaacatgtgtaaacaagccctacgttaaggaaatagaccagggtgagtagactaacctacagaatgagctccgtagtagaaaaatatgccaaagaacttgaaagtataacccgatttctttaggaaagaagtgctcaaagagtctagatatatttttgttctttgtaagcaaagttatttcagagtgatttccctgaaggttggtgttaacctgcctaaaggtttgtggtcaacaaaagtcttttgaaaaagctcctcagtcactttgaagtaggaagtcaatgcctgttctgaaatgtgacaggctcatcacccccagacaggtctgaatagagtggaggcataagagaatcaactctccctgccattctagtagttaaaaatactagaaactatcttcaatcagtctcttgaatttttcattttactccttatgaccaagccgcctagaataacctagcagattatataattacaacacacatagaggtctgctcatttatctgggccttgggttctattgtgcatttctccattatttcccatagtcagtattttttaaagcctggcaataatgtcaacttcagtaagttaagatgctgtgctcccttcgctgtttatgctttggttccttattaaatgcaccagctaaacagaaaatgcggtataaatatgtttcatgagtcatttaaggatttagccaagagacattgcaattgacttttgagtccatttttagaaccaactctttcaagactcttctcaacaggaacacttccccctgcactagaactgacaagactgtatgcattactttattttgatactgacatttaaacaataaaataaagccatttaaaacaaatagtagtgctttaagtgtctgggctgtcaagatatcaaattatataacttggaaaaaatcagaattcattgttaatggtatgcacttaacacaaagggtcgctggagtactcaccagatatatattcagctaccatgttggagctaacaggctgtattcctttagatagaattgactatattcacttaaatggacttgactctagtacaatcactgtattcaaatgtcaaaaaaaaaagagaaagaggatgtcacagagggtcacaaattatgttggattttgacagattgtagccttgctttacaagagcagtaacatctcatttgtcaccgtttgatctgtaagtgcgggaatgggagcggaaggccctccatctccgccacaatttaatcgctctgaggccgagagtggtggtgggagccacctgcccatgcactgcactgctgatctgttttaatttaatcgtccgtcagctagatgaaagcataaatcgtctctctttgatctgcaaaatggtgtgtttttgtaaagcagggtgtggaagtcagggagaagggacttacaatttagtgcagcttggacaatgtggccctacgaagacaccaaagttgcaaatcaagcaaagactctcccatgaaacttaggacaaagcggggaaaatggcagaaggaaatctatttgtgttaaaggttaacaataagataaaagctttgtgcataagatattattccagaaaactaaaactagttctcccattcatatccatcatctttcaaatatattttccattgttagttttcgaacgttggcttcaagagaagaaaaagaagaatgataaaggaatttttatgttgccactgtgaatggtcagcattattaatgtaacctgaagttttctaagcaggatgtgaacagtaaaatacaacgttgttaaaattggtatacgtagagaggcacacacttttgagtaaaacaaatgatgtaatggttgaacacaacaatgttatatcacagtagttattatgaggctttacgtggtctcatacgtaaagattttaaggtgctttccacgtcattttgtggtcaatttcccagaattacagataatgtatttttataaataaagagggaaaaacttatagcacctctgccaaaaataatttgggtcatgaagaattgtaataaacacattctgtgtttggcgctttaaaaaataatgacttcttactgcagagattaaagcagtggtatagggtttcataaaattaatagaaatattgtcaccattacaagatgttaccattacaataatattcttataaatcctataaacagaaaattgggggcacattacaaatctttatgtagaaattttccaatatagtatttaaactaatgaccaaaagacttccaaagaagaagaatccatttctggaaaaattcccaacagtaacccagaaatttccaaaaaacttcccctagtctgatcactccacaaaccaaacaaaaattccccctgaaatccctttaagatactatggaaagcagaaacaatttacagttcaattcgaaaagctgaaaatttcttcactggtaatggttctaataaaattaccagcagaggagaaggcccctgaagaccagttgaatcatcctgcttattctggcccatgtatttagttggctttccccttccataattcccattaatggcttttgtaagcagtatttgcataggaaacataaaggtgtctctgccacttccatttattaagttattccactgcgctgctgcaggctcacaggtaaacatcactgagcttttaggttaaataagtcccacaaagcagttttggaagaacctgagtttttattgtgggattttgaggagtgtaaagtaaactgtggttgcgacactgatgttactatgagtgaaatgggaaagcagattatatggattcttcctgccttgtggggctaagctctgctgatgtgtttgggctagcacagaccagagaagtggggagggaaacaagaaaggaggggggtggagaggaaggaactgtaaagaatgttatgcatacattttgggaagtgataaaagagtgccaacaagtttctttggatgacttctctgtaacccaagatatcagctaatctacttaaatttcatgacacctgaggattgaaacagttctattcccgccccttccttccttccctccttcctcccttgtcttccttcctggttgggcaacagtaaatgttaggattattaaatatacagattgctaccattagacacatcctggaattcatccttttccttctccctacatctcttcagttactaagcctagtaggttctacctacagagtatcttttgaatccatctctttctgttcatcccctttcccgctactttagtatagataatttccctttctcacctgggttactgaaataatctccactagtctatatatctttggtgacttgtgcctgacctgtcttttttactgcataggaaaaagtccaaactctctagtagttatataagcagccattcacaattggaacttaaaatgttctctccctagccttctttaggcaccagatgtttcagccacttgcctgctcatagcatgcttttcatgcctccatatttctgcttcttcattctctcaacctggaatgctcttctcaccctcatctttgcctggagaaattcaacatatccaaaagaaagcacttctattttgtgaatcctcaggaagaattgtttcttgtcctatattcccataggaatttttttttttttacatacctctagcacagtacaaaatatatgacagtgagttattagagtcccccggtagattctgggcccttgagggcaggcaataagttttattcttgtctcacctcctcctctcactgcctctaaacccagttttgtgaccaaaacccatagttttgtgacctgagttcatgttccgtcaatactgatgataaactcattggcagcagatattccaggagactttctttgaaggcttatttgaatttcctatgtgtgtctgagtgcacacatgagtgcatgagtgtgtttatatgtgtgttacattaagtagacttcacatttatacacacctttataagattttgtatctaatgactccctgctaagatctggtataccaatggaattaggtcttcaggctactctaggagaatctgattattgatttatatgaaaagaaaacacaagaaacagacaaatggagagaacttaccacttatatcaaatacctgccgtgtgccaaactgtgtctgagatgattttttttttttttttttttttttttgaggacggagtttcacttttggctcttattgcccaggctagagtgcattggcatgatctcggctcactgcaacctccacctcccgggttcaagagactctcctgcctcagcctcccgagtagctgggattacaggcacctgccactacgcccagctaatttttgtatttttagcagagacggagtttcatcatgttggtcaggctagtctcgaactcctgacctcaagtgatcctcccacctcggcctcccaactgagatgcttcttgcaatgttagttactcctctcagaggcagtacaatagctagattccagttctgcctctaccattttaaggtaagtaaacctgggcacttacttaaccactgtttcctttccttttttctcacaggtttgttctaaggaataaatgagttaatacatgtaaagcacttaagacaatgtttttcacaggattagtgctcaacattatcaataaataaaatacacacatgtacatatacatatatatttatttatacacacacacacacacaatttttttcttggtagcacttagctatcctcatatccttacagatgaggaagtatttggttatccttccctaagtcacatagctagtaggtggcagagctaggggagaggaatatcaaattaagtgctttaggcaacttgtttctcctacactgcagtgcaccttcccctcaaacactaacgatcagagactgtttaagatggtcttatcacgctaaagctaagtcaaatggaaaaaaaaatgttcctttaaatattcttcaaatgccttcaagccctgcaagctgcatggacttagcctattaaggatatggggaaattaggcagggattaagctggttgatgggcatattgtaagcctatatttttctcagctcagcgttatcctgccaacaatgggaattctggtttgggcaatggcagcatctttagaaacattttggaactggagcaaaaaaaaaaaaaaagcactgaattttgtacaattatccacactttaaggtcacctaatgttttttaaagatgacaagcctattttaataactcatatttctattgctaaatgtatgaccactaaattgaaggcacacctgctatggtacactctgcctctgtaccaaataccatatagggaaataaatgagggctaggcccttctgtgacagtgaacttcacttttgtggagactgatcactcttgagaggtgataaatgccagtggaaaggtacagtaagccatcatatattaaatatggaaaagtacttttaaataatattgaaacgtgcaaaatacaagctgacagctaccaccaaatagaaatgtaggccaagattttgtttgacagaattaacccctaatgaagattttgacaggaagtgccagaatatacaacatctatgttaactaatgcgtcaataattttgctatttttatgcttatgtctcctgtctttttcatggcagattatcttaagaaaaaaatagactagttatttctaaagttgtttttagctaagattatttagtgaatcacagaggattccattttattgaatctgacttaagtagttagggatcctacttttcattttttcataaaatggatattattgaattatgaaacttcagttattacttctgttatttctagaaagaagtggaaatacaggagtaccagggactatactcacctggggttcagggctctgctgcagaagccgtggcaacaatgaaatgtgttctccagggtagataaaggtgtgacccactcaaaggctctcctgagacaagtacagaataagtgttgacttctttgagggatggtctgtgttcttttcatttgatgaatgttaatatgccaggtattgtgctaggcttcaagttataatcataaacaaaagccacattctagaaaaggttataatctaatgtgtgaatctgacaggaatcaaataatttcatgaataaatgtagaataaatgtaagtgggaaatcctatgtagcagaggtatatgatgtcgtaagtgtgtgtaatagattaacaagcacagctggtatgaacatctaaggttctacacattacaacgtactaatttttgacagattcattaccaagtgttagttttcattggagattgtagagtacaaaagagaaggtgaaagaaaattcaaagcctgtagccaagaaagatgctcatatgtactggagaccactgtgctacaaagaagacatgtatgtcatttatttgtacatctttcagaagacacaattcctcctcttttttagctatattactctagatatattaatttcagaggtgttttgtgaactagagggaattggtaaagtggtttttataacaagatgcaatctgattgcttcattagattttaataatatggttagtgatttctgcctattttaaatgagcttagatccccaagaaccatcagacctaaggaactgtttaacagtgcctccggttgaaaaggtggattaaattaaaggcggctactcatcagtaaagagccaaaaatggaacactggcttctgagttcagtgtctgggctctagaatatccacacattccatgcacaagggcccagtaatgttgtccagtcctatcatttctgtgaattgaactccaggagctccaggaaggattaggttatgatttggtgaatcagtgattccctaagaaggtcttagatgtctagaagtatctccctccttttctttcatcacttagaggaaatttactttatgatcccctaagaaagaagattgaaatgaatgtatgacctgaatgcctatattaaatatttgccccaaaagcaatgagaccagggcaactatgcatacatgaaatacgcattgtttcaggagaacatcttcagaatctacagtcatgacaaaagcaataaaggaggataatatttaagttgataaaagatgcaaacatggctttattgggtttctaaattcaaattaaaagaataaatatttcatcagtgatactaattaaagattggtcaaagatttgtctgtgtctcatatagcaaataccaatcagaactgattaagagaagtaacatttattggactgctcagttatagaaagaaatgattactatgaagtccattttactgaataatggttatttgattataacttgattttcaaatgacattagtactccttgatatcatgccaccctcttctttcaacagagtaaaattgtgatctaggagaaataatgctttgggacgtttaattatataaacttattagtggttttgtgtgattacatgtgctttcagtgttttcatttgttatcatccttgctttttaaaaaagccacgcaaagaattgattgcaaggattatgatattcaggcacttatcatttgatcatcatagtcacatgtttcctttctattttgtttgtacctctccttagatgcaaaattctgaaaataaaatagttgtggtctcagtaaaaaatagccactgagaaaatagggaataaaggagaaggaaatgtaatattcaggttgtggttactggcgtgggtgctctggtctatcagattagagtcattttatagtaaggtctagggagtggtgtttcagaaacaggcatgaatatgcacacacggagttgatgctgtaacatctcttcattcagtttctttctttcaaatataaagcatgtaaattgccgtgcaagcgcccactctgtccagccttcctgaccattgtgctcaccctgatctcatttacttttattttgtaagttaggctgatgccgcagtgttcttgcttgtctacataataaatgtaaacaagtgacagagaggtcatgatggtcaaacctgtactattgtcagttttggtggccagttttttccacatctaactccatccacttttctccaggccagggtcatgggggtgtagggattgtggtcagcattcagctggaactgtctttaaccctctcaggagtctgaatgtcattggaatagacaagatttcttttatactttctaggtaacatgattttatgaatgtagaaattctttacagtttcctaaggacaacaaaaccattatgggttcaattgctattatataacaagagggttccctgtgaacagcctctttcaaggattccctagaatatctacagatcaatctgtgggtttatctaatgataaattacctttctctgttaaccagatgaaaatcttttcctttccacccctcaacagtggtgctgtgcagttatgtagacacatgtctacttgaagccatttttgctagcaaatatatgaacaatgaagagttaaaataattctcaacctgacctatgtatgctgctcccacactgtctctttctgtatgtatgtgttacataccaggtacattaaaattcacatttaaatttcaaatgagctaaatacaccattgctttcaaataagtgactgatttttgttcctctcatgttatattaatattaatattatggaatcttctgtacccttgcgttccttgctgactatctgataattgggttgtggggggagtgctgagggtcatcttgtttagcttatctctgcaagagaaagagtggccaataataagggaaagcggcaataaaatggtaacaaaaaattgaaaagaagatttaatctctggccaatttgaaacatatcccagagaatccatagagaaaaagataaagtgtgactatgagtaagttaactaaacacattacactgtgtgagagcaaatggagttagtccattgtacatgtttaatttcctattagtctctggcgtttactaccacgtctgagttggggcatctgtaaattcagttaaatacagtgcattgtctaaacatatcacagctccaatcagtcaccccagctgctgataagaagcctcttgtattattgaatctacaatggggaggctctgcaggcaccaagataacagctaggtatttcacttttaagtgtgtggtggttggggttgggggtgggcagtgaaggaacctagctgctgcctttgctgttacagctctgacatttattactgctctctgatttgctttatgccagtgatgtgattttgtttttgaatgtattacatctttctttggttttagcttaaactctgtgaagcaaagagaaggcgagcaggggcagcaaagtattgcaaacaaacaaaatcagctttcttgttgttaaaaaagatagccaacagcttcttcagaagggtcttttttttttttttaatttaagctctctttattgatttttgcttttcttgcagattgggtgcataaggatgaaacccagtctttcgtttacttttctctttcatagtttcattgaaatttttattagagttcctctaatgattgatcctcagaaagcaaatcattttggcactaatgaactagatggcagatctatacataatatagcaaatgtctttcccgagttccacacaaaatttttctttccttttgttattattaccttaatcttgtataattatagtacaacaatcatcttactattggtgacagtatacatagacacatatagttatttttagatataatcctctttcacaccttaaaaatttccttttgtaagggagatgttgatgctattctcattcctgagagacattctcatacccttttctaaaatcttactcagatactggctaatgtgttgtgtgaagatcataatgttacctgtttcacactttgtttttttttaatagaatgattgataatcttttgcaaactgctccatatgtctagttttctcatattgtgaaagtacagatcacattgccttcatttgattttatgagtttatatttcctctttcccaaacagatgttttactacagctgctatttgtttagtaaattggttcacacgccatagtactattttcatataacactgcaaatctgaccaacaatattaatgcaaaaaaaagaagaaaatggaaaactcctttagtaagttctaacttaagctctgtttcttggttacgtttactggcctagttctgcactgtgtgtttctttacagtcacagcctcattgtacacacatattcatacctcccactcatataagcatctccccctccctccttccatccacctgtccatctggtaatgagccaaagaagccctaaagctaggcagagggctagagtttcaatatatttcaaagataattcatcctacacaaaaatgttacagtgtatttggtgaaaaatgatgatatactttgtggttttaagttaaaaaggtcaagaatgcatgtttagatcaaggaacaacaggcaaatattttagatggtacaggccaaggaaaagaatgtatgcagggtggttagggcgtgaatgctaggtattagcaacagattattggatcaagaaagtgacccaatcccattctaatgtcataggatgcacttttatggaaaggtcactgttttttagagatgaggttgatgatccatttatgaaagctctcttaagcctatatgccccttattaagctattgtctctcagctctaaacctgctcttctttgtgatatggggggctgggattcaggacactaggagagagaaagaattgtatccttgtgtctgtttcctattaacttgttcctgacagtgccactctattaaagacccattgccctgacattgacagttggcacagtttctagctttctgtgacactctcagatgaagccccattgtgcacttgggaaagccgagcactggccactggctttgactcctctgataccagtctcagtccaacaggccctcttcactgagcttctagattctgatgtgccgaacacttccttttattcccacaatttccagaggcagtagttgcttcctgtagttacaatccctgttcagtttttgctcctgtaattctccaacaccctttggaccaaagttttcatattgaattctccctgttgaagtgcctactgtggtttccgattcactgtctggactctaacacaggtggaaccgcagtttcctaattttatgtacactctttcttttaatgtcacgccctcatttcctcacaggatgctagaatgtgtgactagggtgtgatggcataagttaaacaatttttctttcctttttttttttttttttgtttttttgttttttttgattcagagtctctgtcgcccaggctggagtgtaatggcaccatctaggttctctgcaacctccgcctcctgggttcaagtgattctcatgtctcatctcatcccgccgagtagctgggattacaagtatgcaccaacatgcctggctaattttgtatttttagtagagacgtggtttccccatgttggccaggctggtcttgaactcctggcctcaagtgatccacctgcctcggcctcccaaagtcctgggattataggcgtgagccacggtgcccggctgatttttctgtcttctttaatgggaatctccaagttttatagaatggcttgaaaattactgaggtcagtgaataactgtctttggttttttatcttttgcttatgtctccgacttaaactgatctgcaatgaaagctcttttgtagaatattcacagggtctttagcattcaatagtgtctttttttctggtgaggattaagtacaaatctttccacatctagctaagtcaaaccagataaggcagataggtaaagttataacaaatatttgcatgctacttcaatgaaagttagggtcagttcacagattgtatcagtcttttggagaatggatgcctgagataattttgaaaaattttgtgtagaacatgggctttgagttatattttaaaataaggagtttattgttaaaaaaataagagggaatgctaatgaaaatgaaatatttttaagctacatagattaatttcattcaaaaatgtcatttcagcatctttaatcattaaaatgggattttttgtaatatcaaatataaaatcaagaaaattaatgtggtattctgatcagtgtagatagcaactaaattcagtaattcaagtaaaaagataatgctttaagatctctattattagattttgctatctatagcaattgaattaaaagagtctctccatctatatagatggggctatatagatgtagtttaacactaagttataatacagctgaaaaactgttttgtcttagttttcttcatgtagacaatgaaaacaatgtcagattattgatcaagtattaatttaaagactaaattaatttatagccaatttgcatttattttctgaacattgagcttgtggaaaatcatttcagtgttcggttaaactgtgaagatgttgcttggctaggcaattcattgtatcattattttgaaaacatagttcatagtaatatatagtgtatgtcagggaaattcttgtgaaattttagaataatccttgcagatcttctctccgctgcacaatcaccaatccacttgggaacatttaactcagaatagataatccggggagcttggtgttaaaatggccaaagtgttccaggtcaggctggggattaaactgacacaatagttcatggaaaaattctattagcacctgttacagttggccctagttctgattttcttatctcagtcttattgtttgaaaaatgtaaagaaacagattatacttggtattgatgaatctttgccttcacaaacaacattttatttttcgcattatgttttgtatcaaaagcttgttacatgtatgtacctagaacagtcacaaagtctttcaggctcatgacaagtgagggtgtgtgaccctttagcctcttctagtaaatgtaatggaagaggaaccatgtacaacatagttactcctcagtgattctacaaaatccctgaaaattttgaaagctgcctttactacggcactttctttgctaatggggataatacccctaactgtgtgtgatataacaactatatttaaaattgaggaatttaagtagaacacagaaaggctaggatttactcagacattccatacatttttatccaatgcttatttcctagctgtgtgatcttgggcaagtcattcaaccattttaagccttcactttgttgttgttaattaagaggattttaataacgctcccaaaggccctatcggttgtagggctttgaatggatttcagtgtttaaagataagtagggtactttttaaaaattccagaatgttacaaagtatattatagaaagcctggcagataaccaataataattaaggagctataaacataatactcttttttgaacttgatgcaagccccttcatctatgcctttatttctctttctaaatcttaagtaacatctgcctcctgttgtgattaatgaaataatattccaacttgtgggcaagaggggagtgggtccaacagctcttgcaagggacctgggaaatacgccactgaaaagaacgcaacttgtacgaaataggtaaatcccaaagccaccacatttctgccctgattaagggcacccccttgcttattcactttgaagtcttcttcctctgtcataaccaagacaactcgcgacaaggaatcctcttcaggaaatgtgttaagtcttatccgcacttgtgtctctgatgcgctccctccagctttcttttctaggatgcttggagcccccctccttcgcggcgttggagcgggctttggtttctgtttgaagcccggcgtcggctccggacgcgcgcagcgccctccgcggtggctcccaggaagtccctgggagtctgcggagggagcccctgggaggcccaggggtgcggcgcggtccgacggccgggtgtccttcacggggcgtcctttccacccagctgtccatggagcgagcagagcccctggccgagcgcccgcccgggagcccggggcagcctgcgggtggcagtgggcaggagcccgcgttccaagccggccttgctccccaacccgctgctgccgcccgcgctgccgggcttcctaggcctccgcgagggcctcagcaacccacgggagcccaatccaggcagagaaccggggaggaacgccgaagcagctctttctccctcataatttgagatgctattttatcatcaacagtctgtgttcagacaggaaagattgggctgaataaatgtgtccgggaaacaggatgcagcctgcgtccaaccagagcgcggcggttgtgtcctgtgacccgctgtgaggctgatcattctgcattgtttactcttgtgcgtacatttcaaaacacggaattacatccggaaatctgggtgaaaacgacatggtccctaattgtaaagttttttcacaggacttcagataaatgcagtcatctgtatacctcaagagtggatttatttatttgggatttttttttaagactttatttttaaaataactaatgggtactaggcttaatacctgggtgatgaaataacctgcacagcaaacccacatgacacaattttacccatggaacaagctgcacatgtacccctgaacttaaaagttaaaaaacaaaacaaaacaaaaacccagcacttttaggctgacagcaaaattgagcaaaaagtacagagttaatatcccctgacccgccccccttcatccataccctccctcattatcaacatttcccagtagactggtacatttgttaacaatcgatgaatccgcatggatacgtcattattacccaaagaagtccatagtttatgtgggggttcactcttggtgttatacattctgtgggttttgacaaatgtataatgacacgtatctaccattatagtattacatagaatggtttcagtgtcctaaaaatcctctctgctctgcctagtcacccttcccttccccaacccccggccaaaatggatttaaaagaaaaataacgtatcagaccagaagtttctccctaattagttgcttgttttcctcatggactgcttccggctcctagagaagacatcatagcatgaagcattcttgcacggtttaggttttgttaacaggggctattagtgtgtgtgacttcttaatcccccttctgctgaggggcatctccagcccagttttaattaacagggaaatgctcatattattttggtacactgattataggcgaagcctaagtggaagtcactttggtgtcccaagggatttccgtgttaaaaatgcatagggtacctttttcttctctttctttttttttttttcctgttaattctcctcctccatgaactccagataagcagcaggcccgagccagatttcattactatcacgcactcttcatggtcatcttttaatatttgaaaggatcatttgttaactggaaatggtcaatttttttttctttggcttttgaaatataattttcaatttttaatttgattcatttagatgaaatcattaatcagggttgaaactgagttaattttctggaaaataaatgaggttgttagagtgaacattattaagtgggctctttgtaagaaagggataatagctgaaaatatggaatacttggagaactgtagcacttgggtaaaaatcgaaaggattttttttccttgttaagtggaataattcattttcaaaattagatcagaggatttttagcattaagcataataaacaccccattaattatattagaaattgtaaatagcaaagcttcaagaaattgtaaggaaagtacactgtgtaaagttcttcttgttgtgagatgttaggacatatactttctgatgtggttttactttttcttttgaaatgacttgtgaaccagtactagctttggtatatttcatctcttgtgtctctggttaaattttcaagatctttaattgtgggttgattataaaataaatcagaaaaaatttattggaaccccctatgaatatctaaacctctaatatttttcattttctgacactttgcaatctgatttgcaaccaatctccttcagataatcttcttttttaactacatgtaccatacccataacttcacctaagttcccagatccctcttgcactcaagcattcaatttataacatattattttaaatattgattatttaatatttctttctataggtatgttttcttccttacctagatttcaaaagctttgagtgtcagaattgtgtctttgtataccatatgctcttctctgcacacagtaggcattaaattaattctttttgactgactgactcagtgaattatgggaaactgatgaggtatacaaatagcttagaagcaaacccagatcccagaccatatcaagcctcttttttttttccagccaaacctggatcaagttttagccattaaagaagaaagcatatttcactgacttgctgtgagagcacagcatgactttaagtgattaggatggtgagcaaaatacccttcccaagaaaacaaagaaagctgagatttggccagacatccagccacctcaattcaccatttaagtaagatgcaggtcactggagaattccctgctcattgttgcttctaattgttgcctccattttttcatttcttacagtctcacaaggtgggttgttccatatgaacaatttctttcagcgatttttgttgaatattctatatagagaagttcccattaatgcagttcaagagatttttattggcactcccacaaatgccacatctatttgcagatacatgtagcagccacagtccactcagccaccagaggttccaagctaaacctgcttagagcttaaatttagctggcaggatgaattgcaccatagattcaacctgtctatgtgtttctctacagtttttctattcacagttctatatttcctataaaacaatataaatggaggattaaattgaactattggtctttagaagtcaacatgtatctcaaagatgcccttccattccttgatcttggtaagttaatatgtatgaagtattcagggcagtgaatgttccacaatatacatttaataaatgtaaattattgttattattattcactgaaacaataaagaagggaaaagcctatatgggttgataggtatactgtggaatattgtatgtgaatgtggatgtacatatgtgtcacccttcacactgtaggttgaatgaaggtctttctaaaatacgagtatgatcaagtcactcattttctgtccccttcatttatccacactacgtcactccttaaatccatcagtggctctagaagtattataagctgaaatctccatttcattgagtgatttctcaggatctacaggaccaagtcccttcatacatttcacattttgtagtatctcagttatcagtaatccacatttccaaatcagcactgtcaaatagaactttctgcagttatgggagtgttccatgattccactgtctaatatgatagtcactgacaacatgtgactgggaagcatttgaaatacagctagggtacctgagtagcagcatttgaaattttattttattttaattaagttacataacacatgttagaaaacacagttccaaatcctgctttttcctgcttttctgccacagctgttctctgtgactgaaatatccttccatcttcttcatgcacagacaccttcgcaactcaacacagtgatgcccaagttccttctttgacctctccagaaagagttcagttttctttcttatactccttctagggtctagcccatgcttttattaaaatgcaagcattatacggctgtaattattttcctgtgtaccggcctgactgtgacagtgagccctggaaagaatgctctggtattgtctcatgcctagcacagtgcctggtgcgtaataagcacattgtacacatttgaataaatggaattgggtgactataatgaggccaacaggtaaagccaatttctcttagctgtaatagacaattaaatgtgggtaaatgtgggttctgtttattactattattgttattattattattggatagggaaattttaaacatttaaaaaggataacagaaactcctgtagttggtcagcagctcttacctgtatcacaaacatggtagatctccaaagggccaaaaaaacccaatatatatttttaattaattaacctgccccctctggtatttacaatacatttaacactaggaattgtatagccttagtactcaggatgccatggccagatcagatttggctcaagtcatattgtagacagatgcaaacatatgccactgattgcaaaaaaattaaatttagttactgtttggacgaggaagcctaagctgggattcacttatttcgaaattgactgcattgtaatggtttagccatctgtcccacatgtgaaacgttcagctcacatatacttggagcattgatattggctagtggtgttggccaaagtgaatgcaaatgtttaatgttcacaaacagaaattggtttagagatagctggtctgttctcctcccactctccctccctgcactcccaagccttcaggcattgtaaaataaaagtgaagctagcggaggagtataatggctccgctttaacttccttattccacgggaggctccctaggtcagtttcaatccctttcaaacatcctcctctgactttgaagagagagcactgccccctccatctctgaagctgggcagtggccctttttgttttcacgcactgaaaatgaagtgttcacatgagctcatttacagagagtggagttggcagtcttatcaggagaggagaaagaagccctgaagatgaaaagctctcgcagtgacagaagtctttattactttgggcagtaagggaatgcggtgtacacagggtaaagtgacggctacctagagcatttagggaaaactagagcagtgatcgtgttttatgttgttcctcattcgactttctcagtgagccagttgaccccagggatggggcttgttcaagttggaagcaacgtaagaaacccatgttcttctccagagtaaatgaatttgctgcagtccctgactgctgtttgaattggctttggggcagcatgcatcaaaatcatgcatatgaaacatggcaataaacccttgtcttttcttctacactgctaaaaacacccaacttgttgctgagttttattcttaaagtcctatagtttttctaccaaaattatgtggaaaaaaaatgctattgatgctgtgttttcataatccagcattgtagaaaataaaattggcagttgatcccagggtctttgagggagtttaagcataaattcagcattctaaagaatcagaagttgagaggaaacagccaagaatacccttagctttttcactgagttgtgcttgaatagacagctaattaggcttcctcaaaatttatttgtctctagaaatagagaaaaggtgctaaaagcataatagaaatgaaatgtgctgcaccctttccgagaaattgacattttatgcatttgacatttgatactagcagtttattttttgaattatttgatatttaattgtttaaaataatttaaccaggttctttttgtgcatgtttctcaatgcatttccagaatatattttatcaagtggaaaaataaataaattcaatcataattgattatgcaagaatatagcagctgtgccatgttggagtttcctacttctatatgtatcatgccctgtcatttttgagctaacctgagttcttaacatgatgagcactgagtgccatgagcactagataattttaaacataagtaagccttcccaggtaataatatcaactttgaaaaaatgagctatgttttctatcattaaacattttaaaaatgtgctatgtaatgtttagttttaatcatactggttttttcattttcaaacatttgtctagaaaagaaagtccctgtcctctttcatagagcaagggagatagatttcctgctctcacacaagtacttgcagaatttttccttggggagtttatagaaacatcacctctagccatagtctactttctgcaggatggttgaagtggttgcctcttgtgatatgacagatgctagaaatactccaggcctcaaaatatcttccctaccaaggtactactgagtcccaaagttctaccactaaagacgaatttctttgcattgcaattgttttcttcttatgtgcatcctcctagaagggagtgaaatgaaggccatagataattaatatttactgagtgactgctgtgtgccaagtaatgtgtcttttagtgatcctgtctttctaaatcctaagtctccaggagaggaggaaggtgataatggtgttaatgaactatgtatgcaaaggtcacatagcaagaaaacgatagagctgtgattcaaactcaaaccatttttttcacttcactttattgttaattgagtgctcagatttcactagctggttctagatgctgagtgctccagtgagctgatgagatggaggtagaggaccactttaaaaggcagggttgatagaagacagtttgcctaaagtcttccctctagagtagatccctggccatgcaatagggctgatggcaatactgagcaaatagatattctcaggcattttgctctccttaaaatattctaatttggaatagtattcaaagaaatttaaataatattattgtctctagattacattcatttccagagatgagagtatttatatttgtaatacaaatgtaaatgctaacaataacgaacatgttttgtaccagtgacacctcatctcatttagacatcatgggtctgagagatacatagtatttttacccccattttacatatgagcaagctaaggcccaaagagataaagggcacacatctgagaagagatgaaccaggaatttgacctcaactctcataaatatgaagtcacaattgcttctttatgccaataagtttccttataacaggtttctcttgagtttcagaattcatactattaaaattcactcatgcctataatcccagcactttgagaggctgaggcaggaggattgcctgagcccaggagtttgacaccagcctgggcaacacaatgagacccctgtctctacaacaataaaaaaaatttagctgggcatgttgctgtgcacttgtggtaccagctttttgagaggctgaggtgggtgagaccaggaggcagaggctgcaacaagccatgatcgtatcactgcactccatcctgggtgacagagggagaaactgttccccccaacacacacacaaaaagtcagtatgaatggaataaatcctagaattattcactgggaatccgttctaacttatatgcagtttattttgacttaacatttgccagccttaccagattacttcaaactagacaatgattcaaactttacagaagtgtagagagcagtggacttgttattagttggatttttagaggaataattagaatgcaggtagttatttacaattggctgttatcagaatctaatcttctaaaccgtggttagcctagttgtcctagatgttccacttaaaacagatggggttgggatatggggaaggcccaatgtcagggtttgaattgtctttttattgtctttaaaacaatgagcctatatttccatttaattaaaacagtaaagttgtgcctcaaatatatggaattcaccaacaagtataattgattttattcattttatttttttccctcttctttaaaaagaaaacaattaacaatagaagactgtccattttagttaaaaagctaagcaacaatggaaaagaagatagattactacagtcatccattcattaattgagatggcatagtgactgttattcattcacattgagcaacctgaacaataccaacttatttcggtggctgttctttctctaatagatttcttcttctttttgataatgctgaaatgcaaacagtcccctgtatgtagggaagacagctgtgtagtactgatgttagaagtactcactgtaattcacaaaccttgtaatggattgaatctgcctcaccttcctcatttttaaaatgagaaacatagtaatacctatctcatacaataaatatgcgaatcagatgaggtaagctagatgaagtgcttcataacctgaaaaacagtacacaaatttccttcaaattatcacctctgccagattataacaagatggtaacaccagcccaggtgtggtggctcacgcctgtaattccagcactttgggaggccgaggtggacagatcacctgaggtcaggagtttgagaacagccaggccaagatggagaaacaccatctctactaaaaatacaaaattagctgggcgtggtggtgcatgcctgtaatcccagctacttgggaggctgaggcaggagaatcgcttgaacctgggaggtggaggttgcagtgagccaagatcgtaccactgcacaccagccttggtgacagcaagactctatctccagaagaaaaaaaaaaagatagatgacagcaccatcttgaaattgtagcaatgtcagtgccattaaaatgaatggaaaatataagaggtgtggaaaaagaaaatcaagatccactggaggtaatattacttccaggcaacagtaactttttggagtctggagaaaaggaaaaataaggaaaaaaggagagaataaaagaaaagagagtgtgagccacatggaaggaagtaaaaataaagatattcaaaggattactggaaattctaagaccagtttaatttcattgacacaaaatatgagtttctaattaaattgacattctttccctgactttcatgactagcaattttgaagattgcagaccagttattttgtagagtgttcctcaatttgggctattatggtgtttcttcgtgattagattcaggttatgtgtctttggcaggaatatcacagaagtgatgcagtgatctcatcgcattatatcagatggcacaaattgccctttgtctcattactgatgacattatcttggtcacttgactgggggtatctaccaggcttttccactataaagttgctctttcccccttggagagtaataagaattttgtggtgcgataaattgagactataattattccattccccatcagcttattcatttatttatttatgtcaaggtagaccgatggattcccattttattcaatgagttataatccattgctatcattatttattttgatcctcaaattgtcccagatttttccagagagagccccttcaagctgccttcttgtgacttattgacacatccccataactcttggttcattttcttacttttctggcacaaaaagatgctccaggctggttttgtatgttccatgccacaacctcagtgtcagccatgtctcccaggagctttatttatttgtggtataaaatgaaattaagaaaccaagatgtagatactactgttattgtttttgaatgttttcaaacaccaacaatcagttctctgattctctaggcaccaactgggtatccagtacttcagttcaattctgatgctatctacaatgctactagcaacaggtcacacatgtaaagagctcagtcccataagcctgactgggaggggcacagagcttccatgctctctctggcacaccaccttccagcatgttgatgtgttcaccagcctagaagctcttcgagctccatctgttaggtggtgttacaatgtttccattatgtaggcatgaatgattaaatcatggtcatcattgatgaactcagtcttcagtccttctcttctctttggaagttgatgggagtgtggctgaaagttctaagtttttaatcaagacttggtatttctggtgaccagccctaattctgaagctatctgggggcctgccaagagtcaattctttagaaaaaaagaggttctcctcacccttttcactcaggaaatttcaagggcattaggagcactgtaccagaaaccagggacaaagaccaagtatcttcctatgataccacagttgttgtttgtttgtataaatggaacatcaccttatcgcagggttgtggtcatgtgtcagtaaagcttaagcttagaaagtcatgtaccaacaaagtgtaagctttaggagatagaaaaaggaacttacgttatcatccccttctttagttattgaattggagtctaattgagatactgtcttgtggcttatactttcttgtattaaaaaaaaacaaaaccgggtttgtagttgattacatttctcccatactctcacaatactgtctaaagacttgaaattactgaataatactcagtctttttggcaattctattgccttctgccttcattttctccaaaattctaaccagatctttagcacagaaagcatattaatgtccttcgtaagtgaaacaatttttcagggtgtaagatttcagtagacttcttatttcttaaattccagacagagaggagggaagaagccagtttggactttttaaaaatgtattcatccaaattattttgtctgttcttaacatatgtgacatcattacataaatcagtgttgattgtatggtttatgttcataatgttcagtgtaaagcactctagagtggtatctcatgagttttttttctggaatttaacaacaaaaataccaaaactaatccagttccataccacgaatcttagaactgtttgaagtatgtagctttgtggtttttctagaagatactagactactaacatttttctagtttaattataatatgatgcattattatatattagtcatattattaataatcaacaaccattactgttagagggttttggcatagataaggatctgtgatattgaatatattttcatcaggattgattgaaaaagaaacatcttggagaatatgcatttatactatttttaagatactcacttttaagttttattatcttgcagtaatatcaccatgttttcattaaattgctgttatatatattttttcaattttactctctctattttgtgggctaaatttctatgaacctcacctctttttttttttttttttttttttgagacagagtttcaccctgttgcccagggtggagtgcagtggcacgatctcggctcactgcaacctccgcctcccaggttcaagcaattcttctgcctcagcctctctagtatctgggagtacaggtgcacacgaccatgcccaactaatttttgtgcttttagtgaagatggggtttcaccatgttggccaggctgttcttgaactcctgacctcaagtgacccacctgcctcggcctcccagagtgctgggatttgaatatcacttcttaatggtttctcttcccttagtttggatggtacagtagtcaccaattttctccatcctttcttagtttccttctctggttacacttattgcttctcttctatatttatgactggtttccaagattaatccttgtcttttcattctacatcaggggtatccaatcttttggctttcctgggtcacatcagaagaagaattgtcttggaccacatatgaaatacactaacactaatgatagctaatgagctaaaaaagtaataaacacaaaaatattctcataatgttttaagaaattttatgaatttgtgttgggccacattcaaagctgtcctcagccacatgtagcccacatgtggcccacttgtgggtcggataagcttgttctacgtcctgcaaagcaaatctgcacttatattttcatatatctatgttggtggctcaagtttacagcagtagtcctgcattcttacctgaatttcagttttgaggtccgtgcaatacatcttgaatttctcaaaatcatctcaagtataaaaccatacttcttatctttctttagaaactgattccatcttccagtttttccattttggtcaggtgcactgtttttctttcctttaaaatctgagttttggcatttgctttgacttcatcttctttttccttacaccttcagtcatgaatattaatgatacacacttggtggcttatggattcttgcctttcactttgttcctattgactgaaagtcctcagagaagtacccgatagattcccaaagcgcttgttttgggggtggggagaatcaatgaatcagttatctgctttccttgtttcccttctttttctatttcttcttattaaaaaatttgtttagagttttggaaaatggagatatcaaatgatagtactgatgctctttaaagaggacttggaattagaaaaacaggtgcagagtattaatcgtgaattgcttaacttctctgagcctataaagcagagatagtaatcctatacttacagcacagaattgtaagaattaaataagatgatctatgaaagtgctttgtaaacattaacgaatcgcttgggtgtaataactgattttattccaaagtctttgaaatgctgatgactagtatatttgaaatatctagaacataaaggccataaaattatagttatttatttctattttatgtttgataatgccagagttaaatttattaataaaaacagtccagattgccttggctttgttgttgttgtttgttgtagtagctcctaaccctcagatctttgcaaatcaaaaggttacagaagaatcagtagcccaagggaacaagagacataatagcaatataatttgtaagtttgctaaactcaaatagtaccaatttcatatgggaaatccctaattatcaatggacatccatcaagttaaatcgttagattgaaaataaaggtgaagtcacaggtatacttcacttatttattgatattggttcacataattagttgagcatccaccagggggaatacatgttaatgtaccatacccacaaaaagacacagaaaaattcacaggactatctgtgatacattttatatttacttcctatttatactgttgctgctaaaataggatcttactctgttcagagcacatggagtttcacaagatgtttaatgtagaattaggattgatgactcaatgtaacctttctaaatagtcatgcttagaaaattgacacacttcagcaataatgcactgcttgcatgaacactaagtttcatgtcttatgtttatatcaagcactgtatttaaactgcaggctctccctgttttaagaaggtttattactaaggaggtgaactatacatgcttcttactccttaatggtttccttgcagattcttttccttttgtttctttccaaatggttttatttaaaaatgtgaattttaaaaaaattctgagcataaatgcttttctaagagggggaagggagacaagtcttctcttgtgacaacaattattgtcctttttttatttattcatttttgggttaatttagtctggctaaaattacatacatattcatgtttcttaataagaacaaagctttactcttggttattttccataaatttgtcctcataagcaatttgatagacatctactttaactattagaatgaaagttcacagtgaatccatgaaacccggtttcagatctgtaattcattaactctttccccaaaggtccaaatgcttctttatcagattactataaaattgctattccttctttttaaagttcagagtgggcacatactgtaatcaaggtatagattgtctaaccattactaaatgcactagagatttttcagatgtaattccattttggtccaaattataagtttgaagcaacattacggattgtgaaacaagttataattgtgcaaaaatgattttcttgtctatttcatagacatactatggaatgtatgtctaaatttttacatgaaatatacagctattttacttccattgtcattttatcacagatatatataggatttataatgtctaatttgtattgaagtatcagtaatgtgatattatttattaaacacttactcataatacaggtatttgttgaacagcagatgttgaagtttcaaggaggataaaatgtcaccttaaatattatgttggtgctgataaaagaaagtgttgaaagcttaaaatttggccagatgtggtggctcactcctgtaatcccagcactttgggaggccgaggtgggcagatcatttgaggtcacgagtttgagaccagcctgaccaacatggtgaaaccccgtctctacaaaaaatacaaaaaaaattagccaggcatggtggtgggcgcctgtagtcccagccactctggagctgaggcaggtgaattgcttgaacctgggaggcagaggttgcagtaagccgagatggtgccactgcacctgggtgacagagtgagactccatctcaaaaaaaaaaaaaaaaaaagcccaaaagttacttaggttactagtttctttgtatgagaagaagttgacacagagtgctttatgatttcacttagtagttgtttaattactacatattatatttcggaaataattagcccattcctctaatggccaaaattaatgaaacttttaactttgcttttaatttaccttaagcttgatttaacagaaaacattaactattatttttacaaaatgtgcttctttcatctatgacgatgatttctttagaagcctttattttgaaatattgtagaagtaagttttattccagcgtcttaaaaaattatgctaaaatttgttttggtaaagaaactgagacccaggtaacttcagaaattgggcttatacaatactggagggtggaaaagttcatgaagatttgaatgtttaacttacagaatcattactctggttgtgaattatctgtttaaatttccattttattatatgaaaagtgggatattgtttttactaagacttttaaaaaataactatttattaattaatttatttattttgagacggagtatccctctgtcttccacactggagtgcagtggcacagtctcggctcactgcaagctccgcctcccgggttcacgccattctcctgtctcagcctcccgagtagctgagactacaggcacccacaaccacgcctggctaattttttgtatttttagtagagatggggtttcaccatgttagccaggatggtctccatctcctgacctcgtgatccgcccacctcggcctcccaaaatgctgggaaaagtaactttttaaatataaaatttagctatattttaatgtactttttattggaatcagttattaggatcaataaaatttatatgatttgattgggcctatttttctgtttatgttgccttattcaatagaatatgtcataatgattttttaaacttattcacaactgtccacaaacatctgttttgacattgtttaaaataagtagacttcctttgaagagtcatttttctcaaagatgttagatcagatttcttcccccattttttttttcagtgaatattttgggatttatttactcttttagtttttactttttgatttcaagagaaattttacaattatgtattctaaattcaaatctgttctccttgttctcttctaaataggcaaggtatgagtcaaacttagagactgcagcttaaatttagagaacacattggtgcaattccacatcaaagattttacatgaaaattaagaggatgttggcagtttactaaatgtgagttaatataagtctatagagctctgccatattctttatttttccatatttccctaaatgtatcctatccttgaaaaacaaaatccgtaatactcatcaaggaatcgtgaaaaatgtcaagcaatattttctgtaggtgatttttttttaacctttctactagacccctaccatcttaattagctttttaaacttttatcaatttcaggctgaacacgtattgatagatgaatgaactctcactttattagagccaataattaaaataattccagctatttttatttcattcttgttagcaatgaatttttattgaataactttggccctatggcatctgaaacgtttaatacttaccatcatttagcagacagctggtcttaaaactactctgttacacattgatattctccaatcatatcctcagcaataaaaaagtaaatcaaattagggaggaaaatatagggaattatagagctgagctctattttccccatctgtaacaccaggttactagtacctttcttattcgccttgattttataagtagcaagtaaagtacatgtagaagtaatatgaaaagttataaaggatcttaaatttcttattattgctgggaaattttttaaaatctggaataatttgagtagtggctatgcaaggaatgctcagaagagtttacagatgtattatgttttttcccatttataacttgtaagttttgggccgggcacagttactcacgcctgtaatcccagcactttgggaggccgaggtgggtggatcacgaggtcaggagatcgagaccatcctggccaacacggtgaaaccccgtctctgctaaaaatacaaaaaattagccaggtgaggtggcgggcgcctgtagtcccagctactcgggaggctgaggcaggagaatggcatgaacccggcgggcagagcctgcagtgagccgagatcacgccactgcactccagcctgggcaacagaacaagactccgtctcaaaaaaaaaaaaaattgtaagttttttaaaaaaatagaattaaaaaaacagagagcaccttggtttagaaaaaagataatttagtttagaaagatcttataagccctatatctatatacataattaaagtgtttggccaaagtggggaaggaaaggagaatgagaggaagaatggcttttctatgtattttcatgtcaaagcatatattaactcttggctatgctctctcctttatgacatggtgatatggtttggctgtgtccccatccagatctcatcttgaattcccatgtgttgtggaggcaaccagtgggaaccaatttaatcatggattcaagtctttcccatgatgttctcatgatagtgaataagtttcatgagatctgatggtttttaaaaagaggagttcccctgcacaagctctctctctctttgcctgctgccatccatgtaagatgtgacttgctcctccttgccttccaccatgattgtcaggcttttccagccacgtggaactgtaagtccaattaaacctcattcctttgtaaattgcccagtctcgggtatgtctttattatgacattaaagcatgttcctgggctgctttggtggcccagtttctgtgctttctttacctactgtatggtaacttgagttcaatttcacagtctttcatttattcagccagagggactctgaatgctaagaggccagccatgaagcccctgtagagggaggggatgcctcatgctgcccagcagcaaccttcttgactgatgagggcactgcaatgacaacttccaaggggattccaatctagtttcctcaatggcagcagagatgagaggctttgtagagtgagtttttgaaatacatacattgagagaagccagtacttctgtcagaggccttgctgaagtgatttggcattgacaggaattatggaataaccattgacttcagtaggtgtacacatatgactttcatctgttgctaacaagttcatatgtttactgtctctagctgcaatgatactaatattctggtggtctaggatatattgctggccatccagtatgtgtcatgtcctgtttaaagattcattttttcaccctatgtaatgtgctatttggcatatgggcagttcttcataatatgcctgcatagtcttgaaagttgatagaaaaatgatttttactgccttctttcaaatttacagttttttttttcttcaaacactcaagactctttttaatttccttcccttccccctttctcatgaagtctttcctggccattctcccattctcccaccactttaggttttctattctagcagtttcttccgctcctttgtactctaggattgacaaaccctaagaaagcactattaaaaccgaattcctcctagactgttccaaaaagcatttaggatccttttcatcttttgccacttcaaagaccttctctttcatacaatgcaagaaattagagaaaaagtgtccaggccaacagaagaaaaattctttgtcagctagttatcagtgatgatgaacttggtgtaatctgaatgaaaatggagctcaccacttgtgctttaagaattgaccacttagaccagcctggccaacatggtgaaaccccatctctactaaaaatacaaaaattagccaggcatagtggcacattcctgtaataacagctacctgggaagctgaggcaagagaatcgctggaacctgggagcagaggctgcagtgagctgagatcacgccactgcattccagcctgggtgacagagcaagactctgtctcaaaaaaaaagaaaagaattgacttgcagtttccaacagatttcacttggcaaaaagacattccttcagagcatgaaaacatttagtaaacacaatggatgaatttaaagaccctttgttgccacctgctataactaccagtggagaccagagcttagcaagaaattctttaggaggggtttttggaccaaaacaggtcagctttcttaattaacaggtgctaggtctggatgtgtgggtgattaaatttttactcttgtttgaaatgttttctaatgaaaacacatgtattttatacattattattatacttaaagccctacaaaatcacattttaaaatcaggatttcaagatgtagcctatagaacaacttaaatagttaggtaatttaatctatgcagatataatggagggcctaaataaataaaagagtaagttctaaatagtgaccaacttataatgtaaccagccaattgtcaaacttgacttctatcaagaaatttctaacatttagcccctgtgtaactttggtatagacaccaaagactagaaacgggtggcctgagggccacacaattagcaaacatttttgggaaacacttaaacatcggatgattttatagaaagatctggattgctgccttcttttcggagtggaaactctgataacactgaactcacattcaagattgcccaccccactcccacaaggcaataaatatctaactggcactgagcagtggctgtgtcctttgggggtaaatgctcttgggttcaccacagttcatgcccattgtttttgttttctctctctctctctctctctctttatttaaacacatagtccctttcattcactcactttgtgtaggtagtccctgtagttgtctgaatttgtgacttgatgtaaatgctaatgtaaactcatagaacatgggttcttttgggagggaaacttgtgcaaatgaataattctcacagaatcgtgtggctgggccaaatcattatcagaaaaataaagaaatttgataatgtcttactggtttaggattgtgtctgtgtttttatgtttatctctatgtatgtacccctgtgtgtggatatatgtacaagtatgcatgtatatacatatatacagaggtatacatatatatctatacataatgtgatttctgccaaaagggtgactgtagatgttgagatgaaacattaattttcaccattgtggcatacttaatgaaatctggtcatctttagccaaatgccttttgatttttaagacattagatggaattcagctaaataacagaacagtcattatctattctttggttgctttcaaaatatgttatttagtcatatcctcctcagctcactttttgtctatatgttgtaaatttctacaaatctgaagctgtatatgatttcccatacttcagtttccatagtgatgtgcaacagacattgatcttttcctaatgcaataataagctagaagcatttttcaaacatgggcactttatttgctttattatcatcaagaacaaaaggaaatgcatttggccaaggtcagcgtgaggggaacgctaaaacctgtgccagaaaggcttctgctcttctgtttcattaatgctatccatttggctccagtcttccctgatttaagatatgaagtatgttgatgtttccaactgccagggcagttgtcggactctgaatctgtgggtcaattccatctttttaagtacaccatttcattcatagacttttagaactggaagagagcttaacatgtgatcaaactcattcatctgcttccaggcaggagagcaataaaaatgtctcaggaagggaatggttttcctcatttgtcaaatttcccaagtatagcaatctatgatctttcttgttcaatattcagtatctaaatataattctctcattagtcagttcttcttaatatctaactgaggttttcacagcatatcaaatgctgttttatgttatctatgatgaatagttaaaaaataaaactgagtctacctttcagccaactccttttttttcttcaatgcttcatgatatgttgttatcttcaagttttctatacttttcttaatttactgtacactggtgcattaagaaaacacgccaaacaagaattactgaaaaaaattgacaagaggttcatatttgtctgtgtacattccagttttagaattaccaaaagaaaaacaaaaatcatcatagtgcatggctgtaaagcatgttgtacatttatttattcacttactcagtatttttgagtacctactgtgtagcaggcatgtgatacatactgcatggctaatgatgatgtatagacactttacaacatacaccaaaatcatttgattatgttttgatccttcaaagctttttcaattagtatgtcattttcactatgcactccactctcaaatttttatggaattaagctgaatatatgtaacaaatgaaataccttgacgtttgcagttaggccggtctatattccaaaaacatagagggagacaattgacagaaaagactaagaaatttaagtttggaaaatgcaaggaaattttcatggggaattctgcctccttctacatgagggagtgacatttgaagtctccattctcaacatctagccttcagctgccttgtgaatgggaaaatgtgtttgtttttttcttggcacacactagaatttagagatgcatccttgcattgaggatcatgttgactagactggcaattgcccatcctacaacccctcatataataacaatacacagggaagtctgtcaggaaattcatgacttgttacaaatacaaacttttttcagccaagactcagtatgtttggtgtctggatatatcattggtgttttctatattttcacacgtttcactcagtctgagaacaaaaatacaggctatggacttcaccctacttcacatgtacaatacttcacatgtacagtttcctcactggccctcagagtatatactttcccaactgttaatttctttgacaaaaaattttggtatgtttagatggacatgtaactatgaatacacatacgtataactctcctccaaacctttaacatgatatatcaatttaatgtgaatctggagtggatccatattaagacctagttgctcagagtagcaaaataaaaataacattgaatatttagcttgtaatccagatgtccaaatataatgccttttgtatgcatattgtgtgcatcaaagcaaacagaatttatagtcatcttactgaaaccagatagaattgagattctgaaaacatacaagagatcaaaagatgctagatggaaataaattgaacaggaaacattgcttatttagtgtgtctgtaatctatagtattttcatatttgtgttcattttaatgaatatacatcatttatatatacacatagatttcttattttcaccagtattcataattctcttacctcagtttctcccatgagaccttacattcctcaagagttgaattgttaactctaggagagaaaaactgtgtattaattggcttgaaaatgtgccctcagggggctacaggcaactgtggatagctcaggtctcaaggcagctgagaatgtgctctgaatcttttgtgcttttcttttcaatttctgaatttctacagaacttatatttttctctcgtaatctctgctgttttttctttgctaactttcctcatgaatatttaagaacaccattggtagatgaatggggttcagtaatggtatatagagttggttgagaaggggatggaaaccactgtattctcttgatttcatatcagactctgaatcaacccattttagagtatccttctaattgctttttcgtgttccttcattacttcttgtttattctactaagacttacaattgagtcattagactccactttatttctctctattggataaacagagagactgtggcttgcaaccaagcaacctgaagaccagcttgcttagttttatatttagttattttttatggggtttgaagtttgaataaataatatttggggcttcttttacacagagcattcctatgggggtgctatgcactgttattattactatgactgtgtagatttattgctaccaatgttacaagaaataagaagtgtcgcagtgtaacaagacatctctcgcttgtattgtatttacatttaatctctattgaactattcttttcctaagaggaaacattttttcctaaagaggtataattctctttacacatgacctgggaacatataccatattcgttatactagatttactttattttgaatttcaactttgccaagttataatgatcaccagagaaatattatcaaacatcatgcctctctttggtatctaataattgacacactcaggatttctgctccagtctggtaatacattttattgtcttcagtgaattgctaacacattggctcagagataaagttttcccctattagaatttccataagttcctctttgagcttcataggctcttccaaggttgcccgtatgatctagattcacatatgctgaaaccaaatgccctccaggctcatatggcacctttctctgccatctatttcctttttttttaaaaaaatctatattttaaatccatgtctgcttttttgatcattagactctactatattccactatattcatttccatcaaatgaaccaaagtgactgtgggctctcaacccagcaacttgtaaacctgcttggttgatttcatatttaattcattttacagggcattgaattttgcataaataatatttgtgcttctgtttatacagagcatccccatggggtgctgtgcactgttataactattattattgggttaaacttattgctgccagtgtcacatttaattgtgaattagtagaatcacttctgatgttgatgtacaaccccatttcatgtctttacccatgaattcataactttattcatatgagaaagcaattttgaaaaggataaagagaatattcacccatcttaaatagtaacaagataaaatatagtttagatatgtatgaaccatagtagtatcttttttcaatagtttaggaaatttttagcaggcaaaaagaaggaagggaagattttccttttttctttaaagacaatccctatgttcagcaaatgcaggccaagcatcttctcattctcgttctctctctctctctctctccctctgacatcaagcaaagtaagaaatagtgccttttgaataggagatttcctttaattacattggggaagtgataatggtaggtattgcatgtttaatgtaatgttctggatgccccttttctttctttctttttttcccccttcacagccacctcctcttgagcagaaataaaaggttcgaggcttgtcagcatcagtttatagatagctgtttaaaaataatgagatattgggtattgtaaggctcagggctgtcttgccagactcatttatttccattcacctttgtcagaattgcagacagaagacattcaattaaaacttgtcacctgttgcagatgacataatttgtacttgtatgtgtcatagattagggctccatgcttcagatgaagcaaccttacccctggtagagcaacatctctcctgttaaatattttgtttatggctattccgatttctgtcattgcaatctcagctccagtgcagattataaatttagcacatgatccccagaaccagctaagagcagtcaatcacattgtggaggggaaaaaaatagaagaagagacttctttggggttatgtcctatgcacagaaatccacaactgtattttggatgcaacttgaatccgaaacggagggaagcctttgtaatttcctatgcaagcctcacatgtttaatagtccagatagctatcaggagaccaaaacgaaagacttccccttgctaattgttaattcatctgtagagcaaggaagctttaatgtgagtcatggcttttatctcttttagtgactgaggactctgtttaaaaaaaaaaaaaagccctcctaatggatatgcattttctctccctgtgtgatttttctcttttatatcatcagaccttataatgtttccacatgcagccaagcagtttccaatgtttctgaattgttgtcatgatattccagcacaagtaaatgtaatcattggctgggggagtttagtggaaaatagactctgtgggactccctcctgaactgtaaaattcaactggaaggtggctctgcctccctggcccttgaaatacacaccttgtctaatctgcagtgaagaccaggagcagggaaattaatatccctcagtctctgcctcagtggaaaaaaagaggaatggaatctttttatcacttttggtttgttcacaatctcatagctgtgaacttttaaaggtgaaatcaccttataaagtgatagaggcaaaatcgcctagcccttttgagtaacagtgttcattattttttcctcctgctagttcatcattcttcctaccttttatatgtgccccatatcatgatgcaggtattgtttacctccataattggttttcatctgcctgtgtttctgcttttggaatatataccaaatgctctcttccaaaaatagactttgatggcagagaagcagtttaaacatagtgcttaagaacgtgagttctgcagccattctccccacttccactcctgtttctgcctcttactagttccggttttctcatctgtaaaatgggatgataatagcacctgcctcataggattgctataaggattaaatgtgttaatatgcattaagtcattaagccgttgcctagcacatgataagttctcaataaccaatgactgctagtcaccggccactattttgttttatcccaagatacttcatgcacaaattgattaattcatttaacaacaaagacattgcttggtagggagaggaggtaggtatgatgagttaaagactgttgaaataggaagaaagaggctaaataatgaaccatatttaacaatatcataatctattttgagaacaggcaatatagttagagaaaatatctactgtttggtttctttaattatcttatatgatcctcaagaatttaatatgcttagatcctccttggagtatacgtgtgaatatacaaataatgttcactactcctcttactgagaagcctgtaagtatgcacagctactctaggttaaactggtacactctctcaggatattgtcccgaaggagaaccccatcagaggctggcactaaaattgccactgctgtgtctgatactgctaatctgcctttgcttcttttcctgccgctcttctaaggggtgttttctctgtttatgatggttccctcatagaaatctcaggagaattcaagggtgctgttggatatttctctttcccaagggaaggagggaggtggctttaggcagcaaagtgaactactgtatcaggaaaacatatagtgcaggaaaaagttactgtcctctttaccttattgtttcagaagtcttgcctttccattctgctccctatactcaattgcaatctatgtttgataacatttatttaacacagcagtttgcttattgtagtgttcattaacgatcttttcaaaattattattactttaatgtgaatatttgcgtctttcttaactattccatgggtctagataaattaatgcttttcagcaagcttttatttgggaataacatattaaatgtgttatctttaaattgggaaagtaggctagagtatccttgtgtaattctctgaagggaagattttttattatcctatgaaatgcctctgactttgtgctattaaagatgtgaaaaatacttttgactttggactacagaatattataaaaatttgcatttgggcacaaaatgtagtctcaaaattagctgacctaagaagaccttgggctgaactattttacttctattggtgtttatttgcctcacagcattttttttactccttgccctactcttgctttctcaattttgtaaatcctgacaatgtataagatttgtaattcccttgtggcaatgtaggcaaatgcagtatatgaaagaagaagcaatgtgaaacattctggtaggtaggtaatgccagctattaaaatcttttatttagaagaaagataatggcagtctacacatgaatggaaaatctaattgccttaattaacttccaatcctgtcaaacattgaacactgtgggtcttttatttcctgggagaaatcttatttttaaacttcttcaaaagtggttttcaagtggagtccaaacagaaattgtttgtgtttaagattgaaaaggtatacagagacaggctttgccacctttagtagaaatatttggattatgttgttgtttgcttatgacaaatctggatttcccaggttctgatcataaatattattattgtttgtttctgctaaaatggttggtttgaatattttaaaggtattagtttaattagataattatgaattctctatttaactttgtgttgtgtacttacagctaaactcaggaaaatcatcttttttaaaaaatagaattttgatttgtttctgtatctcttctaaaataatcacaatctaaataatattattagtgatgggagggggcaggaaataaaacatgatactagatatttctataaatcactcaaacatcaaatagtattattatttggctgtcatcctttaagttattttaccgttcgatcatatctcaaatctgtttacctacagaattgatatgggatagattgtaacactctatgcagatagatgttcaataaatgatcttgacattttaagatttataaaatatttttaagtacattcgtataataaccataatgtaatgttattggatcattacagcaaaacatcatggaggatatactctttacatccatcttatatttggaaaagcaaataagttaagagactcatcaaagtttatagaaatagttatggaaagagccagacaaagaattgaaccattctgactagcaaactatgctttatttgctttgacatattctttgcataatatttaagataaaggatttaagataaagtattatgttattacagttgaaaaccttaataagggaaactttaatcttcacaaaatcatgattgcagacaatggcccaagctcatagggatttaatgattgattattagttatccttcattttgatgtatgcaaggctaaaaattttaggccagagcatataataaaattactataaattagtggtagttagaaacaattacataaaaataatcttatttggtaatttgtattatatttctctttatctgacctctcttcattttttgttcgatttgtatttatttttaactcaacatgttatttgcatttattactactaatgagaaatcatagcttaagtctatgtccagggaatggtgatagagatagaattttcattcaatgtttttgacttagaatattttaatcttcatagcgttactttttggttaaatacttctgtcctttgcaatgtaccttttatcactataaaatttgctttttagtaagaagaaatgtagtatcccaattatgcagagtttgttttccaatgacttttctagaagttatgagaggtgcttttcataatttgatatttgattttctgagatcctgcctcatttatgacatggtgctttaattgtattggtgtctttaatttttaaaatttttcttttctggaaaaaacattaaaaatagaattatgttgaaaatatacagatatcttcatgatatctatacagtattgttttatctgaccatttaaaataacattattgaatttaagtacatgtattattatgatttacatgaataaacctattttcaaagttgcacaaataaagaggctttgtccacatgtttgaatacatattttggactgttttaacttttggagctatgtcccttgtgtgtaggtttttatttgattgtcctggggggaaaaatctggttttactgggtggtgttttcccccagtgtaactaaataaattgatgattactttcagtatgatgtggaagtagttgcgtctgtcttttactaggattttggttcaaacatttcaccaagcatgaaatcaggtaaaccaaataataccaataataagatcatcatcctactagacaatgcatagaagacagatttttccagattttgaaaacgagttaaaagcagtataaatattttctacttgaattgaaaaagttggagttggaaatattagcctgcttttgacaggggatgaaaaatcacgagtatcagttcttatgatcctttaaaatatattggctctagaaatttttaccattaatcgctatctaaacttgatgagtataatattgcatgtggagtccctgtcaatttttactaataattatgtaatctgtttttatgagtatcaataactaatcatttttctactatcatataaataaaattacaaataaaagaatgcattatctaattagtctttattttaggaaataaagtgtaaaatcaggacttatgtgaaaggtttttcactggataggtgtatagctaggataaatgaatggatagatgggaaggatgaggtaaatgtacgagtgaatgcatagatagttattgatctacacacacacaggaagggatgtgggggacataagacagcacccccttagatttgtgacgcatggaataggtaatatgaatttttctatagtcaccttttgaaggtgaaagagaaatgcatagtaatggaatgtatttgataatactttttgtttgtttgttttatgtttgtttgtttgtttgttttttgagatggcgtttcactcttgttgcccaggctagagtgcaatggtgcgatcttggttcactgcaacctctgcctctcaggtttaagcgattctcctacctcagcctcctgagtacctgggattacaggtgcccacaactacacccaactaaattttatatttttagtagagatgggttctcgccatgttggccaggctggtctcgaactcctgacctcgggtgatccacccacctcagcctaataatccataatacataataaaaaccctgtcaattgatcatgcatattttttcttcatgatgtgtaatagctagctttcattgttgcacttcctctgtagacttagcccagttggctaaactacttgatggctttaaagtgatgtaactgtatgtctgaattgttttccaccaagatcttaaatcaagtcactcagctatggtctttttccgcagatcttcatgatggacaaaactccattgtcacaaactcactagctctgacttctgggttggagaatatgtagtgttttgttcaatatatgaggacatattgctaacagtgaatacattccttgacaagcatgaaaagcaagtttagggagtctacaaactcagtcaagatttattctgtcagctttcttggctctaacaattttagtgatgtccaaaaaatgttccctctctctttagcttttgcctgtcattgtttctctctctctgcctgccttctcttcacacttctaataatatcagattaaatgttctcattgggttggaattggatgacaaacgtgaggatataattagtgtcatatgcttttgattttctactaagatttttaattttcaaaattcttataatgaaagaggtttgaatgtatcttagatgaccagaaaaaatgtggtcaccttcaactggaaaactattctgaagaaaattttgaagagaaagagatgaaaaaaaataaatcatgatgaaagtggagagaagtagaaggcattaaactttattaaatatagatgcaataaaaacagaacattagaaattagataaacaaaggaatacatctgctgtaggcatggagtgctttaaaagcagcaataaagaaatataacttctttgtgaacaacatgcatggcaattttcagtgaatgcttaataaccttacctaacttttttgggttttgatatttgtttgtttaacctatttaacttttctcaaagttgtctcctgatgttatttacactatattctgatacttcaatatgacaattcaggcttcatctagaaccaagtatttgtgtgttctcctaaaagataatcaacgcttaaagtagtattgttaagataatatgaaaaattgttttcctaataatctttaacatttgagtaatatattcactgtaaatattcacatagaaatagatctgcttttcccaaatcgtttcatgtaactcagataacccacagctcacatattctgcgtgacattaatcggtattccaaaaaaactggagctctggttcaattggtttgcaaaacactgcatgtgctatgtagcttcctcttagagttttacagagcccgtcgcatattaatggctctgagggggcttaaatgaaatagtaatactgatgatgctgttaaaccaaatctatttcctaaacagtttgagacatgccaaaatatgtacaacgaattacatggttgaacttcttaatgaatacttttacattgttatatcaattaaagtacaacgtaatattgcaaaagagtgtctcctcacttctgctcccaagcagtcgtccttatatttggtagggacttatatggtcctgtgctaaactttacaattatagtctggaaactagattgacaagctcttccctatcacttcctgatattaatgaaattttcctatatttgtaatcccattcattcccttggctttttccttaatcttttaaatccgctgccagaaaatcccctttgaatcttgacccaacccatcactatttgggaaaaagttctattcctgtcagtctacttttgcccactttccagcttcaccctttagccctctttaacattcacttccttcgacatccaagcatttggaattctttgggaagctcttcttttccttccttctttccttccttccttctttccttcctccctcctttcctttcctttcctttcctttcctttcctttcctttcctttcctttcctttcctttcctttcctttcctttcccttcccttcccttcccttcccttcccttccctcctcttccactcttctttccttctttccttccttccttccttccttcttccttccttccttccttccttccttcctttctctctgtctttctctctttctttctttcacagagtttcactcttgttgcccaggctggagtgcaatggcatagtctcagttcactgcaacctccgcctcccgggttcaagcgattctcctgcctcagactcccgagtagctgggattacaggcatgcaccaccacgcctggctaattttgtatttttagtagagacagggtttcttcatgttggttggtctggtctcaaactcccaacctcaggtgatctgcccgccttggcctcccaaagtgctggtattatacaggcgtgagccactgcgcccggctaggaagctcccctttctatcctgtgttcagcccaaacctgctctcagttttctcacatatgagaggaaatacaaatttgtgccaaaatgtaaataacattccccttgagacattgacattttgatagagaacaattcttgcgtctctcaggactgaatctgtgtagtgtaattctggcctccctcctccccagcacataggtgctctttattcagctcaattccacaggtccatcctgaggcctctggcagactggagggaagttggatagctcttggtctactcagtcctacacattgagctttcagggctgactgatgaaaaggatgctaaatgccagggtctttaatttaagaaactatactagcaccaaatagcggcttctttgtattaatctacatggaaatctgccttttctttgatgtgcaaatagtgaccctgatggctttgcatgaaatgtctttcggatctgtcatctgctgacagatttggttttcaacctctggcaagtttgatttagccaccacttatttacattatttgagtacccctggtccattctgcattctactgtttgtcacctatgtgctcttgggggataccatctaggtatttgattggtctcaaacatagctaccttaatagtaagccggtgcctgtctttgctcacaggggtgcgtcttgacagagtacgtggaggtcggcagaagtacaagcgcaggatagatgcggagaacagcccatacctgaaccctcagctggttcagccagccaaaaagccatgtaagtacagcagatgtgtctggcttcccagaacacgaaatcctcccagttggctctatgtacatcagctttggcatgcccatccctactgactccaaggagacttctctttgttggagaacagtggctctattcccaaagattgtctgtgaggagcgacagcaactcagcttattatctcattttttcttttagagatatctgtggttttctctctccagcctttttttaacctagtcattttgtggaagcataagcatattaatacatagcttatatagtgtgaattttacatttactggttatctttatttgcagaggtacataaaatggatcatactgtgatcattagttcattggagctcttagtttcagatttcacaagaaagtgatttttgtagttttcactaactaaatgaatttgactgctcaacctcccaatgaaaatacattaggggcctcattaatttggagctatagaagtttaacacactagctagcaatagattaaaacaagaatgggcactactaataacaagcataggtggctggttccatctgagatgcccttatggacggtatgaattgtttttaaagagctcatggttttatggagccaagttgcaatttgaaaggatgactggtacattgctaaaatgcaagccccattctttttgtcattaacgaaaaagagttggaatatagattgaggcaatcactgtatcctattttctgaaaatcagttaatagttgtagtgcaacagaactagcgttttaggatgtttatgaatagggatcctactgggcatggaggagcgctttggtgaaaacggttttccaatttagctgtctttttctaagaagacacaaccagcactcatcagaggaaaatgcatctgtagcagttctaggaaagacatgggtaatttttgatctgccttcaggggaagagaagatgtccacttctaattcagattctccaggaggggtcactgctgtgcatcatacatatgtgagcatatggaaatctgttaaataaataaaacagaccctgaactgtaaatgaaaggacattttagctatgtcaaaggaaaaacaaccagttttacataaaattaaagcttaagtgaacatatggcatagtttccttttgcctttccaaaaaacattatgttgattataccttcaattgtccaatctggcatcttctcctcagcctgcataagctgtttggcattctgcaaatacaatcgaggactgcattaaacagattttgcacattataataaaaaacctctctgataatacaataatatgcaataaacactaatgcttaatttcattagaggtttagtttttctgaattcactaatatacagactgcccatttctcatttattttatgcaaacattgactgaaaccattgataatttcctctactgaaagaaaaatgagcaccagcccatgtgtaagttgaaatgatagaggagcatctatggttttcttcgtaaacctgagaaattgggaagtggcttgtcaagtacctttaagaagattacagcaatttcagtgagctccatttgtctcagataaagaggactcctaataaatcattactcattatctaaaggcctctgtgttaattttctttagtccatccaattagtgtgtttttgtaacaaacatttataaaacttaattttcagatcctgtcagataagtgtcaagagactgtgcctgagctttgctgagaaagtggctggggaggtttctggaccctgactgattgtgtactacaaagaaccaagaatgaaaattgggttctattgattctaattagggaaacattaaataagatttacctagaaacagtgctgccggctattccattttctgaatgatgggaatttctaagcttcaaccaaatttctctgacctctcgtgtcaagtatccattgacttggataaagccagtgctatgttccctgtactaaaaaaaaaaacaactagaatcatgattactttcggatatatttttatgctctttactattggattttcttctaatcctgagaatctaatggttgctgacaggttttgttgcattgtcagagcaatgaaagttgaaacttttccaagcataactaaaagtatggggtgttgtttctgtagcatataagaaaaatccaaattaaatattaaaaaattaatctctatttaatttttaattcttttctagtcaacgtagtatttgggaatatttcctcccaaatctgcctactcaatttgatgatgatagaatattatctgttgtgtatttgaaataattataattaatatgggagccatattcataaatgtttaaatgttatgttagaaaaagtgctaattatagcttggacaagccacattctttcataaaaggagataaaatgaatgctatatttaactctaagttatgtgaagtgtttttatattgggttaaaaaagttaaaaacttagagcgagaggcaaagagtctgataaacacattgggaactttggctgtgttcacaagaacctcatttaaagtcctggttttctacagtaatagtacatagaacatttaaatatgtgggtttattctcacccgtttgtatctcctcacttagaagaaagcataaaatcttaagctacatatagaaattgaaaatagggccaacaagaaaaatcattctgttaccaagactttacagccccttccataaaccctcacatgcccctgagcaataaaacacatttgatgtgatgctttccatttgtctctagtgtttattttttgaaggatttttaaaacatatatcacaaatttcagacagataaatctgaaccagagaatgaactaaggacaactgatgaaaatagaggattaaagaatttgacacacagaagagaaaatgactgtaacatttaaggaggagtatttttatggaaacatattagctgtatttggaagactggctgggtgtgtggggagggggagaaaaaaataaattcctatttaatgcatcccacggagatagagttatatagtcagtaattcaccaaggcagaagggctctgacctttgctcttctttaaaggaattaagacaattaatgactttcatgcccattatgactataggcattagtagttctttgcctcctgtgttatgatctatatttcaatagtttactgggggttttattttaagctattttataccatttaatctacttcaccaaatcccacttaagaatcaaagcacaaacccagaaagcatctaacttctcttatctgtttgctataaaaattttcactacaggacagacgcttcattccagcaaaagcaggtagagcaaagaagaaaaaaaaagactacattctatcacgactgcagtggcatatgtcttgctatgagttttcctgcacaccgtttaatatatacctattgagccataattggaatatttagcgtttattgtaggatatttggattgtttttcaaaacacaaaatgctctagggtttataaaagagggatgatactactagtgatcttgtagtgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggtacattttctgaaaagaaaaagaaaagaaaaggttgcaattaattccctaggttatgtatatagatttgggtgaattcaaatttttctcatttagacttaaaaaaaccctttacatttatttttaatcataatttagagttttgcatatcctaatagaatccttagactttatattatttatattggtaccaccttgagttcttgttagtttttcatatgtacaggtactactgccagtgtaagctaacgagaatataaatttaaaacatttctttatcctttgtcaaaattcttacctttttcctagcaaatacttctactttttcttttcactttaaaaaatgtttttgtcagcggtagcctaatgtactattttcccaactaagaatcactagttttgttcatagtggctagttatatcctattgctggtcatattcacaagctttgctttggcttacaatcagatatttatctttacagataaattgtgaaaataaatattaaatggacatggtaacttttcctatatggtaatttaaagttagcatttaaaaatatttctcttctttttttcttgacccatcctgtaatatgaacaaatatgtacatgcttgtaagttttgagaattttagtattctacttgaattattttttatttgtttggagttgaattttcagatagtttataaacaagtttttgaatgatgagcaatgtttttctggtacagttaacttatttctgtctccttaaactagtttgtctttatgctttgaatgctacagtaatttctttaatcaaattgatggaagtccctttcccagcccacactgaaaccaatttattggtcatgatacgccagctatgttgctaacagtcgtaacgaactgtcaggcgatatcgcagtgaagctaatttgaagtcattaggtgtgcagcgttcaggcgacaatttgttacagtggttaggaacacagctgacatttctgaatggctttgttcgttgtagttctagatgaggccaagcaaattgtaaactaatttaaacatcactctgtattataccagctactttgtcttacactgtttgctaataaagccccccaaattaagtcaaaactagttaaataggtgagcttgtatattctttagaagacacctacacaaggattactacatataaaagaagaataagaatttgattgtgtggatatttgatattgcagttggattgtaatcacatctgtatgacttttagaaaaataaaaagaaaggatttactgcaagatgtaagacaattgttgattaatgcagtgggaacagccagaatttacttcaacagtgtatgaaaacttatttgtaaggaaagcactattgaagggtttagagatgaaagaaacaagactcacatttgttgaagggtccatagacacttttttaggtgattgatatatatcatttatattaatatatcattatgatatatgtatacacacattttaaatatcatcattttcacccaggatttctcagccttggcattattgatatttgggacgagataattgtcatgaggggctgcccttgttcattgtaggaggtttagcggcacccatggcctctacccactagatgccagtagcacccctgaattgtgagaaacaaaactgtcttcaaacagcctcaaatgtcctccaggagataaaatcgccccagcctgaccctcttcccccaaactgaaaaccactgttctaacccaggaatcaggtattattattctcaattcaaagataaggagatttgaggtagagagaggtaaaaaacacttgcacaaattcacagccatatccagtaccttcagagtggcttcctggagtagaatcaagatattttagtctccagtttattgcatttaaaaaacctatttcaaaatgataatgatgataatattgttattaacaacagcgtgaaaagctgtgtcactatggttccaaaccacccattatttcggagagttctgctcaagttgtccctgaaataaaagatttgtaaggccaatattttgatatcatacagataaagcataataaaaaccaataaaagtcaacaatttcttttgaactttctagtaaggaaagtgagtgataaatatgtaggtccgactgtgcatccaagtagaaatgtcagcttacaaagggacttgtcacagtaaaggggctctagtgacttttgtaaagatagcaactttaaataactatgagtaacaccatttccagtggtggaaacaattactatacgattatgggttcagtcttaagctgaggcttagaattggtggggactgacgttattctctctctatagcaaatgtcagaagagttcactgtggagtagtgattcacagctctgattttcgtgatacctgagggtgttgtaaatgattgcaaggaatatcttggcttttcagaaagggattagcaaaacaagagttaacagaaatttaaaaaaaaaatttaataatacctatgccatacagtgcttgaggtagaaggagagggtgttctgatatcaaagtgtgctgccttaccctgggttcaggaggttggtcagtagaggaccacactacagctatatggactgagagacagggaagtaaaggctggagaaagtaaagataaaagtcacatttctgcctcgataaaagtgaaattgtgttcttgataacatgaaccaatcctgataactggggtcatagccggaattaaagccaaatcagaactgaaatttcacctgtcttggtcttaactttaaaactctttgtttttgtaaagcttatgttaaagtgaagtcattttttaatacactaaaattcaagcccctgttatctttatgctgttctcggtttgtataattacacccatacacgtacatatatgtttttaaaattaagtttagcatcgaaaatgagtagtttttctgtgctgcttcgaatgtacttttgcacactttctttataagaaagtgaaggatacaacaaaagaagctattgaagaaaatacatatggaataggttttttttatcagtaaatagaattagttgacttacattaataaatcatataaatgggaaagtgtgttgttatgaaacatgaccatactttatctctagaagaaaaaaagatcacaagggctttagaaaatgcttgactttagttggaggagcataagggcacaagaacagatgatggtgccctaatagccctttttaagaatgacagggcccagccattagcatccttttatatccttggaaattgctcatgcctcgcttttctggttcctatctgcctgactcttttttatttctctttcaatttcgtccgcgctcggataagcgcatgctaacacaatatgattgagctgtaaaatggaacgctgtcgcctctaatctcttttatgtagatacggaggtactgcacactccacttcactccctctccattgttggccttttttcgaatgggttgccaagtaatggaggctctgtcaaatattagagctaggtttcacagggtgtgataagacgattatcagcccaacagtcagatctattattgttctttttggttgattaaaatattattatgtactgtaactttgttagcaaaatgcagaatgtgcttagtcagatggtgctttaaaaagcataacccatattagctgacctatataaatggcttaaacatatttatggatcttgccagacaacttggtttaaaataacagaatggtattttaacaattaaatgaatgaatgcattttagaaaaaattgtctttgtttattaatatggcaaatcttcaggtctgcttgtttatttttaacgtgacaaattaaataattacccattgaagaaggaggactttgctcaagtttggggggcctcagttacatttttcaattgatctctattgtaatgatatcaaatagaaaaaaattcctataatttttcttcctatcaactggaggcaggagttattaaactctaaaagaaaactacataaggaagatgatgtaataaatagtctttaagtatatgtattcacataagaaacagaaatctaagccacataaaccaatatttactatttgccctgaaacattttttaaataaaaacattcagttaggagaacatatcaaaaattgctcattgacttagctttttatagttttctcagaagtatttagacttttctagcaatgaaaggaatctataaagaacatggataaactgtttctacatttagggtataaactttggaaaagaatagccaagcatgtgtaaatatttattgctaaagatactgcttgaagatatatttattgttctaataaattttacagagtcaaatttttaagattatatcatccaccaagcaaaattatggaggtttcatttttaaaatactcattactgggtactggtggataaaatacccatcttaaaatagtagcaccattaagtgattaggatacgtgcaaaagcacaataaaatgtggcaaaaataatttaatgttatgtttccgtttataatgtaaactatgtttctatgtatatatgtgtgtgattaaggtttgatgtacaggacacaggacatggttgactaagggtgagttataccatatgttagtcataccttatattctgttttgggtctgtatcattggcacttgaaaaatgtttattgatttgttgactaaaaatgtgcatagcacaaaactcttaactggctccaagtttccaccctctgctgcatcccataactcaatttacgtggacttataatatttctactttgctatgaatgaattaaaacacttgtagcctcttttttcaggattaacttttcttttgtgtatgtaacctaatgattttagaactgtgaagtagttaagtcttttagttaagtggaagaaagttaaatataagacccaaaaccttggcacttaataagactgtttaaattatgagaatattcaattatggaatgggtgcggtggatcacgccagtaattgcaacactttgggaggccgaggcaggtggatcacctgaggtcaagagttcaagatcaggctggccaacatggcaaaaccccgtctctactaaaagtataaaaattatctggatgtggtggtgtgtgcctgtaatcccagttactcaggaggctgaggcaggagaatcacttgaacccaggaggcggaggttgcagtgagcccggatcacgtcactgcactccagcctgggtaacaagaggaagactccatcgcaaaaaaaacaaaaaaacaaaaaacaaaaaacaaaaaacagaatacaattatgaaatatttaaaggttatttttaatgtacctggtagttatatacctgtatacctgtagttgtgattaataagggtcgaatgattctgaaagtaaaatcagaaaacttgagctgtcattgagtaatgttttgtaagttacttaattactctcactatcagttaaaatagaaatcaaatgaggaaaaaaaatacatgcaaattatttatatgtataaataattttcaaattataaagcatgatctaaatgtacagcattcagtgttcatttttattttcaaggtactgccatagattgtcattacaattaaaaccaagtgatctaaaaagttcatattcataaaagcaatttataaaaattcagaacaaacatcaattttaatagagaggggagaaaagcttatttaaccaagagaatcattgtgtagatactgtcataattttattctacatgggcaggaccattggcgtctaaacgatttagtccagcctctttggttaagcctaaaacaactgaaaatttaccagtttaatagtttctgaagtcacaactatggcatcgaaataggaaccagtaagttgagaaataagttttgaaaaaaataatctgaaatattacttagggactctattttctgcagctacccttgctggaaacaaaaaagtagaccaacagagaagtagctaggtttcctaggcagagatctagttcaagagacaagccaaagttgtgaaaaatgctcagagaggcctgtcctcaccactcatgccattgtttttgacctaatatacaattctgtcatcatactaaatatcctgtgctcatgtgtctccgttccagcattgcttttgcttgttcccaggactccccaaaatatatttgccatccatacataacccagctcttatatacctgtgatcaaagtgaaataatcatttcatagtaatcactgaatgcaatttaagtatttgagtgtctcctgtatatttaacactacactttgtactatgggaaatttaaaagatgtgcatgacatgacatctaccctgaatgatggatctatgtctgcataaatacatatacatgtgtgtgcatacatttgtgataatctatttggtttacaactttattagttccagaatttattcagctttattttttttcatgggattaagctttaaatataaaactaactaacatctccatagttatttattgtttacaaaagacccttataaacttttatgtgatgtccacaacaattctgtaggtaagtttcaatcttattagtcccactttatagatgagtaaacctgagattcaggaaccttgacacacaccgttgacaatgatacttagacacatagtatatttaacttaatgtgtttttttgttttggtttggtttggtttggttttttaacagtggcttccttatatctttcttttcattccttgtctgcttttctgttgttcattgtcatttgttccagattacctacttctgttttataacaagttaaggcaaatgtaacatatttgccctatcaataaatcttatctatacattaaaaaatgaaagattaaagggaaggagagtgaatttaaaaaggaaatgtatgtcctataaatcaataaaaatcaagatgtttggacaagagtgtattttaaacattcctgattacaagttttactgaaacaagtcaatcactagctgctcatgtgaagagctggcgaagtccttaaatgattggttgctaagactggatgctccctgtctctgactctcttcagatcactgggcaattaatctgattgaaagttataggtaaattggagcagaagtgagtagttgtgcaagacttgaccatataaaaaatgttagctctaccacttaacagtttcttcttagtttcctcctctctccttcttgccttcctttccttccttccatgcataagcatttaatgagctctatgtcagaccctgtgcgctaatgatacacacatgaatacagcacaaattctgcttttaacatcttcactgtgtggtgggtgattcagggaggtgatttgacaactataactgaattatgagggctatgatagtcctctcctacagagtcacatggagacttagaaggaggagcatgggaagaagatgtgacttgaggctggaaagatctgcaaggaccccatcatgaaaaaccttgaattttatgctaaggaaaacaaattttattctgaaggcagtgaagtgctattgaaagttttagctgaagatgacctgagttgaactgcattttgaaaagattaaaattggaacttttgaattattttacacacagaaagatttcccaatacttttgaaaacaattcctgagtgctgaggatttctacatgtactatgtcctaaaatatgttatcattttaaggcaagttcatggtaattgctaagctcttttgaacgataaagtgacaggatgagctcagtcattcagttcaccacatattataatcttttagaagcctgaaatttcctgaaacttacctgaggattatcaaaacatcaatatcctatagacctggcccaggtcatatattttttttttctggcactcttcttttttgttaatggagctgttacctctgactttttagttattcttaagctacttgataagttaaagagagaaagcctcgtggttttgtgagaaaattgttatataaaagctggcataattagtataattcatatatgcttaaatgcttgattaaaaaagctttttccacctctaaaagaaaagttgggggaggagtgcagaacatgatgcatagaatgttttgttttcccctttgctcctttttgaccctctctccaaccctaatcccacttcccttcagtgggctggtcgcactttttcccctgcgtccccctttatctgcctcagccaatctccaaatgaatgcgtgtctatcctggccttggctttgacactctggatatattgattaatagttgccctaagctccttttagcaaatcaaattttcacttttagcaaggatttcgcctctgatttattcagcaaagtgaaatgcactaaattgactttgacattcagggaaaatggctgaaaaacaaagagcagaggaaagagatataaattgtgtggcagctggagacatcaggcatccgagaaacagttttctatagaatacagtcatttaaaagcactttttaaacaggcagagaagtgatttcttaaaattgttttaactattcaggttttttttttttttaaagagggcacctgtattactcagctgaacttagaatttctgatatgataacacacactatattttgtgcatataatagctgggtaatccagctttgtacctatcaaaattagttcgtgaaaactggaaaataacctaattattttggaaaagaaatattcaagtcattttaaacacaaaatagaattgttaccttgaaagtgctagtgatttatagtaaagtgtgtatgtgttttaaaggatagggctttttccactagaaggagaatttgaaataattttggatcacaaacctcagtagagaaaagccatgtacctttgctcatctgtatgctttttttcccccaagaatgtcagccttggctgtgttcttttatgtgactgagtcagcctacctccttgttagaccaaggttcagtgaataagtaaccaccaggttcaagaaacaaagtgtggttttgatgtgtgaaaggcaatggtgctggtgtggatgaagaaaagagaaagggagttgaactgaactcaatatggacacttggggaggaattaaaggtgtgaggaatatcagggaatatttttgatattgagatctaatagactgttgcatcacctctgttgagggattatcagggcagtgaaaggagaagaggaaggcaaacgctacagcaaattcctttgctgttcatttccctctttcttgttgatgatgaattttccttattaatcacagtaagggtccacatagatgtagtcgaagcactattctccctttaactacacatttttattattctcttttctttaattttcaacaaatctaacaggaaagttgtactaactgacagcaaaagtgaccccaactatccatattaatggcattttacaaattagtttttttaagagatggggttttgctctgtcactcaggctggaatgcagtggcatgatcatagctcagtgcaacctggaactactgggctctagcagtcctccatcctcagcctcctaagtagctgagattacaagcataagccactgcactcagctcaaatgagtttttctttggtttgtttttttttttgagacagagtcactcttgtcgcccaggctggagtgcagtggcatgatcttggctcattgcaacctccacctcctgggttcaaaggattctcctgcctcagcctgcagagtagctgggattacaggtgcatgccaccaagtccggctaatttttgtatgtttagtagaggaggagtttcaccatgttggccaggctggtctcaaactcctgacttcagatgatccacccaccccagccttccaaagtgctgggattacaggctgagctactgcgctcagcctcaaatgatgtatcttaacaccgtaccaagtgtgtccacagcactagactcttacagaaatattatttcactaaaatcctgctgcttcctccccaattcagccatcataaataacctcaattagaagatttcaagtagaagaaccaatttaacctgccaaaatcactcattggcaacagtctaagcaggctgtgttgtatgctaaatggtcataacgcccccattgtttatacatactttgctatgactcttaagaagaaaactttttttctcttagaaaaaaacacacttttaaaatttttgatttctggagtagtccacaatttttatattaatttttgccaggttatttttttttcctatagcgagtgtcaggaatgatatacaaggtatgtaaactcaaagtagggattttgttttagctttttatgtacacttggatctcttatggtgcagtaaaatattattttcatatgaatttaaatgtactagtgcattgtattttggaaaggagagaaatataatgaataaaccccatccatgataattctgagagcaatagtcaattcaacttaatctgaaactctgctagtctccagtaatcacataactttgcttccaatgaggaaattatattttcattgccagaatgggcattattctggcaaccacaaattgttaatattagaaagtccagaaggggaaaagaccaatttcttcaactggatttcacttaagcaagttgaaaactgaatgtccaggtcagcaacacacctacccagtttcagagaatcatctgagcccaattaaataccataacactaggggtgtctccaaagagcagccacctcctctctgtatgagggaggcttcacacctgcttaacctacattaggaaaggattaattacctgaagtgctgggcctcctccaccagtcagcacgtttgtgccagggcacatggtggcctgggctgcagagggagagagggagaaggagcagctgtgagttcctggagaaactaactcttcctgacatggtcagcattttaggaaaaaaaaaaaataagtcaagctgctcttattcttgtgatttgtctgtgtcatggcaaaacccagtggcagggtgtcctcagcacagatttgcatacctaaaagaggaatgcactctcagaggttcaacacaatgtttcttaaattcatcttttgcggaaaaacatggaataattacttcagatttttcagctttgtttctgtgaattgctgttattctaaaagagagagctttataataaatgttcccaaactttcaaaatatgattgtttatttaaaagcatgtctagaggaagctttgtaacacccctttctaatatatggaataatatcaaagctagatccctttccccaaaaagtcgattctgggatgatagagctggaatggcctttggagataatttgctagacctttgtattttaaggggaggcaccatattgtagtcagcaacgtactgtctttgtagttagagaccctcattcaaatcttggtattgccacatcccatgaactcagtatgcccatatataagttggggttagcaatacctactgtatggattgctgagataatccaatgagctaacgcaggccaagtgcccagtctaatctttgacatataatttcaagtgttcaacaaacgttaaatgcctttacttgcacattcacttatggataaagatgcttaagatcaagaaagttgaatgatctgcatgaggtcacaagctagtcagagacagagttgagactaaaactcaggtctattaatgctcagttgtgcattattgatatttatcattatcactaacagtttttcagaaaagagtatactattcctgcttatgcatagtattagatatttaaaaattatcatcttaactttttcctatattatatcacattttatatatatagatatacatgatttatatggacaatatatttcttgaagatagattaatagcagtgaatatgttttaggaaagttattttggatatttgaaaaactagatatcacaaagtataaacaataggcctatgttatttgttatagcctgggtatactctgtgaatatatcagattaaatctgtttctgaaggactattaatttatagatatggttcagaatctttctattttgtgcagagagatatagtagagagactgactgaggtttgtgattggggaacatggccaacagcccaagtggccgagagtttggttgatggaacaactgccaaggatcttgatgcagagctaaatagtaaagacaacagaaggataaaataacatgaatttaaagatgctttaaaggcacacccaataataaatctccgtcagcctctctactatatctctctgcacaaaatagaagcatctttgaacataccatgtaagcattgatgctatctttgaacaaacactgtttctggcagatcagtacataacatttggttaaaattagcttgtgaataatccacgggttttaattaacccgatcggttgtctgaccctctgcactctgagggttttaacacgtctgtgtatttgccatgaaactttaactcaaatttccaaggcaattttttatagttagaatagaactatttattatttaatttaaatctaaccgtactatattgtatggttgagtacattttatatggcctgagaatgggtagtgaggttatcacaaaacatcaactaggatattttttgagacatctgaatatggaaataagctttataaattcagtttgacattttcctaaacactttgtaatattcagttcctcaacaaaaataccatgtgcaatatatttttgtagcaagctcatgcctattcatttatgcactaaacaaagtatatattaagagcctactatatgataagctttactaacactgctattcttgggagactgtctctgtgagtattttatgactatgatgcatggtttatgcattatcaaaatattttttgaaattttatttcaagactgttgttctgcagcctattcgtgatcataattttaattcttctgtctcacatagtcaagagtcttgaagaagtgttttgagagtgatgtaagtcagatgtcaaccacgcctcctggcctagtatttcagcattgaccgttctgcggctctctattcccatgttctgattatcagccatagtctgtggactaaactgagagccagaatctgcctgaaaggacttttatgctgttcttaaactctatatgcatggttgttctgaaaccatttggattttaaatagttaaactacttcagaaatggagtctctttatgaacagagacctattttctgcattaaggagaatggcagtatctttactttaagaaaagattcttcattgaccatgacttaatatgggaatatagaactgattacaaccattgtttttctcaagattgttaaggttgtgttacatctcctgccgttgacttttgttctctccggcaacagcacagttcagaggtgtgggctccatgttgcgtccatacttggcttgttatcctcttatcaagctcttagcatccctttgtttatttgaggtgacaggaagactgtgtaaaggctgcttagtcagggatatcagccttgttggcagcggagtgattgccagttgaaaaacaaggcattattgctcattttttccctcttattagtttgattacatttgcaaatcaaatcaatccatcagacatgatcaggcctcgtccgcattttaaggaatagtaatctccgtctaataagatgcaaatgtgtcacatcggtaagtaaccaataaatcatcgtcttgtctttggcaatcattaaatatcagaaccaacagtcaatttttagtattttcaatttgcgatatgccgctggaatataaagatagatggacgtaattacacaaaccaaacactatttcagttcattccagacagcaaatttagtggaaggtataactggcttgtcatcacactacattattcctagcggttcatgcaaagttcacagacaagcttcaaatggacattgctttttttcaacttctaacaacgtccccacaatggcaagcaaactttgatgtaaggacttgaactgacttccgcacggctgttgcagtcagatgccaacatgacagaaaacatatgctctctcccatcagaaactgctggcagtgccagctccaatcttctatatttcctctcttaaaaaaaatgaacttacaagtgtaaaaataaagaaaaacaaaaacaatcaagaactcttcaggtgatttatgccatcctcatgtatttggatggaatggttttccttcagggggaaaatgtgaacaaaaactttatttttctaagtttcacattttagagcttctctgtgtgggcaatgtattcttttgatctaagccattctctgtgaagacgtgcatgtatgcagtgccccagtatggccaagaaagagaaagagtgtgttaatttggggcacatactgaaatcttggtagatataagatgttataattcaaaggataataaatataattgtatggatggactatctgatctgaatgtcttttctctaattatgctctcctggcaactcaatatctgctgatgacctgtgacacttgtccctttatttctttatttatttgcagaaattgtcctatcacaaatggaggaccctccccaatctctcttggttctatttgattatctcaatgcaatcaatattcatacttttccctcctttccaatatttttctcttatctatttctctttcttttgagttctgatataaaaagttcttttccatcactgatcttacggtatttaaaatttgcaactctctgattttctttttggtcttagccttacctagttactgacatcacttttgttcattttctttcttctctgtaaaagttatttgccttctccagtgtaagttgctaaatagcatgtgaagaacatatttatatgaccttggtgcacctgctacttatttcggtggcacttgaaatagtcattgagagattctagtttgtcttgacagatttgtcatgttctatacagttaaaatttagagcttaacatttggcagtaccaatcatttggcctgctaggtcccttatttgcatggagaaaagcaaattctttggaatcttacttaataaacactctcatttgaaattgacaaaattaaaatttttactgcattatttacttaattattttaaatgtgttgggtacctttacggtaattactctgcaaggcaatatacaaaagtaagtagggtagatgggggcacactttcctaaagcttagagtctattggggaatacggacgagcaaggaggcatttataacagtgctctatgtgcactgatggagtagcccagcgtactataggtgtaccatggtggaaactctaacatttggaatcagggtagatttcttgaagaaaatgacatcgcagctggatttgcacaatgtagagtaatccagtaaagataaatgtatgggaaggtgtcaaggtgtcaaatgtatgtgaaggtttaattactagctttgttcttttggttaaacctatagtataggttaaacaagtccattttcaagacctctgcctcatctgttagcagaactgaaggacatcattcatcgaagaaagagcattcttttaaattttaaggaattatactataaaagttgtgttagactctagttatagaccaagccaagaggcttcaaatttagacaatgagaacatgcagtcacttgagagagaggtcaagacaaatttttgaatcaacataatcaacttataaaatgtcacatgtgtacccgtttgattcaccttgcatgccatacaggtgggcaggcaaaatgagccaaaccttatgaaaatgagccaaagtttacaaaagcaattttatgccacttccgtaccttttcttttgtccatatccactcaaagtttgatttccggcattgtttttctttctgcaaaaccgatgtgaatttttaaaaatactgtccaggtctttctaggtgattgttttgctagccaacccacgtagctcaaggaaccccatatatagcagcaattgccaggaacccctaatgagttactgctgatgaaagccatatagctcatgcctttgaagctttgtaccagaactttatgctctctctaaccaatttacataccaccatggtatgtttaatttgctttttcatcaaatcaataatgggtctaattgaaaaaattggcagtgctacgtgcaacctaactactgatctcaatgtttgccggctaaagggaatgttgcatagctgtgtgtcagacacctgcgttattggtgtactcctgctactaatgtgtacaaaaacaaacattaatacaggtggagcatctgcaccaattgatcactatgctatgagaattaatcacctggctttcagcttgaagaataaaatttacatctttaatgtatgaaatgtattaacacacacgcttgcaccattgacagggtgatgtcagcagacgtgtatgtgcagccccattaaatgtgtgcctctggacaattaattgtacctgggagtgtaaatgtagggctaagttttaaatacttgatagcatttttaaaatttagaattgagacttttttgttagcagtgatggaaaaaatttggcagtaattcaaacaaatggactaacattgaactctggaaatctgccttcaaaaactgcatgaggaaggttttgaggttgaattttactctttctcatcccaatccagaatggattttggtatcatcatcatcatcatcatcatcaacaacatcaacatcatccagctacattcactgagctcttgctaggtgccaggcctgatactgattattttacatatattatctcaattaatcttaaacctagatttgaagatggcctctcctataactgtgaaaattgaagtttaacgaagtcaaacaacttgcctgagatctcaaagctagtaagatagcagagatgagcatgttctcacccactcataagtgggagttgaacaatgagaacacatggacatagggagtggaacatacacaccggggcctgtcaggggatggggggctaggggaggggtagcattaggagaaatacctaatgtagctgatggtttgacgggtgcagcaaaccaccatggcacatgtatacctatataacaaatctgcacgttctgcacatgtatcccagaacatatatatatatatataaagagatagcagaggtgaaatttaaatttaggtctatgattccaaaccctgatcattatccactatgctaaaccaaattactaatgtagactagtcctttttaactttcaacctgatttttttttttaaagcacatagtatctccaaaacttaggctgacaaaatgtagatttcattgatacatctgataatgtcgatttgatcattattgcaggactggctacataactggcaaagtccactgcaaaatgaaaatgccgatcctcttgttaaaaatttattatgaatttcaaggtggtgacaacagagcattaaaccgagcatggcttcctgcagtttgcacgcccatgaagccggcctagtattgctatgagagttggagattttgcttgggaacaagtttaggaaatagaggaggcccttttgttcaagtttgtgtagattaggtttccaaaaatgctgcacagacccagacaagcttttttgataccgttattctcaacaacgaataattcatttaggaaggaaaatgttttacatcatcacaagccagtagttgacacatggggcaattttgcctcacagggaacatttggtaatgtctgacaatattttgattgttacagtcaggggagggagatccagtgggtagaggccagagctgccgctaaatagcctacctcgcacaggacaatccccccacctcctgctctcatcaaagaattatgtcaatagtgctgatgttgagaaatctgtcttaaaccatcctatgagtgagttttttagtttcttattcaattttgcaaatcttataaattaatacataagtaggatagttttattatcatctctagtctctcacttgacaagaagtcatcttcatcaataagatcaataaatattttttgggcagagcagacagggtatattttcatgagcactctgtgaccgagcagtacattttatctttggtatttaaaaataaaacagaaaaaatagtgaactctaaaaagtggccagggaacatttgaattaagagttttcttggaaatttcatgggagatatttattgcattgttaattacatattcacatataatggggagaaagaggccattgtagcacatcgagtaaacagcatgcattttaacaaacatataagtatgtgtgtattcatcaaacaatttcttattatttgaatatcaataaaattttgaaaaatttataaacaagtgataaatgttctaaatacttagatcaaagctatgtatatttgaagacatttgaatttttaataggtaagtcttttatatgaatttatacaaataacatcagactaattctgaatgttaatgttaatctggacatttttagaacgtatgcattggggtgggtatgttacaagcttgacaatgaattgtttaaagtttatatgaaatcattaatacaggccaggtacagtggctaaggcctgtaatcctagcagtttgggagacagaggcagaaggatcccttaaagccaggagtttaagaccagcctggacaacatagtgagatcctgtctttaaaaaaaaaaaaaaacataaaaattaaaaaattagctaggcatgctggtgtatgcctgtagtcctacctactggtgaaactgaagcaggaggattttttgcttgaaccctggaggatgagtaagctatgattgtgccactgtactccagactgggtgacagagcgagcccgtctccaaatgaataaaataaatgggtacattttaaaaaatcattatatgtaatatattgttatattgcataaataccaggcaattacttgaaaatatatgaggatacataattcaattcttatggtcattttctaattcttaaatggttttcctaatcatttaagagaaaaacacccataaaaccatagttttatgcagaaatttttattaaagtcagtttcatgtcactgtctttcaattcagtttctctccatctaggacatattttaccaaattttgaataactccaattccttacagcaatgttacaaaaacaaaacaaaacaaaacaaaacaaacagtgttttttctaggtgacctgagaaggtattatatttgtaatagagtcccccagctcttgaaactcgttctaggtaccattctaactagattaactcttcttccactccacagcagttttgagaggaggttgatgctaaagggaattccacggacagcaattaaaagtaagggagcctgcatgaaaaaatatgaaacgcagattaagcaccaaaaagcctagcactgaaagctgtgtaatgtgggtttgggtatcccccgtattcctcagtaaccttggagggcatctccttacaaccctggatctcctgattggtacctgatattgtgcagattctgagtcagcaggaaaattaaatagtatgtaatagactttgtttaggaagaatgagaaatatgtaattatttttaaggaatttaatcagggtgactaaaatctttaaaacatgttttggagttttatataatgaaattcacctatgtgaaatgtctctgcactttgcagttctgaattattattactcttgatgaaaaaataataatgacaatgattatcatatgcacaatgatgttgagattataaaatcattctaaataaatttaatattcacttgcatttgatacctacaacatccctgtgaaattgttgtcatcatccacctattttgtctggatgaggaaaccaagacccaaagtttatttccaagtgcacacagttatctctgtatgaacatttgcatcctgaatagtatcactcaagtaattgctattcacattttacaacacatatgaattcaagttatcaaaagtttctattcaacatttgaaacaaatctctaagtttttttgcattttcagcattattgaacataaatgcaaaaaaataagattttataatctcttcatgtttttaactgaactatctcttaaaaagacatgttagtaacttctacttgtcattatcgtgttaaacataaataaaatcctgcaaagtgtagaatactgtttcaaccctgttcatctgatggtggatactatttttccagtgaacagactgagagactacacagcaaatgtaatcatagctttcgtagtgaagcaccagaaacacattaaaaaatgtgatagtacatgttgaaattccatgtatttgtaatccaaaatttagtggtaagcctctaagaggcaacaattaaacatgaatattaagatgataaaacaaaattagaagcttgctgggatcctggtgtgatataaacccatgtttccaagatgaactttaaaccttgaggttcaaggcagttatttctttactcatcaagagctgtcagggattagaagaggcatggaagaagtttcttggatgtttgtacaaaagaataaaatagatttttatccctaaacttttttaatgatgatagaaaacttcaaaaaatacctgatgaatacaaaatgataatcttgaaggcaggtttggaaacaatactacaatccaaacaaatagtgtcattccatggatttaatggatggatagtacagtgctgcaggcaatatcagaacacacaatttcttgtcagtgatttgaagattgtcccatgtgcattgttgcacgtggcaactaggtaatcaatttccagttttattttacagtgcacttaattcacagtgtttgtcaatagggtgctatggctattttgagtggaaacgtatgtgttttgtggaacttttagcattctttggttcttccactaaatccctcagttcaaaaacactgctgtacattttcaaatgccatgtgcttggggggaagggggagatagaaagtagtagacttaattgagaaagatttgagtgcaaataaacactaaattaaaaccagtccccagcaaaatgggattattcatgcatgagacatgcaagactctattgtccatgcaaagtgtggaccaagagctacattcataaatgaataaataggtagagagaagaaaaattcaattctacattattgatgtatttttgtgtggaattcaatgttttaaaacacagttggagtcattaagaactttaattttatgtagtaaatgagtacaaaaatgtgaaagtttaaaaaaagttttgaaggacgattagagatatatgtgtaacaaatgctacaaaataatagttttctgaatattattgaagtataagccttcatatggcagctttctatctgttaattctccctgttacattgagacctaataggaaattccagggatatgtgtgatgcatcatccactgctgctgagatgtggctctctctttcattactacatgttgatgtttcatttatatttgtatttaagagctatagctacttttaaagagttgctttataaggaaccaaaaagaattgcatctttttattcttccaagagagaaaaaagcctgaatcctactgaagtggttaaataagaagtcccacatctgggaggaacatagaaaatagttcaaaaaagaggaaaaaaaaatggaattcaacaggatgtgagcattaaaagagatgccctttataaaccagatgaaaaggataggaactgatcaacaaggattagtactagaatcagaaaacattctatctctctctctctctctctctctctctctctctctctctgtcatagacacacaccttatacccacagaatgtagtatatccatttcatgaagaattaccaaagaatacatcttaggccagttcattaccagggaacgtcttgggctcggctcccgaagtatggccagaatgaaaatcccaaacccttagtagtcaaagctcccaggaatcttctgtgtgatcactctcagggatgcacaagaaggtttggtgtgagtcacgattttcaggataaaggtaaatggactatctgagaaaaactaaaggtttggctgaaaggaattcagtcacagtattggtctaaaaatgattacagacgtagaacaaaaatagaagttaaaaaaattgtaagctattccctatatcctggctttgtttaacaagcaaagactttggtcattatagcttctctttatatgtccctcatcttaagctcttggccagggtatgaatagctgatcacatacacacacacacacacacacacacacacacacacacacacacacactaaccaaaagactcaaatagctgagcgagcttcccttacttcaatatcattatttcccaaacttattattaaactgaggttcacactccataatgtgtaacaacatacaggaaatgataatgccattgactaagagataacatttagctctcaatccttctgtgatcctattgaatttgcctgttaagttcttggtgtaattaaagcagatagaagcattcatacattttgttgcaaattgatatgatctcttttgtctgtgatctaagtgagattgccctgtagtttttaatttagcaggttaagaagcacaattaaaatatcatgaaaaagatcataatcagaaaccgtcttttgggttgttcctgccaagtagataaaggggttggtgtatttaataattacctcctttgctgtacatttgttctatttgtgggttgaactgttaataaataccttgcactattccagtgggaaaagctttccacctaattaataaaacttggaagaatacctaggacattgaaccatatctttcttattagtgttgcctgcctcaaaagagaatccctgtctcttcaacacattagtaaatgtcatcttcccgggttataaagaaacatcttgaaaaactgcctgttttcagaaggactaaaaaagcaaattctctgatttttttaaagaaataattctactgtaaaattttaagtagtgaaaaatactaatcaagcacaacaggaatgattctatctaaagagcataccttagtaaaagcaccacaataaagaaaggttcacattgggatataattggctttgaattagtctttatttctagctattgtttctcctatatttcggttactcaagtgctttctaggtcttgatcctagagaaactgaaacagaaattagcatgtagcactattacatctacatctttactgttattaaaggccatgttacttgtaaatacatttatttatattaaaattgaatttagaaatgaaaaatttgaaaacatattactttaaacataatattgactgatatagagaagttgctcttgtgagttggtacatttaatgaatattttagcacatattttgtggtttgaaagatagaatactcaacaaattaaataaggtcccttgtctatggccatgtctagtcttcagttagaggctttaattataagtctgatattttacattttagttctaatttaaaatgtgtaataaatgaaaaatatgtgtgccacatgatctatagaatctttttctgcatagagtacggaagtttacacctgttttatcatatatgaatttctgagtctattggcttttctgagattcttccaaatatgaaaattaataacagtatatgaattctatgggaaatattaataagagagaaggctcacaaggctacctctataatagatatgcaataaggtggaaatattaaagtacataaattctacatacaatgtggccagacagcatctccaagaatgattaggttagcagaaatagggcctattttaaatttcttggttaaattatgatttttttaatttttcacttcatttcaagattcttttaataaaattaaaatttaaagtaactttttgactgttctttagagggtagaattaagaaatattttggtagtaatgaattttgtatgtatttttacatctcaaattaacttaattcgctttttttttgcgtcaaaggtgagacaacaagctaatatattttgagcacattccattataaaactactaaattcacaatacactgctaatgctgtgcatattgtcattcatctcttcattcattttttcaaatattttatagagcacctagtatgtgtaagtctctgctaaacactagcgatccagcagtgaacaaatgtaaccaaaaaatccccactcttgtggaatgtaaattctagtgaaggagacagaaaatggacaggaaggacagcatatacaaaggtcctgaggcaggagtgtgcttggacattccaggaacaggaaggaggcccaagtgattggagtagaatgaaccgagggtcagggagggtggctgaaaacaaggtaggggggaaggggaactgactgtcctggtattttcaagtgtgttgtctcacataataacctatgtgttaatggccatactaagcaaccaaacgaaaattgtatattttcaagtgatgtcagggacatgccattcttactaaaggcttatatatatatatatgaaaattcttcaaattcactaaataaagaaattgtcagcaaatatatttaaccattagctaagatgtggattggtatatattggtatatatatatatataaaatctccaggttgactttttccttccttataactgaggagcaatccctccaaagatctgaagttagactttatttatacaactagaatggtcttcctcatcttctagactgtgtttgaaatattagaattatgatttgagaaataagcatgtatctcaaaatctgttttaaatgtatatcatgacaacaaatgtttaagtcctatgcttgctagagtaattgttaattgacatgacatgcctaatataatggtggaatttgtttatctaggtggcatcatctcccttgcctgttcgatgaatattctgcataagataacttctaaaatcatttcctgagcttattttctattatcttatggactttatttaataaacatcttgcaacctcatcatactggtgcatttaacttttcagagttaccttgaaacaattgctgttaattgggtgcatgcttgctctagatgtaaacctaagaatgtgtagcagtaacttggtgttaagctgagggataggaagatgggtagagttcatttaagaggttttagcttgttctttttaaactaggggatgcatttgctgcgttttctctctcaaactcttcaagcttctcaggcttatcctgcgtttccctggaggaattactcagctgcccgagtcacctctggctgtgcggtagcagtggaaaggtttcaccacgttctgatttccctttccattagagcagaaagacagacagtagtggggtggggagataggtgccaggaagagctctaggggccatgctcttaagcgcttctcacagactcacgcttttgtcctcattcaagatgtgaccattcccaccagttgttgatttttcaattctgcaaacatgaattaagacaatttaggtccttgagaccttccaagttctgggcacacacacacacacacaaaatttttaattttttaaaaaccaagtatttgccaagcactagaattacaaagaggaatacattttgatatcatagaagagataatgactttagtagtgtcgacacaatgcagtaatagaaatagggccaagtagtagaggagaaagcaggagagaaggaagtgcctctctgtttgaggttattaaagaaatacttagagaaaaatatttcagatatgtttggattgtttaagaggtatttgcctgcagaaaggaagggaaaaggcatttcacacaaaggtgaagaaatatccagtgcacagaaatacaaaacagcatggcttgtttgggaaagggaaaatgatagttggaacacaggaagacaaacagtgctgcatggtggttaaattctaagttctcaaatggcatcggtacaaatcatacctctaataattttagtcaggtgacttggagtgggtttgcacctcagtttcctcaaatgtaaagtggcaaagagaataatgtgttctccataaggttttagtgagaatgcttttgactgccttactcctatcccatacctagtcagctttcaaaatacaaatcagatcctgtctcctttttgttcaaagcccccagtgacttcccatctcacttaaagtaaaggctgcaaaagtttgcacaaagttgcaaagcctttgtgacatgcctgccccattctccagtcagcaccatctcctgctactcctctccagctgcactagcctctgtaaaattctctgaaccaaaacaagaaggctccttctttggtatatgtgtcttttccattccctctgcctgaaagttctagtgttctagtccgtttgggctgttacgacaaaaataccatagaatgggtggcttataattaacagaaatgcatttcttatggttctagaggctaggaagtccaagatcaaggtgctggcacattcagtgtctggtgagggtcccctttctgtttcatagatggctctcttctcaccatgctctgttatggagaaggggcaaagggagctctctggtctctttcataagggcactaatttcattaatgagggctctgttcaccttcatgacctaatcgcctcctagacaccctccttcctaatgtcatacctttggcgataggatttcaactaagaattttagaggaatataaactgtcagtctatagcaccctgatagacaaaggacttgctctctcacctccttcagatctctgctcaaagctcaggtaccagtgaggctttccttgaccccctctcccactgcttacaacagcagctcctctttccccatgccccatcccagggcccattttccctcatagttttgtattcatgtttctctattgcagtattataccactgcctgctatatttttatttattccaccccaccccttgaatataaggccccaaagaatccatatttttcttttgttgcattcataatgcccagctcatgataaatggaagcactagcatggtgactggaatttagtactcagtgaattttacaaattttaatagtaataataattgtcatcatcatcattcttaccaaaaaatgaagaaagaaaagtaaattgggccctgacaatgaaggattctgtggacctcacagagagaaaccatcacaacaaggaagaggtgacccctgattaatacagatctagaagaaaagagacttgagtcagggaaatcataagttgggaggctattgacttagttcaggtggaagataatgaggaactgagctagacagtgggactagaaattagttttggaaatgagatatttcataggaaaaattagacatagaagtcaaaacatagctaactcccaaatttcaactctgtgttgttcagtatttaaaaatgatctaagtctgggaggaaaatgagttcaattttagacattttgatatgagttgccaatgagacattttgatgggaatgacctgtaaaaaaccagaaatataaaggcttgctctttggggagaagggggtactggtgatatagttttgttacatccatagatatgtatggatgggcaggtagaggaagaagagaagaagtgaacacagaattatttaaagtattacattaaaaggattggcataaaagaagaaagaccaggagaaagatgtcttatcagtgcaaaaggaggaaagagcttcaggaagtaagagaggggtcagtctggacaaaatagtccagagagatcaaatcggatctgaacaggccatgggatggggcaattaggtcattggtgattacagtatgatagagctgagatgcaatccagactttagtggaatggagatgaatttagtgcaaaagtgcatgtacaccattttgtcaggaattttcgtggtgaagggatgcagtgaacagagagggaaaaagacagataaacagataggcagacagacagagacagagagctagctattggggaaaagccagtatggaagtaagattttatcagaatagagggatgaaggaatggaacttgaggagaaggagagattataagtataagaaatggagaggggccaagtagaaaattggtggatcaaaatcttcaaggtggccagagcagatggattgagaacataggaaaggccttccttaggaagaaagagcagtctctttaacttacagacaagtgagaaggtgttaagaattagtcctgctacagacaagaagggaagtaggtcaagggtatttatatctgatgtccttcatttatctaaaatatgggaggtgagatcatgtttgcaggataaaatacactcagccttgattcgggcaggaagactgtccattcatgcaggaaaggcttgttttggattcatgttttccctgcccatattgaggaacatcaaagatgttcagtggaaggtttagtctggagcataccatagaccagagagagcatcatccagtctagcaaccttatttggcagatgaggaaattgagcaattcagtgactgcctgaagtttacacagctagttagtagctgagattgcactgaagtcagcttctctcactcttaatccatactttcagtgaacagtctcaagctgtgctttctggagacttgatgtcacttcaaccaatattacattcttttgcctatgaacacccttgcctcttacatacacccatacaccctaactctctgtcagtcatcaaccccacactcagcctccatgcatcctgctgcttttcttgccttctctgcatggtccatcatttcagtttgcaggctgacttggattgacccactgatgggcttttcctttgggataagccacattgcagacaagctatctggtcgcattcgtgaaacgagccaacatgaggctgatgccgtcaaaaggaccgagggcatcagctccatgatgttgccacaacctaaaggcagagttgagctagatgttccctggagtgtacccctacggttgtcaaacgaacctcctagatgacctttttacatttatgtgtaaaacaacttatggaaatgcttaattcaccaaaagagatatgtcagaaatacgttaagcagaatagttgcatcagttattcggctacatgaactcctacattccaaaatgagtcaatacatgtgaactacaaacgttttagttatgtataaatacaatgttattttccctgcctacatttcagcatgaatttttgttgttcttgaattattgttttaaagatattaatatccatgaaagagatactcatgagctataatcgaatttgtctcagagtacttattttggattgctgtgttagtgctatgtgccaggaataacatctcatatatctagctttctctttcactactgaaatagacattaggatatctgagtagtctctgccctttaaataatgcactaaatacaatgctcatggacaccctttccttctctcatttgatttcgagatacggagaataaatgagatgttcactggggttttgctgtcttttataaaatccaccccattctggagtgaatgagcgagaagcacaggaggtggccttcgtgggagcaactacctttcccaagtgtctcatcctctctcctctgtcatccccaggcaatgtgcctgcatttgtgtgtgtagatttatagtttatctttatctatggcttcatctgtaggtagctattatagctgcctcgcctggatattgtttgggcctgatagatctgtctgtagttcatcaaagaggagcctagtgcctaaaagccattgggtccagctgaggatgaattacgagccatcagccttgataatggctgtaaaatttcataattacatggcctttattacattgcataatgatcctgaagcagtatggaacaattaattaagattttcaaccgtggctctttcagaaattaaaaggtgctagtagctgaaaaatgggatctgtcttgtcctaaaagcattagggatgcttaggaaatactttccaattgcacttttattttttgttaagaggaacatccgctagttagggaacatgcgttagtataccctgcctattatcgagtttttatttcaacttcaaaactgatactttaaaaagaatgggagtaaaagaggcagctaaggatctctagaactccccaacttcccttttcttttctttgaaaaattctattctgcctcctgctgtagccatttatcacatttatggttgttcatctctacacattaaataaatgcaggctctgagatagggggtcagttaactgcctactatagtatactgaccaaggagtttttcttatacactctctcatatcttgaggcattaaaattctttcaagatctctacagttttgacaggcatccccaaaggaagactttaccgttttcatttattatcctgcgaatgcagcatgtcacatctaatatataccttttatttttttttcatctcatcttcacaccccataaagaataattaaatttggtgagggcctgtaagtgccactaggaatttgctacatttaaataataacagaaactaaagtatttagtatttatacacatggatgtgcatttacacatacaaattataacccatcctggactttattttctatcaaggaaattataattgagctagtcaggtgcaataaaatgctaaagaaaagatagtgaaaacaagtccaatatttttattataattattctaagctgtatcccgagctttcatccatgtactcggtaagaaatagatatgcttccaggaaacatcatcaatggtattgtcaatttaaatgagagaatatgaaaaaagaaaacccccaacctcgttgtgatttacacataacttctggatatttgttcccgtcaagtattattgtttttaaattgacaatcatcatataatgttttacggatctaaatatttcatgggagactaaaacttcccttgggcctccccaataataaactttcagcagaaaatttggaaaggattatgtgcttcaaggaggagctggtgctcagagtaaattctcttgttgaggcatttagtcccttaataggaattttctgatctgctgtcattcttactcacacaccgagtgtcactgcctgtaaaacacttgtcattctttaatggaaacaaaatagtcattgcggccagagccgcaatgtcattccactaccccttgctgcgtcggcaatagtgaaaatgacagagcagctctcagtaggggtaattaaaatgtaaatattgatattttattatttgaaattactttccagtgcggcatttaatatccctccatctgtgcagctctgtttagcggtcactttagtgcagctctgggataccaagcagcggcttgatccccgttatgtcaaaatgcttgttgctgcttaattttgatatctaattaagtggaaaagtacagtccacactgtaatccatggcatcttaaccagctgcttgggtatatttagaattaatctccactatggcatcatcctaatgtatgcaattaagagtctgccgatggctaattaggtgtattagaatcaggcagctttttttttttttcctccatttcttctccccctttcattttggactgttgtagacagaagagtctctgcctccagaggtaatgttcatgctactcaaatctagttaggaaacaggacaacttccaaatatggtaacccttgtattttccttcacgtatttccttgaatcaacctgatataaaaacttctaggatttcctgggttttttttgcagggtttcagtgacatgaaaggaaatggtcacagcctaggagagaggtgggatacaaaggtaaatgcactctccagcagatcaaagcgggaaggttagagggactgctgtgggtgctcttgtttatttggggaggagaagaattatggcttttaactgcagctacatttgccttctccattctactttgaatggaggatcttcacagaaagaattattataagaggcacaggtttggtttgtgtatcatatatccatagtaaatatataccaccggcagccttttaccactgataatgattctgcattcatatggttgaggaattccgagagctgtgttgtttgatgtttttgttttggtttcattttaacttggctagtcatccaaactggggatagtgtagagaggaagaagggagggctgagaggaatcgaaggggttgcctctattgtcaatgagaagataactggtcgcctccccagtggaacgtatgccaagccataatgacttagctctgcttgagccagcaaacacgagccgtgaacttgggagtaaatattcacaaacagatcttcattagccgcagagaaaaacagtgtgggagcctgactttaaaccgaactctcagagctagaaattcagagaagctgcttttccatgctgtccagaacacaaattatgcctaggtctttaagcatcagtagtaaggatttctaatattatttgagtgtggagtttcagggtcagcatgctataatttcatatctgtgacaagcatctcatggataacatatttcttctacgttctttcatgaatacatatggcactttgtttttaatggcctatgctgtaaatcctttaacttccatttatgcagaagacctcctgttttgttttgttttttctgcctctcctcctcctagggcatatgttaaagacactgagttatagtttctattttaggaaaattgagaaaagcacacctgaaggattttcatttttttttctgctttacttgtaactagtaatagtaagacaagaagagataacagcgttaactccacaaacaccaagtctataataattagtgcttttattggaatttgtatttctatatcaagggaccaattaggtaactctgaaaggatttgaagttatgtttttaaaggcagtacagaaattataagcaatttttcttttagggatccaagatagaattgattcttggtcatttcagtgaaagtacacaagataatcacaactcccttttgtacgtggcagcttaaatacaattttcaaatttttaggttaacccatatgaaatgacccaggttctcacaatgcctgtcattctgtgcttaatgtgcgtgtaggtgaggccttcacaaacgggaaaacagttacacaaagatctttttgacaagataccctgagccttaaagccagcaactctaccttcattaatgcaagcagtattaggaaaaactttgaactttcaccttacttgaataggcagtgtttaatccaaaatcagactggggtccagtgagcacttctcttttccttctagttttgtctcttgtactacatcagtgaagatagatagatagatagatagatagatagaccttaatatatctatctatattttaatgttaattcactacagcttatttcaatttattcagtgtgtggaatgtgctttttaaaaggttcttacaatattagactctaatgttggattacaaataacagaaatgaagcaaccatggcagttactattctttcccccacccctttttttttttttttttttttttttgatggagtctcgctctgccacccaggctggagtgcagttgtgcaatcttagctcactgcaacatttgcctcctgtgttcaagcgattttcctgcctcagcctcctgagtagctgggaatacatacccatgccactatgcccagctaatttttatatatttagtagagatggggtttcaccatgtaggccaggctggtctcgagctcctgacctcaagtgatccactcacctgggcctcccaaagtgctgggattacaggcatgagccaccgcacctggcaagctaagtcactaattataaatttcttttaattgtgggatattcccaagaaaagcagttcatttcacctttaaaaatattattattaaacttcacgtgtgggaaaatgaaaattcataaaaattcattttatactttaaatatatttttgagttagaaatagtgaaaatcaaatcttaaaaagtagaaaggaaggcagaagtgccaataatttgttgtttgaaaaaagttaaccaaaaattacagctgggattgcctcttcgacagctttaaagagttttagaggcatgcctatctctttttgaagcccgacaaatgacattttctagtaataacatattggttagtttattaaaactttgcatgacttaaaaagcatatttttgatcctaaaatgtatattcacaaaattcatctgcttgtgtttctcctcatatctctattttcaatgaaaaattataatctttaacagaataattttctcatgaatccaaactctcagccagccataaatggaaaaacaaagttcatatcaaaataatgtgatcctggttctgacctattaaaaaatgtttttggttcctgcttcatttcctcaaagtcccacctgatttcttttagatttaaatagattctgcttgacttgcccagattatttgcatagagctatctatagttatgcaggttcccacagcaggtagaactggttcctgtttgaaattattatgtaagaatggatacacaaactagtctgataaacctgaaacatgtctaagtggcatttaaattacattaacacctgtgtgtaaagacacagtgaaaggacataacagacaagaaccctccttgctgtttgtaactgtctaatctgctgctttatcataggaagggcccttactcccttggtgctgcaatgactgtagtgttgcaagtacttctgacaagtgagtgtttacctagtgaggacccattgttctaaactggactgagaaggggacgccttatgtatgcatttttattgccttgtctcctccttgctgtttttgattcagagtgaagcagcccataatgataaaatgccaggatttctcaatcttcttgcaagttttttagtgtggaaaatgttctcatgagaagctccttcttacacttgacaaaaattaggttgggattgcctaaaaatttacgttaaaaaagtagacatattatattttattcctgcaagtagaaagaagcaatgagcattgttttcatccatgacttcactaggttagtatttcagaggcttaaaatgcaagctacagaacataaatgtatacatattgtcaaaataattgtacaactaggataggtagataaattaatgacagtacttataaataacaaaaaagtaattgtgacattatcatgaagtctgttgtgaatggttacttataaatataagagaagcagctagtccatatgactgaaacatcaactttacttctaaattgaagagaactggctgaggttaataaatttaggcaggactttatcagagtctaagtggctccaaataaaaatcctatatactttataggcacttataagaaaagagcattatacgaaatcagtgccttaataaacattcattgaattaatgaaaaagcattaggcacccctttttgttatatgttgatgtattttctgtgggtgagggatctggttcctgcaatggtcttttcattcctaacgtcgcatctttttgaaagccagtcaatgagctgttgaggaattctctattcattcatttagcacatatttactgagcgccagctatgtgacaggcactgtttgaggagctggagacatagcaggaaacaaatcagagatctccaccctgaagagtttatctagaacacagcaaaccactgtccagaggatacagatacatctatcaagcagcagatcttcacatccactcccttacttcaggggtcacttacactcagctctgtgtctcctgcttatgtcttcatcttcatcttcacatttatattttacaagtgcccttagatgctacccagtgacaacgatcatggcaatgagaatggaaagaagtgtgtgtatttgagaatgatttcacatgtataaaagagaaaacttggtgagagatcagtgaagggccaagagtaaggtggcaggtggatggcggtgcttagggaaatagtggagctgtaggttttgacattaggattaggaaaatgagctcacttaacatgttaggacatccatggaggaattactagaggaagattttttaggaaatatggcaggaaaagggaaaaggaacaaacaatgaaagaaattctgtgttctaccagagagtttcagttttatcatgcaggagatatggaaacaaagaaagcattttgatgagggaatgacataggtttcatattttaaagattgcttgactagccctgggtaggatggaagaaagaaatacaagatataaaaggattttggtaaggatgctgttaaaatttaccccaaaaggatgatgaaggcctaaccaaaactggaatggaggggaggagagaaagtgatggatatggatacatttaggagaatgtgtacaaccaagcactaaactctccttttctgcatagacatgtacttggatccatccttgcaatacttttcttttttggttgttatggtcttatccacttttactgtgctataaaatcttagatgacaaggattatgtcttattcattttgcatattccaatggtactgaacatagtgcttcacttgtaatagatactctaaatactagttgatttgaactttgtcacagtagaaccattggaagcctaataatttaaggctgaaataaaccttcaggaatactttttctaccttctagttttacagatgagaaagcagaaaccagcaaagttgagtcattcctcagtgtttcacagttctttggtggcagagatggcacccaattctaggtctatttactcccagtccatggattttgtctgaggtgctcaccgttacccagacagccttgtgcttcatgattagctcggtttgttattctgaattagaaactgttggaactggaagattcctcagaagtgtgtagtccacagtttgcaattgacagataagaaggtcacctgtgggtctgtattagtttgctaaagctgctaaaacaaagtaccaaagactgggtgacataaaccacagaaatatattggctcacagctctggaagttggaagcccaagagcaggtggcaggaggtttgggttccttctgcgggctctgcaggctagtctggtccatgcttctctcctgtctctcctggcttctggtggcctcaagcatcccttggcttgtaggtagtattctccctgtgtcctgacatcatctttcctctgcacacgtccatctctgtgtccaaatatcccctttttatgaagatacagtcatattacattagggcccactttaatgacctcatcttaatgtgatcatctacaaagaccctatttccaaataaggtcatgttcccaggtcctggaggttaggactctaacatcttttgggtgggatggcacaagtcagatcatcacaggggctaagttaataccattggttgtagtcagatctctagacctcaaagttatagttcccctcactatcctctcccctcagacatcacttcctgactataaacctttatcttacgggcatttattgctaaatgttttccacagactctttaaaggcttgtggagatatctgtcagctttctccaaggttcaagatagagcctgtatgtgtttattttggaggcttgaattttaaattattagaccaaatttgatggggaccccttgggaatttcctgaagaggatagtgtttagatatctggttccaaagtgggactggttttctatggaccactggtcagttccctgaagcactctgatatttcttgacctagttctaccagtacattggtaaagcaagtcagattcaagcatagatcctttttctttcaaatcagaagtgtggcttccaaatggtgtttttccctattcagtatccatctaatcccaaagttagactgaaaaatgccttttttaaatatattttttagagtcctatattatatggcattgctttcctattttcttgatggccaaacaaatttcagtcagtctgctttccaggcagaacttattttcaactagtaaaaaataaaggttgtaggaaaagaaagccattagatttccctctttaacttaaggcagctcagcccatacttgcctccatgccccccgacattttttctttcttcttggcttagatgaaaggacaaaagaagtaaacttgaggtcaagtaagagggagtttgggaaaagctaagggaattatttcagatcctctccagtcattcagaagtactaggtaagtaggggtaagtaaggacttccaaagaggaactgcacactccgtgtagatggtctttacattcttattaggcattcattggccctgtgtctagtacttttcaaagtaggctggcagttgttaaaaaaaactcccactcacaggaaaaaaacaaaacaaaacaaaacctcttgtcatcatgttgagtctttcctgtattgtcacttgaaatattttttcttagctgctattgtattttaaatttttctagcaagctgattggaaaaccaggaataattgctaaagaaagcatttcaccacgtctatgggggcatgttttcaatttctgttcctatgattgggctaattgtaaactcatttggttgtttatgtaatcagcatgagtagtcagtggtcaattgcacctgtaaattcagttaacagtgataattctgttttggactggtagatattacctttgcgtttctgttctcctctcttttagttcctcacaactgcttagatcatttgctcagttttatggaaggtggtcacttctgcccttatatacaaaattgtattaaaacctgagtcctgccttttagattttaggaatatgtacttgtcttgtttgaccactattttaaaataatagttccataaaatcaatgtgaaacctaattaaagtataaaaacagagataaagaaatagatttcttatggaatcaacaaatgttgaaacaaatgactaaattagctagcaagggacctattttccatttttgtcaattattcttacatttcacccaattgtgattgaatctaaattattgaaatctggattaaggtcagcccaaaagagtaaagattcaaagaatagtattataggtattgtatttaaggcttaagtacaaacataatataatcattatcatctcttttaaagaaaaattttaaataaaatgcttctgatagcaccatgtagatgttccagctttcacttctgcagttaaccatctgtagctgcttaactctagctcctactgagttccagttcatgaaaaaaaagtgtgtgtatatatatatatagtctcctgcaagagactatatatatatatatataacttacatatatatatatatgtatatatatatataaagtttcctacaagcccctgagctgtgtattttgtgaatcataggacaaagtgatatgtctgccccatatgtgaaaagaacatctggcttaaaaatacaaaataagtttatctctagcaagggttatgcatctgtgtgtctattggtagctaagaccaaatgttagtgccactgttattcttttcttctctgggtcctgtaaacattaggtttatttgtacgggaaagaaaagaatctagcttacgttgcattgcttaatcagcttctcaaaatgaacttcatttgtgatctcagtgagtcattatggcataattacagttctagcatgatatgctagttgttgaaaaatgttgattttttttttttttgtggaacagaaaaactacagttcaaaaactgtgatcaggcaagtcaatgccatgattaactgatattaacagatgccctgaagatttaaaatgcttgctctctatttcaagaaagcagccgagaagaaaatgcctagcaggggttaaacccaaatgcctgcactgcagcctatttctgtcaacactctgttcaggaaataaacatttatgctttctgaaatgaaagtgtatttttgaagactagccgtcagatattttttgcccttcacactttcaaatgcttagccttttttgtaagttgactgcaaagtgcatcagtttgccaggctaaaaaaaaaaaaaaacaaaaaaaaaaacagtgcttgatgagtgcccatggcaccactgtcaacctccaaagtttccagtagaagaaggcaagacggttggcacaaaacatgctttcttcaagcctattacctcaggggtacctgcctcttgagaagcttttcaatccttccaaatgatgttattcccaactgtcatctggtttatttggagcacactgtattgcagataaacatgctatttaactgcgggtcaaggtagagagtcattctgcaagcaaaatgcctgagatacattaaatggcactgactctgggacagagatgaagagagatccgagttgtcagcgatatgcagggaatgggctatagctgtggaagaaaaaatgtgccatggtatcagtgcattttaaaaagctgtaatatggctgaacatttaaaactataacctgtcacacaccaaagattaaggtcccaggatgtacaaaacatgaagttcaaacgacacaactgcaaagcatattttatttcacttgggaaagaggtttctctccaaagatagctaaatattacagatgatgaagacctctaacttgtagcccaagagctataaactaccattaaatacctggtataaacataaacaagtaattatcatttggatacaagcatgtgtaagccaatagagcaattatgttttaagaaaattccttagactcagcttattaaaacatgcattttcatttaggccttggttatttagaattttatacattgttcaggtctattgataaaaatgttattttatccatgcgtttttatgtatgtgcaacgtagctagtactcctaaagaaaaggtaaaataattttatggaattaagataaaatttctattatgtatttggtctccttagtgaccagatgaacatgactatcttataacaaggctgtcttaactgctgctcaggcatttgggcaggagagctctttgtactagcttccagattgcagtggtgtggtaggaaaggggtaaaatgagagccagcaatttctagaccaagaaaagatagaagaagttcagacttttattttattttgtaaggcatagattgtcctttttcctttggatttgcaaaaagtatacttcctttaatcagctgaaatatacttgaggatatcaatcaagcaaatgtgtcaaaccttttgtgctatatccgtctcctcatgctccctcaccaaaaaaaaaaaaaaaaaaaaaaaaaaaaaggagagctgtttcttccccttttttccttctctttatttcatagagaagcaaaaggaaaaagttaggtttgcaggaaggataaacacacacacatgcacacacatatacacacacacaaccatcaatatagaagaaacaaattgcaggatcaactttaaaaatgaaattttattgttttttgttcaattaaaccccaaagaaatgtgcgaaatgttgttatggctgtaacattgttaatttgtaaatcacagggacaaagggggcccggtgcaactttaaagtttccgtgcacgtaaatgtcgctagcgtgccttctccatcatcagcactaaattcacattgatgcctcttttcttctccgtattgatccttccatgagaacgtagatttgtatctgttaattaatgtgtcctgaaacagcgtttgtattaatcaggcagataagaaaaattggatgcctgcacccccctgacaaccgtaaaagtgctggccctgataaaatcgtggatggacctcaataaaaaagttcctccttccactcaataaactaatcatcctgcttttaattattcggcagaaagatgtgtggagattggagaatgtgtaaatctatttactaacagcagtgtctgggagggagaatagggctgtcacaggaaggtgctgcgggctacacgctctgtccatctgctgctgcagagaaactgcgacttgggagcatgaaaaggaacaagaaaactaaggcaaattgaaaagacccattcatttttgctcctaactttccagatgattttttttttttggtattttaatttacacaagaaattcttacttagtatgttttcttgagattgatatttggatttgcattgcaccttttttccttggaggggaatagaaaaaagagcagtgtggttttctgtttgtttgttgtgaatataacattgctaaaattaaaagcatctggagcctaacctatttaggttaaataatttagttttctgtgttgaaccgctgtttaaaatgttatcagctattatatctctaagaggatatttattaatttaaccccaaatgcaatgacaaaagcagaataagaaacaagacttacacagccagtccaaaagaaatcctgtcaaataacatgtaagcaccatgataaacaacgaaagaaatgcattttacacatatcttaaagattcccttaagaaaagcttgactcatctcttctgatgattttattaagcacttataattaatggtaccaaatggcaaaccactgtttttcaccaataggtcaggaaatcctttccttttctttactgtgctgtagtttctaatatcatatgggatacccacaatttgatatgattgaaaaggacagcaacagtgaccataagcagcagcctaaaaaggttgggcatcagtggctacttatgatttggataataatgtctagaaagggagtaaaaatagatttcttaagttgcattattaaaaatggtccttcctttctgtagaattactggtggcaggaccttaaatgatggtaccactgtcctcagaagccatgaggtggatggttacccttagaagtcttaggcatacacttggaaataaaagtgaagttttaagaaacatttcttttttaggacttgagaaaagcttctgatcatcaggtatcttcactttagaatacagatctagtccctctgatatataaatatatatcttcactcctaagtaggcttaattgtactgcttcctctttctctattgaacaacattttctttttaatttttttgcatatgttttctcaagctcagagggactttaaatatgcgtgtatgaatgcatcccagatttgcagaaaagaattgatcacataggtaattcagataaaaagaacatatattaatcatacaacaacacttactgaatttcaggttatagcttaatgtttaggtaggtgatattttatatttcccaaatacgaaatttaagagacaagttaatttctcttgctcaaggtgaaagagccagtagctaagtggagccagtatttacattcagaatctgactcctttgcaccaaaccctgttacctttatttatatttaactttttaaataattggagcttaataacaatagtgaacgaggcttttctctttggtggggaggccaggctgctacatattacactttcttttatacctattatcactaattttaaaagaaagtcatgttaaatatcagtggggagaaatagccaattaagaaggctcacctatttgtaactcatcatccattgtgcttgtaattattaatattatacagaaatgtttccaagttgtgctgagctctatggcctaaattgtttgtttaccttttatttttagctgcttcttcttctccttcttcttcttttttttttttttacttttatgttgtttaccaatagtagtttttagagatgagatagttgaaaatctgacttcctgtaagattttcctaaagacttcaaccagaaatcaagtatatttaaagattacatggtattttcttctcgaatgaaagaaagcgacatctctattatattcccctaagctgtgtctataaaacttatagcaaatacccacaaattgaagaagctggtttgtgactttcactttgctgttcgcaaagtgatccagggaaaattttaagagcttctaatcaaagctcagcataattttgagcactgatgcagaagccagctaccatatgaaactaatgttgcattatgaaattatggctttaaagtaacttgatctgcccatctttccatgcaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcaggttggcatactgacatagtcattgttacattttttttaatatgtcagttttacccctctccttaacttctttagggatttgctagacctggtttgtaaattttgtatgagtcagcaaaattataatcagtatagctttctagtgaaaagttagaaataagaaaaatatacttaaagggaattaatttcatttgacttgcttattgaatgctttgaaacttttatcaactaatgcatgtactaatttggatcatggcaaagcaaaagctcttgtagtaatagcataaatggacactcccaggacaaaattatttctattgtattttatgcgtaagttaaaacaagggaattgttgatacacacaaaccatttttccctcaaaaatgcaaattgtgcaattgggaaaatatatttagtgttgctttgagttttggttatcaaagaacagttttcttacattctggagttctttagaagtcaaattctgcctatgcagtaagggttaagaattatgggaataactggtctttacattcgaactgaaacatgctaaaatagcaacctctaataagtaaaaatcgttggtgctttgttgtttttccctttgtgcctctcttaatgctttattatggtcttaagtctcttttagcatttgcataaagttcaggatagatccctccttaatgacgtgccgatcattagatacctgcgtgtcaataacgtgctctgatgctatgtaccactgacagtcacaccgtgcccctccatctgcttttgttttgaccctatctttgaactttatcttggttgccggccagtagttttccctttaattacaagaaggaaactgtcaataaaatctgttaaatgggatgcaatgagtggcttgaatgggcggacggctatttgttcaaattctgcagcattcaaggtattgacagtttgttttctggggccatatgtgacgatcaatctcaggctgggctcagccgcgctgaaaaatgaaaaaccagattgcttttgcttacttgtggatgacgactttgtgatttggcgcggtcctagtgagatgagaccttctgcccaaattgcccccatgagagccagggacgcgtgactgtttttagaaataatttttaattgattttgtaattaacagttcatctacaatattgatgcatgaatccttagactgataggagggaaattgttttcaacaatggagttgtactttcctatttgtcttcataatgcagtttagcatttcacagttttaattgtgaatataaccctcttcctcaccacaccatgcacctctcttcttctacgctcctgtgaaattataaaatatgatttcttatgacaaatgacattgttattatgaaccctgaagaatcccctgccctccctctccagaagatcaaagtgagagatggggtagaaattttctgaggatttattagtttgtatggacttcacattataccatctctcataatgagatgaaatattttataacagtggttttgggaagaatttttatttggcaatcatgaaacgattctaatttaaaacatttacttggttaattgtttttaaaatatactaaagcctgtgttaaatcttttatgtttcaaattgcttttaaaaattattaactaaccatgaatgctgagcaatgctaaaactttatcaacaaaattgctaaaaatgtataattttagatattggatgtgtactttatgactattataatttagagtaactgaattaattagtagcagcatttctgtctctgttgcttagaagtataagcattaatatttctgatagataaacgtcctaatccacatattctacttctgggagaggaagtgactacctcacagcagtgactgatgattagaaagtctttaaagaattagttcatttatttttcatgtctaaagtcagaaatggtcaataagctctcctttcttctcttatcatggtagttgagtaacattgcttcttctaaaaaaaagtctctgtcccaaaatattcttgcaggtgattccatcattgacttagcccctcaatacggagaaaaatcaattgaatcagagtccctactaaagaataactgattaagaactctaaggactattttaatctccaaattgtgccacctctactgtgttgtgtaattatggccttttcttcacccacctaacctgcaagccccatcattttagtttggggtaaacaactcagaaagtcattttctttgatattgttaatatgatgttattttattccatttttgactgttatttggagcacagcaataaagttatagatccaagattgaatgtagactcaaacttgcttagatccaatgtaggttttttaaactgcccatacacatatcagtataaaaatattttaatactttagacaccctaaagggcttctattttttttgtcgtttctctctctctctctctctctgtgtgtgtgtgtgtgtgtgtgtgtgtgtgtatgtgtgtgtgtttaggaattccagattaacataagtaactttttgtgcaaaaatgaaaatctatttcagtgtaatttaggtaggtatcttagcttttcctacatggctgtaggtattaaaaaccattgactcatttacttaaattttagcttattttaaacattggtctttattcaatcattataaatgttgtgcttatgcttggaaaacaggcaactggcttcctaatgatggctttcatatttttatagctttgtttctgtcataagtgaattcaggaatacttataacaccagaacatcactggaaactctatcttcgtgtgtgtggccaaaacaacaatatgtcatgaactgttataattctgcagttttcacattcaaatctttgaaaaccctaaataatagttccaattacttttgaagataagaaacttacagtctcatttaagctatgtattctcttattttttagtattaacaacctcttgagtaattattacatctctgatatatctctgtgcaactgaattttaaaagaaaactctaggtcacaattttaatattgtaattctgaggccccagttttttcatgtatataacgaggtttgactaatatcaaattctttccgattctggaattctatgattctataattaatttcatttatatattagaaaatatagtaaaatatttctataagcacctaggtaagattatatgataggatttatttctcttcattgaatctcttgattcttatgttaagaatttgtttgaaattatatactataagattaaaagcagtttaagctaatgaatcactttagtctgaccattctctgttgctcgagtcataagaacttcaatctctaaatctgccactcacatcccagtctttgccacccctaccccaccccagcctgaagccaggcgagtccaatccattcaagaataaacttttttcaaggtcaagttttcttttttacttctacacattatttccagaataatagcacctattgatatcaagctacaaataacgatttggttatcaatttaaaatcataaataactctaacaacctcatgacagcattctgttgttcttaaggacaaatggttatgtatgcagagttgtgtaatttcaaggtatagaaagtttatgattgctgtaggatactggaatgggcaccatatttaattaggatatttggactgtcatataggtttgacttagtgtgttttcattatcactccattaggggagcctttttagatatggttttcctaataaccccccgatgaaatagtaatgccatctatttaggatatatatatacacatacatacatacgcacacatatataaatacgtgtacacacatccatgcatatatatattatattatatatacgcattttacctaaaaagaggaatattttctactctctaattccaaatttcacctcctttgagaatacatcgcttaaatacataactgttttctcatctgtaaaataaggcaggtgaattaaataatgtctaatatcccttaaatggcctgaaaattttagattgattacttttaagtaaaggtggccagtttggtttcatacatgtatatatatgtacatatgtaagtgtgtgttgtgtgtgtgtgtgtgtgtgtgtgtgtataaagtaaaactgggccttagccagttttacaaaattttgactaaattagttgatttgatattctggagatagttttagctgctggtcaagagattatcctttttcagaatctttctgtagacatttccttttttaagcttcttctagggaatcttatttgattcccacaacatgcctgtgcagtaggcatgtccagtactatttcacaggtatgcgaagaaagctgataatcatgcatggctattatgaggcagaaggtgggaccttctgtcctttgctatcaatgagctatttctattccacaaataattatatacatgtttctaaaaggattaatgcagaagactttacccattacaatttcacatctgggagcctaaattagtatttttaatttgattgagaatttcatgcccacttcctttatcttgccatcttcttggagttagaggagtataaaactacccaagaaagtgacaaaattgaacatgaaatgtttaccaagaaattataacattttatgagaaatgaatatatgtaagctttgtgtggcaggtagaactttgttcctaatttttacccagaacaaaccataagtaatactatcaggtaaataagaaatcaaaattataacttttcatctcttagtttacttttcattggtttttattcaaggctgcctttactggattattttaattctatttagaataagatattttggaagtgagttttttaaatttaatacaacccttaaattttaaacatattacagtattgcaatttttaggtaaaaaacataaaagctggctcttaaatatttcttttcatgttcaatggtcactgtgtcttggcatagtatcagaaatatttgctgcaaatagctttggccttccaaaggtatttacctgagtaaatacctgggtaatatgtgcttattacctgggcaataagcacataaaatactctgcagttgcttatttccaggaaatgattatagcataagataatgagctctgttacaaaacgtcattagcatggtgcagatcatctatgatgttttgaaatgttgaactattcaccacccaaattgatatcaacattcacttacccagtatactataattgtctttatgacttgtagcaaaatgagttaaaaaccccctggaaaagtgtaagatatggagagagagatggaaggccttaagtaattatagaaaaatagaaaagacctagcaggtaaatcccattatgcaaggtaaacataacaatattaatagtaatttgggacttgtaagaagcctgaaggaaagaaactacaaccatgaccatggaggttttctgtggttcaacattttatataaatacagtcagagtgatttgtgtggctggtgtaaatgtcaaagaaaactagctttttagccacagcaagaaataaggaaaacaggccttctaaaaaaactaacagtatcttaatggagagctctgaaatggaaagttatattattgtcaccatggttaagcagaaaaatcagaattattattactattttcgattttaaaatcataagatttctgggttggaagaaacctaaacatttttttgattcagctccctacttgatatgtgaaaggcttccttgatatttctgccacctgtttctacagccgccaaagaattctgcttgattcattactttctagaagagaccatccaccagaaatttctttctctctctctttttatctatatcattttaatgcaaaagaaaacacaaaaacacataaaaatatagaccttaacgagtatatgagtttcttatgctacattgacaaatgaccataacttgatggctttaaatgacacatatttattctcttacagttctggatgtcaaacgtcgatcagtttcactaggtgtaagacaatgtatggacaggttttcactccctctggagactctagggaagaatccgtttccatgaccttttccagctcctgggcctgaattccttggtgctgagcaccctcctccgtctttaaagccagcagtagcattttgcctcagtggtaacattgccttcttcttcctttgcttccaaggacacttgctttcattgagggcccacctgaataatctaggataatctcccatatcagggtccttaacttaatcacatctacaaagttcattttgccatagcaggtaacattcacagatactagatattaggacctgaatatcttcagggccatttttcagcctaccacgataagtacataagcaaggtcaagaataaaacttgtaacgtaacccctgaaagcccttcaagtgtcttgttcctatctcagccccttcccttcccacaaaagtaatcactatcctatcctgagttttatagtcatcacttccttttattttattatagtttttttaaataaatgtgtatacttagttactacaatttagtcttgctcatttacccataaaaaaattatggatgaatttttaagtctgtactccaaagttcctccttcattttatttttcctacaatttattagttgaagatgccagggcatttgatgtacatggttttccagtgtctggattttgaagattgcatagtcttggagaagttcatcatgttttttctgccctttgcattttgtgcaaattggctactggatcccgagacttaatcagactcaggttctatccctatggcacctataagtgatgtattgttcattgcaagatacataatgtttgtttctgtctctttttgtgatgttagcaactgttgacgttcattacctaaatttattaatcactgggggctgaaaaacagtgatttgtaattttgttgtttttcttctcttttttcattcagtaggtgggatatgtataaagtaatgctttctcttatctcttatttggttaccagtgttacaatttgtttaggaaaagtagtataaatgcttgattatttctctttatttagcagctttcagagtaaataattggtgtcctattgaaaaaaattataaacacatgtactcaaacatatttaatggatttcaatcagttgcaattataatcctttttgaagcccaaattgtcccatttttttcagtgggaacctcttcgggttggcttctgaaatctttttgaatacctcgtagttctagataatatcctttctattcggtgtgacaaaatattccatgttcattttaaatattttctggctgaagcctagaatcagattacaacctgggcactcaaggtgccttccagggttggccattcttcctaggccaacatcatctgcctacataagtacggagctggggatgcagacacacatagacctcattgtgtatttgtctgtgtgtgtgtgtgtgtgtgtgtgtgtgtgtgtgtgtgtgtgtgaatttatgtctattttgggaataccctgtcacctagtttttctgtaaatgtccctgaatttttagttttgtcatgtagttgctctgtttgttgttgttgttgttgttgttgtttatgtgatcatttggagaggttaaaaaaattctaccatctctgttaacttaaagtccatttgacatggcaatcaaccagtgttcctcagtaccctagccaattgctacccgaagaaccactctgttaggtggcatatatatggcatatggaaatttaaagatacaaagtatcttttagaaaatagacctttttccacttctctattctttccatgacattctgtttcattcattcaatgattggagagagtcccattcaccctttccttactacccatctttatgtaggcagttcacaaacatcaaagaaaatcaagtcctgcgtttcacagaaaagtttacactgactgttggtttatgttatatactaggctcgactctgaatatactgtgcctgtatctaatattcaattccatactcaaaatgagatttggcactcttgagaaagtattgccaagaatggtctaaaagtccagaagaaagttcccaagcaggacttaggtattttggagtagctatgtctgtgcacacaatgattaatgttttcttcttttttttttgagacggagtctggctctgtcgcccaggctggagtgcagtggcgcgatctcagctcactgccatctccgcctcctgggttcatgcctcagcctcccgagtagctgggactgcaggcgcccaccactacgcccggctaattttttgtatttttagtagagacgggttttcacggtgttagccaggatggtctcgatctcctgacctcgtgatccgcctgcctcggcctcccaaagtgcttggattacaggcgtgagccaccgcacctggcccacaatgattaatattttctaacatagagaagggcagtattttattcaagggaagatataaaaataaaatcttctttttcagtggctctgtcttattcaatttgcagctgcaaggatgatgatatttagctatcttcccaaagtaaatgatctgaactagacacatttttttaggatctctttcacagagtaaaatattggaagttttgataaagttctattttattattaggtgttagacttaatatgtgggcaataatatgtgtttcatatacactctggttatcttttgaaatatttattcttttagaatagtatttgcttgtcttattgtctaattcagtagtagttcttaatcctggcttggcagtagaactacctagattttcagcaatgctgatgtcctagttctggtctcttacttcatagatctagacttgggcccagtatccaagatttttaagagctcgcccattgtttttaatatgtagcctagtcctgtctagttagttcataaacttatgatatccattaagtttagctggttcctattagcacaaatactaggaatatttcctttaaagcatagttaaaaagaaaccagcatgaacaatgaaaacaaaataaattacatacattaatgccagttctattgagcctggtgtcaacgtgtaaatttaaccaaaagaacaaaacagagattaaaaccacagatccagaacttgaactaggatccctaatggagattaatattttcttcagcagtctgccagctgaatcattgtctaattaaatagttcaaatttagtgagtttgcatttaaagtattagcagatccgagaatgggtaaagctaaaatgagttagaatcttttctataaatgggaagttaaattatcatagtaatttgattaaatcatttttaaatctctcatgctaaatcacagccttgaaagaatagtttgaaatcttaattgctgtttgtgagcatatctctctgctatttgttcttgtctcatttcccatgacatcctataatatatctcctgctgggcaagagtagtgggaaaggcaagactatgggtagggccgaggtaactgtgcagctgacttcaagcacttaaagatatgccatgtagaaaaaggaaatttatcctgtattgttctagtaattagaaacaggaccaaatgatagaatttggagacagatttaggaaaatttaaagaggaaattcataataattagttttgcctcttatcaaggagaatactctacatacttttcatacaactggcaatgtcttcattaagaatgttgtaaagaagacagctgatgaagataggagtttgaataggatgtgtttagaggacaattcatcccaatttttaagggaatgcaaatttagtgttctacattctagcagcattattgatttgaagaatcctgaatttaaacctgtgtctgacacatattaccagtgccacgtgtcttctagggtttggggaggtaaaatgaggccatgttcacctgaaataggtgcttaataaatggtaaatgtattatttttattctggtgtgtttttggtctagttggaaaatagttatttcgtttgttttgtcactgcagagtgtaattcccattttctccttccatctattactctgttttcatgtagagagctaattattagacccaggataagttgggaaaatccaactcatctctgttcccttatgcacaaggtccatattgcagtcttttgtgtatctagagactcaccatagtgtttccccatacctcccatttttccttcaggtagcatttaagtgcaaaaatagagagaaagaatatcagatcatgttgccatcatctctatgaatgtttttctgtccctaagattaccaacccctagacaactttagaaattatgtgtgtttgtttctaagagacagcaccataggaggtggatgagattgccatgctgagaggaaccagactggagagaagctgggtagaaacaatccacagggaaaggccaggcgtatgttggggagtgacttgagtcccgctccagggaaccactatcaatgctatttcccacttggaaaaattccttctttttgctctgccaggcagaaattgagtcttgagcagtaaatacttataagcaactttattccagattattcaaaaattttttaaagaggtgtcattaaactacctaatgtaaatagtggtcagttcaccagtgatatggtggaatgattcaaaatgacaatgtaagtgaaaaaaacactaaacaaaatacaaataaatttttaagacatgctactggttatcttttaattagtttgccatatttcatttttattatatatttagccacttcattttaaattacattccctctctttttgttcatgtgatctatgtttgaattgtatgaaagattaggctaactacatatatcttagagctcagcattctcagagaactagaattattaaacatgaagaatcccccaaagactccattatgtgtaattaacagataaactgtcatcagaatcaataaaacgtgctaaatgattcaaacttgtatataattaagtgtctgctttagagctggagctgtaacttttattttttccccacatctcacatttctcacaagaataatttggcaaccttgttaaccctttctttgcttgattgaattagattttcaaattattcatttaagggcaaagttcacctttacaaatgcgaaaaatatttcagaactcagtgatctgaagacaccatttgtttttcatcagggaagtagactctgtaaggatgctttaatcaactgatactagaacattaaacatcctgaaaggataaataatttattgtgatttctgtatagtgctagattcaatgtagtcacatggagttcttagaatcttagtcaacaattttttcccctgtttgggaaatattggcttttccaggcaagatcagaattttaaacaaccttcccccacacagcactaagataatactttcaatagatggccttccgtggttgtttattgagtgaatgaatatatacctggatgagacaatgaataaaatagtcaagactgtaatctgttaaaagaaagccttctcttgctcagcctgagaaagaaaaatacacattttaaatcatagatcttttctaataattcccattttctaagctagtattagaaattatgtagggaaatttggaaagaaatagagattgtagaaatgcaagactctgaacaaatcataggttcaagctcagagaagttcaaaaataattaaattaataactaattttataactctagtctacataggtttgctattattattataattactcatatcttttgcttcattgcacagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccataccgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtagatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttctta

SEQ ID NO: 13876 - DNA, 36171 bp, Human
tcccctgggcgtttagggtgtcgcctctggcatgtgctcccactgcagaaaacaagtccaaatgcaacgcatcgggtttctgaacagccgccagagcgcggaaaccagaccgtcagcaaagctgtcgcgggaacaggggctctgagagggcggcgcggggggcggggtgccggagtgggggtcgaggcgggagggggagtgggggtcgaggcgtgggggagggtggcggggcacaggccaggtggccgatgttgcgcgttccggggcccctcggcaggcggcgggtcgggaggagtggaggcccgggtggggcgggcgcgcggggcgggagcagccccggtcgccgcctgggcgcgggcgccctccctgtggagcatgcgggacgtgagcgacgtgtggcagcctctgcgcagacttttccgccgcggtgtaggtttcagcgagcgccgccttccctccaatcacagcccagcctcagcgctaagtgtgcacctctctgcaaggcggcgcagcgctcctgtactgaggcttcgtttgcaaaagttacatccgtcccggcgcgggcggcggttccccaccaaaagcaacccagatcttccccgcacgcctctgacctgactgcacgactgtcacaagtcgcgagctggtgcaaactgcgagggccgggaaaggagacggggcacgcatgcaccaaaaagtggggaggcagagctgcagggtgtgcaggataacggagtgaattttaggagtctgcctaataaggggccgcccccaatagttttccctcgacttaggtaatgaattgcagatcgaaatgggtctagttttattcattcttctactcggggcgataaaggtttattgaatggtgtacatggtgagtgtgaaaaccagatgccagctgcccccagccccagtccacttcagtccagctccccggggctttcccgccccctcctcgtacccagcaccgcgggcctctcaaggttcccagtctttgggctaggggaggggagcaaggctcagttcaagtccaggtttctaagggattcaggaaagtggacaaggacgaggtgaggtgggaggatcagggaagcctcctccccgcgggtcgcccgggtcgtggcgggggatgggctcacgggtattatcagggagcagcctggcccatgtccttacctggactgcgcctgccccacagcgcgtgttaggaatgcagagtattggggctccatggccctaaaggagctgcattggtaggatgcactttaagcagcttcccaagggattcggctgcggggtccacggtctacactgggcaggactgcgtctctgctctcctcccggccagcacagttgaggtgaggggccggaattagtcggggaagctgtgccagacgtcccgaggggacaacgggacgaggggataacagcagccaggacccttcagcagggctgggcgcgctccaggcccggggcagggcggcgggagctggtgcaccgccgtcgccggcccgcagggggagctcgcaggctgcttcccggctcgcccaccctcctccccacgtggaagggggctgggacccaaggaatgcggcccgccccgaggctgacgtacgcgtctgcggccagcccggactctttaaaagccggcggtgcgcggggcatcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatgtgagtgcagctgcgcggagccgggttgcagggcgggctgcgccgggccgggccattgtgtggggcggctttgtgccgacgcccctctgcggggggcgcgcccgtgcgggtcgcgccggcggggcggggcggaggcgcgggctgcgcgtccttggccgggcggcgggggcgctgtggcccttgtcccggtggctgccccgccggcccggaaacggcgagtgcgcccggccgggctgcgtaccccgagacggagggacgcgcgcgcctgggcaggccagggaggggatccacatcctccgcgatccctgtcctcgacacccgtctcgggcggccgtcgccggagcgcagcccagggacccggccgctcgcgcctccgccccttttcaccgtccggatctcctctctctgcatgtttccatctcctctcccgccttgctatgcattcctatcccctcgcttcacttaataacctatttctctgtcctgttttctctttcgatatatatgtctctgtttttctctgtttctacctccttcctctcccactgtttctttctgcttttatctctttctctctccttctctctcttccgtgcatctccagtgccatgggggcgcccgtgctgggggcgccaggagagccacctggagccacgcctgtgtccccggctttggggagggtcggtgggttggtgagtgcacggttggcgctgctccacgcgccccgggcgcacgcactccccggtgctcggaattggctggcagtaccctgccccgccccgccggtcgccgcccccgccaccagcgatcgcttgggagagggttacctcgagctccacctcagctgcggagcgccgccgcggaaaagggcgggtgggcagcgcagaggggcgacgctgcctctccaggtaatgcgccccggctcccatgggctggacagggagccgcctggtgcggttttgcccaggtcaggtcgtagcctgagtagtgaccgtgggatccaggtgcaaactctcgaggtggcttcgggtcatccgaaggcgcctgagcgcaggcggctggcaggcagggttgcccggctactatgtttcttaggacggcccccgcgggacttggcagctctcctggagccctgctcggtctgaatcaccggcctcgtccagacctgcccctctccccacacccacccccatggtgtgccctgggtggggacgtcagcagatccaccctggtggacttcagggttctggggtagccctcaggagaggtcttgttccccctctttgtgaggtagcccaggactgggggatgtgggtgtgttgcccagcccagtcagatgcgcttgaactggggtggcccatggttctcttgtctttgtgtaaaacctgtaagtggagtggaatgcagctcttaaatccccagggaggtttggccaaggccaaatgcagaaacaacttttgcataaagcaagtattatctctatagcactttgtaaactgcattggaggctagtcccacatatgtaaatacatgtgattgtatacgaatgcccacgggtctgagaggagtgtcccgtgacttccagggctctgagatctgttggcatcagctcagttgtgatcttgagaactccagcgtgcaccaaggcgtcctccctccaggcttggatcctgatccattagaccccatcaacctgcacgtctcacacgcagtgagagatttgcctaagaatccctgtcagaatcattcagagctggagggtgggaatttggctaaagccaatggattaattcttttgtcccgcctactgctggtatcctcctgtgtggctttgaggtatagtctcagacacattccttcttgtaaaaagatccgcagcctgggtatcgcacatccttatttcaagtggtggtgtctttctcagtttatatagtcacatttaactcttactggaatggagggaagaaggtgtttctatttggtatctttcctgacaccctccctcgattctctaatggcatttgggacattgggtgggtttttctttcttccttttttttttttttttttttttttgacatggcgtttcactctgtcaccgaggctggagtgcagtggtgcgatctcggctcactgcaacttctgcctccgggtttcaagcgattctcgtgcctcagtctcccgagaagctgggattacaggcgcacgccgccatgcccagctaattttcatatttttagtaaagacggggtttcaccatgttggccaggctggtcttgaactcctgacctcaagtgatccgcccacctcagcctcccaaagtgctgggattataggcatgagccaccacgcccagctgggtgggttttctttctcctaaacttgttgccacctttataagtggccttctcattggaggtctgcagcagagttccctgaggtttattatttatttatttatttatttatttattcatttttgaggtggagtctcacactgtcacccaggctggagggcagtggtgcgaccatagctcactgtaaccaccaactcttgggctcaagtgatgctcccgcctcagcctgtccagtagccgggactataagtgtgcaccaccacacccggctaattaaaaaaaatttttttttttttttaattgatcattcttgggtgtttctcgcagagggggatttggcagggtcataggacaatagtggagggaaggtcagcagataaacaagtgaacaaaggtctctggttttcctaggcagagtgtttgtgtccctgggtacttgagattagggagtggtgatgactctcaacgagcatgctgccttcaagcatctgttcaacaaagcacatcttgcaccgcccttaatccatccaaccctgagtggacacagcacatgtttcagagagcacagggttgggggtaaggtcatagatcaacaggatcccaaggcataagaatttttcttagtacagaacaaaatgaaaagtctcccatgtctacttctttctacacagacacagcaaccatccgatttctcaatctttccccgcccctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcagggggctgacccccccacctccctcccggacggggtggctgccgggcggagacgctcctcacatcccagatggggcggcggggcagagacgctccccacatctcagacgatgggcggccgggcagagatgctcctcactgcctagatgggatggcggccaggaagaggcgctcctcactttccagactgggcagccaggcagaggggctcctcacatcccagacgatgggcggccaggcagagacactcctcactttccagactgggcagccaggcagaggggctcctcacatcccagacgatgggtggccaggcagagacgctcctcacttcccagacggggtggcggccgggcagaggctgcaatctcggcactttgggaggccaaggcaggcggctgggaggtggaagttgtagcgagccgagatcacgccactgcaccccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcctcctgcaatcgcaggcactcggcaggctgaggcaggagaatcaggcagggaggttgcagtgagccgagatggcagcagtacagtccagctttggctcggcatcagagggagaccgtggggagagggagagggagagggagctggagcttaaaaaaattttttcatagagatggggtcttgctatgttgctcaggctgatctcgaactcctggcctcaagtgatcctcccaccttggcctcccaaagtgctgaggttacaggcatgtgctaccattcccagcctccctgaggtttattgctgaagagggtgtctaggacgctgctttttatagacaaagaacagtaaaacaacaaaacaaaaattactatatcaataagctgcattatattcttgccttggaggcaccttaacgggatgccctgttgctacatcaacatgatggtaaatgcttcttacaaaacctgtagcttccttcgcatgcatcctgtaactcctgctgacttactgaatttgtgagtcagcataatggtcaagaagtacctttttgactggcaaggtctagctttcctttctgttcatcgtcactaaaattcaagagcctgtgtgttctgagggatcctgggtaccgggctgagtcctaagatggtgcttgggacttggcattacatcagaagttgccatgatcagtggagcaaaggagggggtattagtactggtcaggccagtgcaggtttgtaagcaacaggtaaaagacagccttttaaagcaccaaactttgttttttgagacagggtctcactgtcacccaggctggagtgcaatggtgcaatcacgtctcattgaagccttgaactcctgggctcaagcaatcctgtctcagcctcctgagtagctgggactaggggcatgtgctactgcgcccagctaatttttaaaaatatttttgcacaaacggggtctctctatgttgcccaagctggtctcgaattcctggcctcaagcaatgcccccttggcctcccaaagtgctgggattacaggtgtaagccagggtacctggccttttttttttttttttttttttgcctcttaaaaacagtggaatgagacaaactgccagcttgtctttgctcaggatttagacaccatgggaaattgagtctgaagaaaggttgatgtggcactcaaatacggatagaaagactttcatctcagtagcgagttacgccggctgctggtgttctagcttaaggaagctgggtgggtgatgtcctagagaaatccctgccttatccctgggtagcccctacagtttatttactggggatgcattctgtgttagggtttgagtcagtgggggatacaggctgtgcgggctgctgcctgtctgtctgtgcattgcacaccatcagagaggttagtaacttaatctatccgggagagcaggagtaggaacccgggggtgccagcctctcactgtccaggtgggggattcaccatccatctggctgctgctttccataactggctccttgtgtcactgtatcccacggctgagtgttcaccagccagccttcagttttcttttggcttcctgtgtatgtttgcctgcagggaacgggccccagtaggcagtctccgttgtacactaatggtactgcgggcttgtagacagccagggcttagcccaaaggcactactcagccacattgaccctgtatcccccaagtagcctctgtctcacgggtacccagtgcatgtacctggtgcatgtgcccagtgagcgagcgtgtcatgaacgtagcaaccttgcagaattgaagttccgtgcctgggacttggtgactttctgggaggacttacccacgtggccatggttgtaaccatgacaacactttgagctcgagtcccccagattcaattcgggtgtttagtctgttacccagggtctttacacagttgttccttcccctgtaacccggtgacatctgtgttcccccaggcatgtttcagttgacctctaaagtccacatctaaacacatttaagtttcacaactttcaaaaactttaggtgtgtgaaaaagaagttaaaatattgaacatttacataaaatgaaatgagacacaaatactctttggaaaatcttgtgttaaactcaataattttttttttgtttttttgagacagagttttgctctgtttcccaggctggagtgcattggtacaatctcggctcactgcaacctctgcctcccaggttcaagcgattctcctacctcagcagatgggattacaggtgcctgctaccacgcctggctaatttttgtatttttagtatagacggggttttgccatgttgaccaggctggtttcgaactcctgacctcaggtggtctgccctcctctgctgcccaaagtgctgggagaccatgcccagccaatacttaccttttctttttttttttttttttttgagacggtgtctcactctgtcacccagactggagtgcagtggcgtgaccttggctcactgcaagctgcgcctcccaggttcacgccattctcctggcttagcctcctgagtagctgggactacaggcgcctgccatcacgcctggctaatgttttgtatttttaatagagatggggtttcgctgtggtctcgatctcctgacctcgtgatccgcccgcctcggcctcccaaagtgctgggattacaggcgtgagccaccgtgcccggcctaatacttatcttttctaatcactgtgccttgccagggagggtgatgaggcgggtggggggtgtctcttttttggtggtaaaaaggcccattgagaagagaagaagaaactgagggtcacagaattagaaacatgagatgtgctgtgagtttttaaaaggggctgaggttggagaataagacaaaaagatttagtaaggatttgtgattaccccatctgtccaagacagtggtgggtgtctgaagggagggacaggtgcaaacacctcaggcgcccctctctttgtttttttttgtttttttttgtttttttgttttttttttttttgagacgaagtttcgctctgtcacccaggctggagtgcagtggcgctatctcggctcactgcaagctccgcctcccgggttcacgccattctcctgcctcagcctcccgagtagctgggactacaggcgcccgccaacatggccggctaattttttgtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccgtgttagccaggatagtcttgatctcctgacctcatgatccacccgcctcggcctcccagagggctgggattacaggcgtgagccaccgtgcccggtgcgcccctctcttgttctgcagtcaaatgctctacccctgagctatatccccagttatagcgcccctctctttgaatcttactatgcgacagagcagtgcatagggagaatggctctgctttgccaagaagggactggcagtttatttgggtttgaaatccagtctgaccttttgccctgtgtatttactctgctgtctttattgttattgttattttccctccctaaatgtctactgccagaggacatttgttcctatgattagtgggtagacataatcccctgttggataaatcaatcagcctctgcttccttggcgtggttccgacagaaatattctgcgtatgtgcacagctgagagtatgtgtgtgcgtctgtctctgcatatctgggtgctcttaggagcagcggtgcggtggggacacctggtaagaccaggagggacccttggcctaggggaagggtcagtggatgggtattgtttccaaggagttgctgctactttcctgatatggcagctacagctgccagaatgaccctgggcacggtggggtgtgcctcactggctttcggggaggccaccatctctccgtgtgcccctggggacacaagaaagcccctgggtgcttggtgctttgtgcttgtttgttccactcatgtgctcaggatgcccggctcaccctgggcagtgaaaagcatctgttttcgaggaactgtttgttctaggtcactggacatcaagagcatggcagcccagggcttttagcgtctcctcatctgctgatagcctgtctgtctccttactctgcctgctgagaaggccactaatggtctccaaatagcatggaggggacaaaggcccggcatgccatgcctgcttccctgcccccacctccaggcctagcggcagatcctggacattgacttcagtttggagccctgctgggggctccggcttacagaggggcttctttcctgagctgcggcccgtctgaggggtggtggctcccgcagcataagcctgctcagctcggacatcagggcctctgtccagtctgacatctgcctggttctgtgtgcggctttcagaggttttcctgcaggccatgtgggctgtgtctgggaatgatgaggacagccaggctaaccacgtggcagtgagtgctgggccgtgccgcccaggcgggagctggcgggtatcatctggccctggagcttgcatgtcggcaggatgcgggagttgcctgagactcccagggccaggcgacagccggggagatactgggccctcggctcccagaacagggggcttctggctgctttctgaaaaacccagcaaaaccccccttcctgctgttttgtcttactgagatgccaagaccgtcatgtagcagcggaagccaggagggagctggcaggcaagagcatctccaggtttcctggagacagtggtggagccggcccctggctgaggcttcgtgaccggcccttccctcggcagggccccagcattcatccgagcctggcaccagaagagggggtcagacagggcgtgagaggctcgggtggaggatttacctgtccactggggtaattttagcattctgcctccctgacctactttcatttgataaactcttttcttctaattattttttaatttatttgtttgtagaggcagggccttgctatgttgcccaggctggtctcaaactcatggtctcaagtgatcctcttgcctcggcctcccaaagggctgggatcacaggcatgaaccaccgcgcctggctgtaaactcctacttttaaaaattgcctttttaaagattttttttagaaactctgcccatacctctgtgtggaggtttggatattgatggtgggcctctctgtctcttgacccctgggccccagcccctgcccctctgtccccatgttgtattggaatccaccctcttgactcttagccccactctccctcgggagaggaatcctttcctcccacccgcaggagcatttccactttcactgtggtgtcagtcactggttccctgctaggtttagcgccctgggtatcagctcaggaatttggggttgggactgtctttgccaagtagaacctaaaggcaggactgagggacagggtgtggctggggggctgtggccactagggttgcctggtcccactgtggtacaatgccaggggcttcaggatggggagatgaaatgaaaatttcgatgaatgctgggtgtggtagctatgcctgtaatcccagcactctgggaggattgtttgagaccaggactttgagaccagcctgggcaacacagcgagaccccatctctacaaagataaaaaattagccagggatggtggtgtacacacttgtagtcccagctattggggaggctaaggccggaggattgtttaagtctagaggtttgaggctgcagtaatcatggtggccaccgtgctcccgcctgggcaacagagtgagaccctgtctcaaaaacatttttggtgaaattcttcagtgttattgttgggtgtggcctctgctcctcttctccggtcacttggttgatgacacacccttcttgcttgtttttccagcctgtgggccaaagctgaccaactcccccaccgtcatcgtcatggtgggcctccccgcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtcccctggtcggggagtctgatcctgcctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttaggaacctggctgcaggaggtgagtggcagtgagtgcgcattcctgcctgagctccgcctccagtctgatcagtggtggcattagattcccatgggagtgaaccctattgtgaactgggcatgtgatggatctaggttgtgtgctccttatgataatctaatgcctgatgatctgaggtggaacagtttcatcccaaagccgtacacccacaacctccctgtccgtggcaaaattgtcttccacgaaagtggtccctggtgccaaaaaggatggggactgctgttgtggatgacacatttaagaatctctgcttggtcttcccaactagatggggaacatcttgtggataggcactgggtattttttttttttcaattaattttattttagattcgggtacatgtgcatgtttgttacctgagtatattgcatattgattggggattgggcttctagtgaacctgttacccagacagtgaacattgtacccaactggttattttttaacccttgctcatctcccaccctcccctcttttgaaaggatggtttttatgtttaccatccccgctgtgcccagctcagtgcccaggaaccatgggacacatgtctccggccctggccctggcggctgcaccagcagaagggttgacctagatctggcggtgggcatgaggccccactcgctttctgataccattggtggaaatgtgttgtccctatttttgctagacttggggcctccccccacccatcctcacagtctcagtctctggtttaggatattgtgggactgagattgtagacttggctggaggggacagtgtcgcagagcatgcggcaggggcattgcagctggactggggaagccgggcagcctgtgccctgctgtcctcaggagttgagggtagcgtaggactgggcgccggcattgcttccacaccatctcattcaagtcggtgtggttggcctggtggctcttcctttggtcgatcctatggtcccggtgtgagctggccccttcctcctgctcgatcatccagactgttctctttcccgtccacagtgttcaacgtcggggagtatcgccgggaggctgtgaagcagtacagctcctacaacttcttccgccccgacaatgaggaagccatgaaagtccggaagtaaggctgggccgcgggcgtagggctgggctgtgggaataaggctgggccgcgggcataaggctgggctgcaggagtaaggctgggccgcgggcgtagggctgggctgtgggaataaggctgggctgcggggctgcgggtgtaaggctgggctgcgggcttgggcttgctttgttctgagccaggctctgtaggaggcagagaaagccggcctgcgggtgggtcctgctggtggcttcagggctgtgcagtgtgggaacaaggttgctgctctcatctgtcccctgagggtctcgctgagctgaccctcactgggacagagccgcagaagcaccctcactgagaattagcaagtcctgttcatcgggagtgtctgtttatgtttggaaaggatttcttgttaagtgcgagttgattgtgaaaccctagtgcaagggtgttcagccccggctgtatgctggagtctcctgggggatgctaaaatccctgatgccaggccccaccccagaccagttagtgcaactctgtgggtggctctgggcagccatttcttagcagctccccaggagtggttcccgcgtgcagcccggtgcgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgtgtcgggagttgcttgggctgccccagcggatgcaccagcgctgacattcgggcaatgtcttgtgcattccaggcaatgtgccttagctgccttgagagatgtcaaaagctacctggcgaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggcggatgtggggcggactcagggacccaccccctctgtggccagtcccacacctccagggcgggcaggactcgagttacccacaggaccactggcccttccttgtacactgtcccattgcacattactgttttgcttgtttgcttttggggtatttcccccacgctaccacccctgagtgctgttggtagttgcgggaggcctgcctcctaagcactccctggagaggactgtgggcaggcacaagctcccctgaagcacttttggggcttattcctggagatgatgggtctggcatctttgctgttctggtaaacgttgttaaactcaaacttagagttttcttcctggccctttgctctccatatcaggttttcgatgccaccaatactactagagagaggagacacatgatccttcattttgccaaagaaaatgactttaaggtgagctgagcgtcttgtgttgtgctagagggctcgggagagaggaaaaggcctcaggaagcggcctgagtcctgcttggtccttcccctcctgctgccatgttccttagtcctgctcggtccctcccctcctgctgcccacgttttgtggccttaaatttgggcctttgtgtggtagggctcttgggggccgtggggcgttccagaggctgcagtgaggaggtgggctttcctgtgtttgggagttggtgggtggcgtgcttccgccttgtccgggtgatgacatcgcagtgatggcaaggttgatccttcgtggtgtttgttttctaacatccccacctcacttccaccaggcgtttttcatcgagtcggtgtgcgacgaccctacagttgtggcctccaatatcatggtaagacagccgggagccccgtgcttctgcggcagcgtagaccacaagggcatttgcagtctgaggaagtgggggaccgggtccggctcggaagcgcagctgagcccttaggatgagcagcccccagctggctgttgattgggaggtcagacctacagagcggtttttaacccagaggcctgtcctgtgagggactagctccatccagggcagtgggcaggcttggatgggacgtaggaaataattcagggagataggattagtttctgttggtggcaggagcctgacagctagtggtgatggagctgctggggcagagggccgctcactgcccctaatgggacaggtggcagcaagtggatcacttgctgtgacagctccaggaggtaagaatgcttgggcattggcaaaagtccatagggctcagcagcctcctgagtttgggaggtaagactctcctcctgctgatgcatctcgtgaacctgccacaaaccctcctgtctgtgctgtgcaggggagcttgcccagataaattgagggcacttggcatcataacttgatgaatttctccagtgttaccacttgatagcaatatatataaacaggaatggttactatggagacttactacaagctgccaccctgtgttggagataatttcctcttcagcttaaacatatcagaatatgacaattctataaagaaaagcagttctgaaaacttaacactgggacgctgtggtgctggcatctttgcacctttagaggggatgctaagcatgtgttagccccgttatcttccccaaggtggtggaagtatttctagatatctttaggaaatgaattcctgtttcaggaagggctatttgaattgtgaaaagtcagtttagatttgtccagtgggagcaggaggctcagagtatgagggtttgccacctttctttggctgggcactccttgttccccttggtagacagcagggtgcagctgtgaagtcatttttcccagtgagtggtcaccaatgtgcttagcaaggagtttagcatttgtctggttgtccactagcagatagtcatttgccccaacccaccatgttcagaaatctctttctgatgaaatctcaaagcagcttggtagagccaggcatttgtgaacttagatttttttttttaaattgtggcaaaatatacataatgtaaaatttaccatcttaatcatttttattatttatttatttatttatttatttatttattgaaacggactctccttctgttgcccaggctggaatgcagtgacacggtcttggctcactgcaacctctgcctcccaggttcaagcgattctcctgcctcagcctcccgaatagctgggattacaggtgtgcgccaccacgcccagctaattttttttgtatttttagaggagacgggggtttcactgtgttggccaggctggtctcaaactcctgacctcaagtgatctgcttgccttggcctcccaaagtgctgggattacaggcgtgagccactgcatccggccattttagctattttttaagtgtgcagtacagcagcaaattatattcccattgttgggcaaccgccacactctatccgcaggactttctcatcttccccggctgaaactgtgccaggacacaggcacagctcccgactgactcgatctttgaagagtggctgcctctcagtgacggcagtggttgatgagaaaaagagcccaggcattcagaaatgctgagtttccctaaaatccacctggtttctggggcctgtgccactgtgggtgttggtagacctgtgttgttgcctaggagagcgagccctgcaaaggagccggcacagccctagttggagaagcagttaaccacggactggtcacactggggctgcctcaggcagtggggggtggaggagaaaccacacaaggccagaggcatctctgggaactcctgagcataccttagaaccagcagcctcctcccggcacggggagcattgcggatcctcacgtggagctcggttgagttcagcgccaggctgtctggcggtgactcgggcacgggacagatcctgacttgctggagcattcagaggtgttcattatggaatccctgtgggtttcctgtctctgtccttccggcttcagttctccatctccccagggaatcctccccatgtaacatcaggctgtgactcagcccccagcatctttctccctttctcttacacgctgggccggataatctttatactgagccttctgtgcgctccccttttgaaagccccaaatcctgcttaatctcagcagaaagccttccagcgtgatttatcagccacccctttgtggtgttgcaggaagttaaaatctccagcccggattacaaagactgcaactcggcagaagccatggacgacttcatgaagaggatcagttgctatgaagccagctaccagcccctcgaccccgacaaatgcgacaggtgattcccgtggctggccgtctctgcaagacccacatgagggttctcactgaattcttgatgttcccacaaaggatttgctcctggatacctttaaaaaaatttttttaagacagttttttttgtagagatgaggtctcgctatgttgcccgggctggtcttgagctcctggcctcaggtgatccacatacagccgctggatacctttatcaactctctttgaaaatatcttttaaaaacaatccttgatgacaaatcatattcagtgggaatattttgaacactgtgtagaagtacaggaagtcaacatagagttgagcctgattttgctactgtccctccgatagttcctttcttttttctttcctttctttccatttatttatttatttatttacttacttacttgcttgcctgcttgcttagagacagggtctccctttgtctcccaggctggagtgcagtggcatgatcatagctcactgcaggttcaaacttctgggctcaagtaatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctgggaggcaggccagcctcacagccagacaccagctgtgggagttgtcttacgcatatgctctgccccttagaaggattcagtctgtgccctggaggggcctacggtcccgccttgctgttctctggggatcacatcttcggagacgggccaggtgcatcctgctgtgggtggtggcctgagctgtggttctcggtggggtctctctgcagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaaggtgcggggtgtgctgccgcatgggccgttctggctgtagggcggttgcagggtctatagggtgggtggggagctgtgtgctgctgctgctgctgctgctgctgcttggtgtgcttgctgtgtgtgttatctgtgtgtgcgcctgcacgtctctatgcatatctgtgtgcatctctgtatggctctgtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgcgcggttgtgcactaggaagggaaggggcaggaagagctgagcctggtctctgggtagggtgtgtgcggctgtggctgtcccagtggcctggggcccccacggtgtaaccaggtagtgcacagccctacgtgggctgcctgctccagccctggctcttggaggagctgcgggcatctggaatcagtggtccccctccaccacctctcagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcggtgagtcctgggaggcgggcaggcagcctcaccctcgggcatggggcggcttcccaagaggccctagacacccctgtggtttgttcccctgagtgaccactgggtccccgcagggcgtctgtgaggagctgacctacgaggagatcagggacacctaccctgaggagtatgcgctgcgggagcaggacaagtactattaccgctaccccaccggggaggtgagcgcaggctggggcgggctgacggtccccagcacacatgaccactgctgtgcagggctgggccacccctccagggagttcacttccgtgtgggttctgggggctcctacaccctccaccttggaactgagtccccccaaactgaaccttctaacagcctggggtgaagtgcattttcccataagcagaagtgagatgtgtttccctagggacatagaactatatgggagaggaggaaggtggtgtgtgaaggtccactgggcagggtggtgggcaggctggcaggaggggtggctctatatcccctgggcagcgtctgtgcttccccgtgcacggtgcccgggtggctgtggctgaggacgctgttgcctcctctgccgatgggatcctcctgggcccggtgtgtcctccctgcccgtgccctgctgagcagtgtcgtgcctcaggcccctgcaggcccactgtcctctggcctcagactgagccttacacaccggggccctggttagcacagcagagagcccacaggagcaggagcttttctggtctttttctaaagtcacagccctcctgcttctttttacatttttaaattgatagaaaatacacataacctaaaattgaccactttcatcacgttaaagttatgatttagtgcatgttagtgtactcacagtgctgtgcagccatcaccacaaattccaggcctttccctcactgcacaaagaaacccagacctgttaggagccgctcccgcctgcccggcccagccccggcaccggcccgtctgcttcctgcatctggatctgcctattctgggcattccatgtcagtggagtcagatgccacacgtgccttttgcgcccagttctttcacacagcattgagttttccaggttcccccgtgtgggagcggagtggggagggcttcactctttttgtggctgagcaatagtccacgttaaaccctgctccttctcaaccactgctgatgatggatgattgattttgcgtggctctctggccggtctgatgcagtctgtggccagcggcagagcccctcccgagtgccctgagctcacgtgggcccggccctctgtgctcagtcctaccaggacctggtccagcgcttggagccagtgatcatggagctggagcggcaggagaatgtgctggtcatctgccaccaggccgtcctgcgctgcctgcttgcctacttcctggataagagtgcaggtacctcgggcaggtcgtggccccgggatggagggaggaggggactggcactcggcggggggtcagccgcagacctgccgtggcctgccctgtgttggctgctgtgccatggggtgttaggagaagggcacaggtgtcggctcccggctgcttcaggtcctctctgtccagcgcttccttgaagcccttgggaaatgctgtggagcccaggttgatgccggggacttcattgcttcataaacagctccctgagacccgcccctggctccacacatcccagggtcttggcttggggtgggggctgcacttctcttcagtgccctctaaggaacaaacagcccggaaaactctgacaatcccattgaaatgttaagtcttagcatgtccagtccagtgcagctgaatccctagacagacctaaattgtttgggagtgactttttcccaactctaagtcaccgtgagggcgagtcttttggtttggtttgatggcactctttgggctaaagtcttcttctggggccagctgctgcccgggacagcttgtggctggggacagatgcccctgcccgacagggcttccgagggtccttgttggggggaccgtaaaggtctttccatgcctcccccaccctcatgtctcatttcttttttttgagacaaagttttgctcttcttgcgcaggctgcagtgcaatgcatgcactcactgcaacctccacctcccaggttcaagcgattctcctgcctcagcctcctgagtagctgggattatacgcatgtgctaccacaccctggctaattttgtatttttagtagagatggggttttgccatgttggtcaggctggtcttgaactcctgacctcaggtgatccacctgcctcggcctcccaaagtgctgggattacaggcgtgagccaccacgcctggccgtgtctcatttctaactgtgggtgtacaatttcaatttcagaggagatgccctacctgaaatgccctcttcacaccgtcctgaaactgacgcctgtcgcttatggtgagtagcaacccctgccaagccctgtccccctgaaggtggccacagtagcttcttgtggccgtgggctgtaagcggtgctgtccctttaacagcagcttcctctgcccccatcccacgccctccaggctgccgtgtggaatccatctacctgaacgtggagtccgtctgcacacaccgggagaggtcagaggtgagtggaggccccaagcctcatcctggccatcatcacacgatagccctagtgggtgatgggcgctcaggaggccccggggccgcttgcctgcaggtgctggcctgtctggggccatgggcctgctggctgccttcctcagcacctctttgttcctgcctgtctgttctgtggcttctggggccttctcattttctttcttcctgtgtcctcttcctcccatttctgctgagctcgagatatgaatattagtgaggaagatacattctctctttttttttatttgagacagggtctcagtctgttccccaggctggagtgcggtggcgcagtcacggctcactgcagcctcaacctcctgggttcaagtgatcctcccgcctcagcctcccgcgtagctgagactacaggtgcgcaccaccatgcccagctaattttaatttattcatttttttagataatggggtctcactgtgttgcccaggctggtcttggaactcctgggctcaagtgatcctcctgccttagtctcccaaagtgctaggataaaggtgtgagccgttgtgcccagcgtctcttctctttaacatcagcatggcacagttcttgttgcctttcctttctggcagctaaaaccagtgctttcagtttccagagttactgtttcaaacaggatcagcaggtcagcgccgccatgtgcttgtgattaggctcagaaccaccaagaacacggtgttgagagacgggaggcgtggagagcagaggcctggggggtggcgggtggggaggcgcttcaggagacctcgaggcctggccgtgcagctgctgtctaccttggggggaggcctgacatttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagaccgagcgtgactttctgtcatggcgttcccgaaacaggtgactgtctagtcccaggaagcttggccttcggattttggcatgaagggatgaggtgtccgccccagtcgctggcagttgcctggctggtgggctgacctgagagaggctggggtcccttggccgccttggtccctgtcaccccctccacttcggaatgtgggtcaccggatgctgtcctgcctttagccatatgacaacagccctggtcagggagccactgcccccgctatgggattgggcctgagccggtcctggagctcttccctgcagggaatgggggcagggccatgatggagacagatcccggttctgaggctggaggcccacaccccatcacgctgtccctctcatgggagggctgtgtctggtcctggccgcagaacctgcttcctgctgcacattttctgcgcctttggtctccaggcttgttttgcagcctccgtgccccatcctaagccagggtgccctttgtgtagtagagatggctcttcagatcctgcctcgggtcagcggaagggagtcagcacagttgccttcccctccccagcctgtgagcctcaggcccagcctctccctcctagatgcccctcctcagctctcaagagaggctggaagcaaagctcttttctccgacctcacgctctgctgtgatcatcattctttccctccttgctttgcaagcaccgtgtttgtctgtgtggggaatcctttggtaccatccgaggaagggggcatgggagggaattgcccccattcttgctgcctggcagtcaccgcacactcagcagcccatggtccctggcccgtggtcccggccactcccctcggtcagtctttttgcctctctaaaatccaggagcagagaaacttttttggggctaattttcctccccttctttgtaactgtcgcctttctctcttttgtctttgtcttgcttaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaagtcagtgcactcccctttccttcctgcctgggggacgcatgccgggcgtgatgccacagatctgggattgcgtgcgtgtgtgtttgcaagaatacgtgcgtgggtgcgtgtgggtgcgcgtgcgtatgttgtaggtgtctgtgcacgtgtgttgtgggggcatgtgcacacactcacgtgttgagggagaacataggaagcaccctccgaagttaagatcctgggggctttccttgctggtgacaaccgtgactgcgttcgcctcctttctgaggatggggtctttacagggcagaagcaggcagtgcagaaggaagagtgagatgtccaagacccgttcacgttcgtgaatggttatttctaaaacaaagaaagtggctactttctcacataaataacatggttatcccagcaggtagtaaaaaacctaacaaacaaggccaggcgcggtggctcacgcctgtaatcccagcgctttgggaggccgaggtgggcggatcacctgaggacaagagttccagaccagcctggccaacatggcgaaaccctgtctttactaaaaatacagaaattagccaggtgtggaggcgggcgcctgtaatcccagcttctcaggaggctgaggcaggagaattgcttgaacccaggaggcggaggttgcagtgagccgagatggtgccactgcactccagcctgggtgacagagggagactccgtctcaaaaaaaaaaagcaaaaaaccccaacccgatttcacttatttcattaattttgaaggttacaggcctggaagattttggttgtcagacattaagatttgttttcagaaaactgtttgttttcagaaaactggtcttttcctttacagcctggaacccttgcaaatatgtgagatgtaggaatttctgtgcttaaattcaggtaccacccaagggtctgccctacctccaccctccaggcctgcccccacaaatcagcccagtgcagcttccggtcaggtttgttgatgagccggatgctggtgctggctctgagcatccttttcagcctgccacctcttcccgccttttccgagacttccttagacctcatgatgtctggaatgtgacctgggagatgctgcagcctccacaggtcacttaacctctccaggcctcagttttttcatccaggcaatgggggaataatggcagtgcagaagtcagatcagatgaggggattcatgccctgcatcaggcccagtgtcgggcatgtggtggggacgcgtagacacggtgaggtggctgtgattagcggaagcctggaggcctggctttggtggtagctccacactaacatgagtgcagcaatttaattgcccaggttccttcccctcccaggccctcagtctccttagctttgcacatgataggagcaggactgggagagctctcatacatattcccttgcaggtctcagatctgagggtttttatgaaaagccagcagaactgaaatggtgtccctgtggcatccgttctgatggaaatgtgcagttgtatttggaagttcagaggccgctgctttgatgcttggggggaccaggctggggaagggggttgatatcctgagctgcacagacctccgtcgtggaggacgcagtggcaggggctgcatcctcctgtccgcttcagagctgcccctggcgttgggaggacagtccttcagggtggccaggttcttagggacgtctgaagctgctggctgggccggcgtggggtttttcagggcttcgtccctgcagattgcgccctgcctcctgactgacttctctctctgcttctcctccgcagcctttgctagggcaagcctgtctgtaagtatctctccgatcatcgctgctgcttgcactgctttcttcctgcttgctcatttggcctcctgcctgttaaaatattgaggatgagagcagttttgtgatgtgaggtcttccgtgggggaaggaggagatgggcgtaggagtagggaggagagattcctgaatgtttttggaaaagcgtgcaggcggtcatggtggctgcactactgttgggtgtgttccgacaccgccgcacgaccgctggcttctcccctaccctctcagggctgcaggtcgtggtttgtaatggccgtggtttagggctcggcataaatccacatttccttatcagaatcagatcttggtggcgagctgcatctgtgccaggtgccattagccttaaagccccctcctgccccaggagtgtcctttgttttggaaggaaaacttactcagagcctaatctgtaaaccaaacctatggggaatagtgggagtgtggtggggcctgagctctgagcctctccctccccatgaggaccccccacaccccaaaagagctccaagtggagacccttggggatccgtttgtcctgggttggagcctgctcagcgtcatagtcacgcccggggctgggtgcagcctccatctctaacccatgtggtcacttctgctcctcccagagctctctgcagagtttcaggttcagccttagctctggcagccactgggtagctggggctgtgttcccactgctctgggatcccttccccaccaggagcagaggccttcctgccacagaactttaatgacagccacatgaagtgtcatccccttgcccccccaaaaacacacccgcccctttatttcctgtttgctccttaagttaccttaactactttatgcagaaactggaaaggtgtgatgaggaatgcagcctgagatgctgaaaagaatgactggctttggaaatgggagaggtttggcatggcgctcagattttggtggcaaaggggtgaagggccagaggatgtaccagtgtcctccatgtccacgttccttaagaccaccctgggaggtcggcagggcagtcagtcccccgtttaatggttgaggggctgagtgaccggcccgtgcttccagcaggtgagccgcagagccggggcctgaaaggccccttgcttcagaaagccggccgcctcctctctgcggcttctgggagtgggctgggtgcccgttccctgctgctgtcctgaggcccctgccctgtgacccgcaaggcatgggcagctgttggaccctcgtgtacccccacagccacccccttgcagctgcttcccacagccaggctttgcttacctaaggtgggcctgcccttaacttccagcttcttggggcgcaccctccatcctcagggccagtgtctgtgatgcgcggggccagcgtgcagtgcttcaggatctgggcttctccttgtgtgaaactttttggacttggagcctgaaggttttacatctgtgcatgtcctgatcctttagaccagcagtccccgacctttttggtaccagggacccgtttcgtggaagagaattttccccaccatggcagggtaggggatggtttggggataaaactgttctgcctcagatcgtctggcattagattctctgaagggaacgcacagcctagatccctcgtgtgtgctcctccgagtcaggtggtaatgttggcccacccaccacccacctcctgctgtgtggcccgcctctcagtgggctatggactgggtactggtccacagcccaggggttagggacccctgcgttagacacgtggcctcatgttgccaggaaagaaatctttctactgggaggagccattcggggatagtcccccacccgctaaagctgatcttacctatctccaagatgaacataatagtgcgtttgctagaatccctcctgttcagcaaaaatacatccgatggacccatcacacctgactcaggttggaatttcactctggagtcccattgtcccgtccatcctgggtgcgtgaccccacatctaggattgtagccacatctgattctaggagtccacctgggctctgtgaccagaatttatgatgaaagtcagaccaagccaggcctgcatcttggttctactcctcctggcctctatccttggcactctgggcaagttaaagcaattctaggacctcagcttcctcatctgtaatatggagataataacttcataaagttgtcataatgagactatagatacagcacttagcacaatatctggcccctaggaagtgcgtgggggatgacggctgctgttgttatcagggaggaacttggtgccctgggcctgtggagacttctgggcttgctggcattgggtcagcctttggataccctcctgtaacctgagggatttcttctctggggcagcaggaacacccagacttggggaggggaaatccctggggtctcaaggccatggcctgaagtctttttttttttttgagatggaattctgctcttgttgcccaggctggagtgcagtggcgcgatcttggctcactgcaacctccttctcccgggttcaagcgattctcctgcctcaacctcccgagtagctgggattacaggcgcccgccaccatgcccggctaatgtttgtatttttagtagagatggggtttcaccatgttggccaggctcgtctcaaactcctgacctcaggtgatccacccgccttggcctcccaaagtgctgggattacagatgtgagccaccacgcccagcctagagtcttcacccctgtgatcttggtttcccagtaagatggggacgaacaactgtccggacctggtgctctggggtgccttcctgggggctgtgccggctgcttgggatcgagagatcacctggcatttgtgatgcaaccttcatttttaaaatttcaaatgcacactagaaaatcctactaaagattttcttttttttttttccttttccaacctgtttcttcctctcccccactctgcttgaaagacgaactgtctgtcacattttctcaaagttttctccttactaactgtggaaggtaaatgcctgggtgcatgtccctctgtcccgcaccgcgtcacggcatctgggtctgtgtgcagactggccatcgtgcaatgcggggctcatctgtctccatgccgaggttgttaagtgcaacaccattgtcgtgaggtcctttctagtctgtctctcaccccccacgtgtcctgagctggggcccctgggtgaaggacgtggacatcacccggtcttgcaggctctccactgttattgttgcatcgccatcacctgtgggtgccggaagctgtgggctggtggtgttgaggacaggttggagccagcagatgcggagggaaatgtcagccctgctctgtgatcccacagcccggctggggctctccctagatatgaggacccagggctctctgaagagaattgccccctcccagtgggcacccatcacttccatcatccttcggcgggcacccatcaacccccgcaggcagccgtcatcccctggcaggcacctatcacctcctggtgggcactcatcacctcccggtgggcacccatcacctcctggcgggcacccatcacctctcggcgggcacccatcacctcccggtgggcacccatcacctgggttcctgagtctggcccacgcctgggcgatagctctgatgctgcccagccccgtgactttcctccctgtggatggctccagccttggacccccagttctgtgtggggtgggcatgggccacggtggccctgtgtgcctgggctctctcccaccctctttagagcagtccaggtggagacactcaggactggagagaatagttttaaacattgtgtgttttcttgttttttgaggcgtaggtgaagcaggtcacggaaggaggcccgctgtgcagtggctgcagtcagttgtgttcctcgctgattttggagcatgtttttttgcggggggtgggtggcgggggggtttggtactggccagtgccttaggggtggaactccctgcgagggccactgtgatcagaagtggggcagggctttaacaacacccctctgcctggctccccacctgggcctccccaccacgtccagccattccatgtatcacctgtgttctgcctgtcaagctctgttcccagaatctggatgcaggagctgggagtgtggctctgttttgagctgagtcgagaggaggggccctgtgtgtccttggaggccccgggctcatcctctgcctggctgtggtttgtgggatttctatggggtcgtgagcatgaggctcctgtagttactggtgcccagcgccgcgcagctcacggtcctccaggagccacacggcccccaccaggcgggctccaggcctggtgcccagccccttctctgagactctggggttatcttgcgtcatgttctgaggcccacctgggctctctcccgcctgtgaggttggcagcacctttcttggatcatgttctttgtctgggatggagggagggaagaattctccgttgcatggctcgcgtcttctgctttagaattcagccagctacaaatcctaactccctccccacctctcttttctcctgaaaacagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaacctctggtcttttcgtgggggaaagaagagtctttaattgatgtttacggcagatgcgccacggagctgccaactcaccacttcattatcttcctttcaacaggatgttcaagtacagagtgtctagtgcctgcatttggggagaatgagctgtctcaatttttcttctaattgataggcttcatgttttatttttatttttaatttaatttttttcttttttttctttttttttttttgagactgtttctcactctgtcgcccaggctggagtgcagtggcgcgatctcagctcactgcaacctcctcctaccaggttcaagcaattctcgtgccttagcctccctagtagctgggattacaggtgtgcaccaccatgcccagctaatttttgtatttttattagagacagcatttcaccatgttggccaggctgatcttgaactcctggcctcaggtgatctgcctgcgtcggcttcccaaagtgctgggattacaggcatgagccactgtgcctggccccacgtcggttttactcccttcattctataccccttccccgcgcccttttaaacaccagttcttgcctcattggcactacagaaggtatctttcatgttaggttcctttcacctgcccttccccatctcctggcttcttccatgtttctgcagggaataaaactcaagcttctgtgacttctttgccgctcattggctgccagaggttgagccggttatttcacttccagcctcagcgtctgcatctctgcagatggggcagggttcagggtggagcgtggcaaacaccatgcgtggaggaagccctggagtggttccttctgcagctggtatgcgtgaccagcgtcttgcttggtctgattttttttccggagccccccactgctgcgctccagaaatagccttgactccccagtgagtcttcatcccttaggcgcctgccgcccacgctgtgaagagaacaggcggcagagacttggcacctctgttgcgagatgactcccagggttgcgatctggctgcagcgtgacggggcagagcgttctggggaacctgaggccacctcctcaagctctgagccacgtttgatggcgtgagatgtgtcaggtgcagggatggagcagtggcgttgacggaaatctggcctagcctttcaggctgactacccagaaaattaaaagactgctcccaaagaggatgtctgtgtatcgtaaggtcctgggccggccgggctgtggggatccacaggggctctgaccttttgggccagctctgagattcatctgagagatgggctaggtccacagtcactgactaaatacagaagattcagtaaccgggtggatgctgtcggggagaggagggctggggccggagaggggtggacgttgtacacaccagtcgtttccattcgctgcctgggctcggttccttccacttctcactcccttagctccggccacactggcctcctgcaggtcttcgaacttgccaacgtgcacccaccgcagggccttcgagagtgccgctccctcccctgggaggtctccccagctatccggggttctccccgacacttcctccccatccccattcagttatcaaagcctatgccaaaaaggcctcccgtctcccgagtccctgcacacctttcgcagtgtgtgttgaatgccttgccctctgtctcctgaacctgggcctaagatcccggagagcagggcagctccctgtgccccgtcatcgtccatacggacctggcccgcagtgggctctgtcactaaatggataaccagtgctggggagaagacccagatgatgtgctggtgaagagtgaggcgttcattcagcttgcagaaggaggcttaggaaggctttatagaagaaaggaaatgtgagcaaagatgtcgttgaaagtaactttttttgaattaaaaatattgtattaacaaaaattcaaagccttctgtgagttttcaaaatc

SEQ ID NO: 13877 - DNA, 202111 bp, Human
  misc_feature (1)...(202111): n = A,T,C or G
cataagatgggagtgagacctcctcactaggtatttagagagcaaggtggtataataaatgtgaaagtagtgcctgaaagttgctaggaagttagtaaatgtaagactaatcttaatacatggagtcactagcctactcagaatcagtgccatgataataaaaaaggccgagctttctgtggcctataacatcttcactaatttctcccctctgctttaaaaacttgattgtttcagtgcacttacaggtttatattttctcttattttcaaagcacgaaaacatatttctccattgtaaaaagtttgatgatagaaatacttgggtggaagccaaaaaccaaaattcattcataatttcactgcctagagatatctaatgttaaaattctaatagatgaataaattttttataattagtatgataaatatacagatgttatgttttatcttagtcaatgtttataatatacataagtataagattttttctgaatgcctacatgttaataatgtgcaataaagaatctttaggtatcacttcttttctctatcaaaactatgctgtatatgaagaaaattttattttctagagaaaggtttattgttttctatttgctttatttccatttaccacctaaataatatgctcagagtattagcaacatttaagcaggcggcaatcagggaagaaaacatttatccctatgtcagccaaaaagcaacaacaaactctgtcatctagaatctaagccctgaagcctactctgagatctttgaagtactcacttgggctgaagccctttagagaaactaagcaaaataaatgatttgaagcaaacaaaaatataaactccaaaccttccccagctttgcataatcatcatattcatttactttttattaaatttgcctccctggaggttaggttaaccaaacctgtctccttcattttatgttttttaatcttctgagtgacttctcagcatggacctaagttttcccaaatacttaaatatttgataagcatcagtgttactactgaaaatcactctaaagggtttggtgataatatggatctatttactatatttaaaaaaataaatatttgtttataaggtagaatagcagaatagttgcattttttggtcttcttattaaataaccttttctgtgtgttaacaaactctctacctattggtaaaaataccatatcatatgatctctgatcccatttaggggaaggaggccaatgaagattccttcacagtgtcattaaccacatgaagacagaattactccagaatccccaatttttttgtaacaatatgacctatttctatcaactaaaaataaataccatttgagctcccactatgtcttagacactggtggtgtaaccgtgaacaagtcaaagcccctgtccacatggagcttaccttttagaaagactgagcaatacgcaaattaataagaaaatcttagataatgctatcaaatcttaggcatatttgttattttgtaaaaaaaaaaaaaggtagattcctctgcttcatcttgttaacaaataaatttgttaatttcaaaatagcatgtttagcagggttttttgcggttgttctgaagatccactgtactctgtataaacattgctgtataggaattaaagtgtaagattttgggagctgttcataaaattagccaaacttaaatttactctaggaataagttatcatattaacgttaggctcagtgtgatgtatctgatatattttgaaatatactttatacacccatctaagcagtgtactgtaataaaatgcatatgacacatattatggattagcatgttttgaataatgtatttaagatacttcataacagcaacatatgttgaccagtcagtggggtcatttttccccattcttttcattttgaaatttatattttgaatttttttctgcttttagatcttgaatatttcttcaaatatttttattacttttccaggaatttgctgcactgacaaaagaattaaatgcctgcagggaacaacttctagaaaaggaagaagaaatctctgaacttaaagctgaaagaaacaacacaagagtaagtgtaaagcagcctttttggaattaattctatttgtagttcaatgcattacatgtaacacacatataagaagaaaatatatgcattttaaaactttataattactttaagcagatagtaactcagttacttaaagtaaaggaggatatactataaaactcaaaacaaaaagacaggaaacctaaattatagtcacagctactaaatcactatgttgctttacaaaatgttcacattccttctggcctttactttatttggctttaaaaagaagatctggatttcaataatgggtttcaaactttcaaaaggttgttttgggggtagggtaatccctcagaggttggaaatgggcaaaagaggagagttttggaaaagaggaagagtttaaattaagggctgctacaaaagagtggcctgggtttggttctcacctcctcccagcagaagatttttttaaaaaggaaaaaaaaaaaaaggccggacgcgatgcctcatgcctgtaatcccagcactttgggaggccaaggcaggcggatcacctaagttcaggagttcaagatcaccctggccaacatggtgaaaccccatttctactataaatacaaaagtcagccaggcttggtggcacgcacctgcagtcccagctacttgggagggcctgggaggcagaggctgcagtgaaccgagattgcaccaccacagtccagcctgggcaacagagtgagactctgtctcaaaaaaataataataataaataaaataaaaaggaaacaaaaaatagtgtcaagaaaaaaaaactgaaaaaaaaatctgcccattaaaagaggagtgcctttatgttttaataaatttccaagggaatgtccagccatgatattctgatttcatgaaactcatggaatttgctagattctacttttggaaacccatgtattttcatcaagcatatgacatgccatgtaacattaaagttcagaatttgataaacatgctatattttctttgagaaaaaaaatcactaaattttataaacatgtaaattaccacattacccatagaggagtacagtttactaaaaggaagtagaaaaaaaccacttctatgtggatgtaagttcaatttaaatacaactgaagttggtgaaaaatagtttaaatgttatagctataatagatcaatcctgaaaaaaataggtatagctaatggcctattcactttatgagtcttagagagtaatataaaatacagttctactaactgggagcttgtgcctttaatgagagatagggttgcttgcataatggttacatgatcaaactgaatttatgtccttatttatcaaggtcttatttcatggtaaagagaattcacatacatgcatacattgaattggttttcaatgatactctgatgaacctgtcaaatggattgcctcaaacagggcataacaagggcagtttagatcatattatcaggtatcagacaatttttttcttttgctgtcttcctctctatatatttcctacccttgacttttttaacttaacactgtgttttcgtgcaaatttaaaatttatttataccatgacatttattctgccctattccactatgttatattttagtactttagactacattccttgatttaacacagcacactcaagtgtaaaagtaggagcagaaagctgagaatgcagggaaatacaaagctttggttaggtttataactaatgctcacatttaaaatgcaccagacactcttttattagctgtgtaggttcatctagccttttttcttcagccccttactcctttctacacccctctggagatgttataattatctcaattttacagaccaggtaagtgagctcagaaaaggtcagataacttgccagaagtcacacagttagtaaatagcaaagaatgaatttgaaaggtaaggcagtctaaatccagagcctgtgcactaaccatgaggccatcagcattattactcaaagacttactacagctagagaggacattgcttaacagtcagaccaccacagtatctaattgtgatgaattttagagagctaagagatttggtgacagaatccgtacaattttcatcatattgaaccccatgagaaccagaaatacccgaggctattgtgtttgcaaaggagtcttggataataaagggaggaaggtgagccacatgtgaagtacctatttgggagtcaaaattagaaaaatacaaagttcctttaaaataacaataacagatattgaagccattgatttcaaccatgcataatagttactttgaaaatatgaataaggctggaaaatacatttctaccttctttaaagcagtgatgtggaggatttttgttgtcgactgcatcaaggaaaacagatttatgaaaacccccttgtacacagtattaattatataataactccttaagttacataaccacctctcaccctcctccatcccccagaagtagtatatccagagctgaaaatcaaatatgtctctcttcacaccagatgccttatcaaatgttgctaaataaaaccatttttatagattttatagttgtttctctttctagatgttgtgcttttcttcttgctataaatatctgtgtgctggtcatagagacaaagcaacaagctagtgtttccttctcacatgtaaagaaactttaattggtgtcagattgtgagcaaatttaaagcgcaagtgatagctgggcatggtggcacatgcctgtaacctcagctgctcgtgatgctgaaataggataatcgcttgaatccaggagggtgagattgcagtgagcagagatcgtgtcactgcactccagtctgggcgacagagggagactccatctcaaaaaataaatacataaataaatatataaaagaaaataaaatataaagtgtaattgagcattccaatttccaaagttctgatcaacttgtggctcactttacatcgagtagttaggatatgttcatgaactgagctaaataacataaaaagccagtccatgaaaccatgtgtggatggggtcatttgtattaattttgaatgttatcaaaaacaatagatcagaaaaagtccttctgtataatgatatttggatgaattataccatcttccaaaatagaaaatagaagttccagtgggaattgaatgaagatagagagtaataatgataatataatagctaacattaaaatctaaatgtttttatgaatgttttacatgtttaactcactttattctcacagcaatctcattattcccatttaattcaagagaaaactaaggtagtaagtaacttgtcccaggcctataaatggcttataaatgaaacacccagagagtccactacttccttctcagtttacccacagactatgtatttaagaaatcatattcctatgtcacccacaattcacatgtgatgcaaaggtattatgttcaaagaagaatacagtttgttcaaatttatttttttctttttttaattcttttgagacgaggtctcactcttgctcaggctggagtgcagtggcacaatcatggttcactgcagcctagagttccctggactcaggtgatcttcccacctcagcctcccaagtagctgggactatagccacatgccaccatacccagctaatttctgttattttttgtagagatggggttttgccatgttgcctggacttgtctcgaactcctgggctcaagcagtcggcccgtcttcacctcccaaagtgctgggattacaggcatgagccactgctcctggcctatttaaatttttgtaattcaatcctactttattttgtgttagtcatgtggaaagtcaatctgctatgtttttattctgaggtcaaagctgaaatgtatgtcctggccatgtattatgttttctccacagaaacacctcgttgacattgcaaaaatttgagtgaatgaaagaaaatcagtcatcactgcagttgttcttaaatccaactgcctcaagttattaaattaagaatatcctaataaaatcattataatattataaacaattatacaaaaatagaaatttcaaaaaattatagtggatatttatagaaacatacaaagaagtttttgttcaatatttttatactgataaaaatgtagaaaaaatattgaaacaaaatttgttattcctaaaactcctctgaccatactttggcaagtatatatttacagaaggttatatttatagaaaataatttattcctgatgttatttcaactcaaaatgatcaataagacatgttttgacaaagttatctgaactaatgaagaggtaaagaaaaactgggaatttttgtatagttattgcctgtgaatgtcagcgtgaagaacatttttattgtcggagttgtttcaactatttttatagctgaagatctcaaaggatgttttaaattgttcataatgttttagaatgtaactattgtgtgactttgaattctcactcataggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaagaaaaacgttatggttttgagaaacagtattcatattgttatgatttcaagaaacagtattaatacctagttataaataataaagctgtaacttaatctcatggatcataaacttaaaaagaagacataattgcatttgacacatttcttaccatgccctcacttttgttttgagccaaaggaattatcttaacagatattgagatacaattagacacccatcactactaaagaaaaattttttcttattgacaaatctctgcctgtacgagttaataatgtcatccaaatgtatttcatcaatgggtagaaaatacggtccaattcagaaaaggaagaccttctcagctgaaaacagataaagattctacatatgtgtacatgcatgtgcgtatatagttatttatgaaagttctatgataggatatgatcagtacaagagtaaataggataggacatacgccctcccaacagctatttcaatttcataatcaaacatgagcataagaaacatgggattttaaacgatatttgagggtaaaagatatggagtgggttgagtaagaaggcaaccaatttaaaggttttcgttttcagatgttaatgtcatgctatatgaccatattacagcagccacattagtctacagggaagaatgtgtttctgtttcagtgccatttataattggaaataactattcacaaggttttgttgaattaagatctaataggaagttatatagttttagaaatccttacagaatcatagtaaaataaaagatttagattacctgggccatcttgcttttcaaggcaaaacttagtccaaaaaattcccaatgacgcatgatgtgtgggtttgtgtgggtgtgtgtgtgtgtgtctgtgtgtgaatatatgatacatatgtgtgtatacacatagaacctgtggtcatttaaagaaaattcaaacataggattcatggccattcacatagtctctacaatcctttgagtataccaaagagagttccatttgtactttctgtgagaattattaaatattaggctaaagttgtagctcccagtgaaggtgtgtaattagtagattgttaatggtatcttagctaagtatcactttttgtactcttaatttatttacttttatttttaaccttaaattaggccatatatatatgccagatgagaacatttttgtccatattcttcaatctgaataattgatgtttatcattaacccaattcaacaagtattaagtacttattatgtagaatattttccttggtattggggataagtgaaatcgttcatcccttaaggagtctgtttatattaataaaaacatatttggtttttattatcatgtagatgagagttcctaattgcacaaaacagagtatatagcttggctgtttaaataaagacattaattaaagcatataagaaatctctaaactgagctttcagacagtctctaggaccacatttcttagctttgtaaatttttctcacaagcccagtcccagaaacacgcagcctctgccactaccccttcccagcatggttcctctctgccccgtcaggctaactcccagggtggtcaggtctggttgactgatcttaagtcacaggtctgccacctagtggtaaacattcccaagaaatgttactgggaagatgggatttggattgtgaggaactatcaaacagtcagggggaggggtagaaaatggggataattaatgggtaaaagatggtaacagggtacagaaaacagaaaagagaataatgtattaatgtacattatatatatatattcacacacaaacatgcatgcgtgtgtgtatatatagtgtgtgtgtctgtatgtgagcgtgtgtatgtgtgtcaacaaaaaaggaatgatcctcttttctccactagtcacaggtcctagttggcagttatgaattccaattataaaccttggtttctggacttacatacatggatccatagctattccaagaaagaaactctatcttatttctatcagtagttctgaggatatactaattccaggatgatagaattcctacttagcaatgtattatgtccaagcttgaattgtgctgggtcaactggctagccacatgtagaaagctgaaactggatcccttccttacaccttatacaaaaattaattcaagatggattaaagacttaaatgttagacctaaaaccataaaaaccctagaagaaaacctaggcaataccattcaggacatagggatgataggacttcatgtctaaaacaccaaaagcaatggcaacaaaagccaaaattgacaaatgggatctaattaaactaaagagcttctgcacagcaaaagaaaataccatcagagtgaacaggcaagctacagaatgggagaaaatttttgctacctactcatctgacaaagggctaatatccagaatctacaaagaactcaaacaaatttacaagaaaaaaaacaaacaaccctatcaaaaagtgggcgaaggatacgaacagacacttctcaaaaggacatttgtgcagccaacagacacatgaaaaaatgctcaccatcactggccatcagaggaatgcaaatcaaaaccacaatgagataccatctcacaccagttagaatggcaatcattacaaagtgaggaaacaacaggtgctggagaggatgtggagaaataggaacacttttgcactgttggtgggactgtaaactagttcaaccgttgtggaagacagtgtggcaattcctcaaggatctagaactagaaataccatttgacccagccatcccattactgggtatatacccaaaggattataaatcatgatgctataaagacacatgcacacttatgtttattgcagcactattcacaataccaaagacttggaactaacccaaatgtccatcaatgatagactggattgagaaaatgtggcacatataaaccatggaatactatgcagccataaaaaaggatgagtccatgtcctttgtagggacatggatgaagctggaaaccatcattctcagcaaactattgcaaggacaaaaaaccaaacaccgcatgttttcactcataggtgggaattgaacaatgagaacatttggacacaggaaggggaacatcacacaccagggcctgtcatggggtcggggggaggggggagggatagcattaggagatatacctaatgtaaatgacgagttaatgggtgcagcacaccaacatggcacatgtatacatatgtaataaacctgcacgttgtgcacatgtaccctagaacttacagtataataataaaaaataaaaaaaagtcttggcttatttaaccattctataagttcagctacttctaaatgatgtaatggtgtgataaaatccggggtccctgggagcacccatcaattgcattactcttttcactgtaaaatcagatttttttttgtttttttttttttgtctgaagtaatgttgtatatcataacatgactgtaagcaaaaactcggtaagatggtgtttctggtagaagtatggtcattagagaaagcaaatctatatccaaaaagggggtttattatagtgaggaaaaactgcctcctctttaataaaaagtatttgatataatatgcttgcttcatggtgaatagctggtctccagctgtactttatcatgacagggctcaagttagattgctgcagcttgccactgggccgttcagccatggtggtgtctccatcagtcttaatcgtgggaagcccattttgtcaggtttataaccctgaaaccatggtcacttctttatgcacattgagaaatacgacatggtggcaagggaaataggctgatatctacaaggtgaatcagtttgtccaccaggttactgaagactcttacagagtgaggatcagaaaattactcctagctcagaggtaatattcaagaaactttgatattttattgtccatagtactatgactctaataaatagttacagatcctttgggagaaggttttctgattacctatcatgatatgacaaactatccaaaaacttaatgacacaaagcaacattttaatatgctaggaaggagatatccaatgttgtaggtaaccagggaaagcctcattgaaaagtggcatttgagttaaaatatgaaagcgaaggtgaagtgagatagtcatacagatttctgaaagagaatgttttagttagagaaaagaagaagtacaaaacccctagttagtggggacatggatgtttagcctgttaaaagcaaaactaacaaaactaaacaaacaaaaaactgcaaggcagccaatgaagctataccagaatgagcaagaagaaaaataggagataagttcagaaaatttagatccctttgggatgtataaggactttgactttcacttgagctcaataagaagacattaaaaatttgagcagaggtataaatgacctaactcacattttaactgaaatagtgttttgagaatagcctgaagatgaaaggctgaaaggaggaggaccagttaaggagccattataatccagggggagattataggtcttggacacaaatgtaagcagtggatgtagtggcaagtgatcagattctagaaactgagggagcatgaaagagagtgcttacaaatactgaattgttaactttaagctgggtaaagagacaatgaggacatgagggtagggagaagcagttaaaaagttccacttgccaaatgtgaagagtgtgatcaaaagatttaggtagtctctaataacagatatcctttatagcatcattattgtgtttcttttcctagagggtggatattttatatttctaaatcttacactgtattgtgcaaaattggatgctgatatgtttattgaacgactatattatgcaagatgactctaatttacaattagaaaaaaaaacagttttcattgtgttgtaaaggtttcattatttttgtcatcagattgaaggatagatgtacataataatgttaattagcctaagcttttaggaaataatgccaattaaccatggccacaggcttagctttcatataggccaaatctgtatgagatatataaaactatatgaggtatgtaaatttaactcatttaacatttcagttcactcaacaaatattaattgcatacctatagatgttgggaattgagctaacacccaaatccagagaggatcaagaggattaaggcggacactgtgccaactctcatggagcttttattgcaatgggaaaatagaatgaaatttggtagaaaaatttgtttaaattgcatatcataaaatattctgaagaaaattagtaagggattgaaatagagacttgcggaggtggggaaaaggagaaacttactttagacagtagtgagcaaatgccttgttgagagatgatgtttaagctgagacttaaagaatgagaaagagctggttaaatgaggaaccaaagaaggagtgctttgggcagagggtacagcataagcaaaggcttgacatactgaggagctaaaagtaggtcagaagtctggaacatagtttgccagcgaaagattgacatcagatgccactggaaaaacagacattattaagttcatgcaaatctccacaacctatgtaaaacagcttggatttatgcaatgaatacatgtatctaaagaatttgagagaatagaataccataatataatcagagattgataaattttaaagggctccttgaaaatttcaggttattttcatactgaaaaactactattattattattattattttagtagagacggggtttcactgtgttagccaggatggtctcgatctcctgacctcgtgatctgcctgccttggcctcccaaagtgctgggattacaggagtgagccactgtgcccggcgattagtttgatccttaaatgtgactcttatctactgatttatgcatgtttagtgtctcagatactggtgttctttgtgcccaataatggcaaagttttctaacattttgagtcataattagtgacagcaaatgtagagaaatcaaccaaaaaatatgatactaatacttgacaatgaatctaacagtggtatagtgaaaaccaaaatttttcattacagttaaacttttagaaaatatcttgaaaagaaaaaaataaagttgttttctttattctttccaccttcagtgtcttatatctgtttttaaatcttttgtttgggtaatttctgctttattttcttctttattttgcataagtagacaccacttgttagcctatgcttttcactatgcttccgaagacctttcctataatgctcaccaactgtgtgtggttcttcactagtaaaattataataactgaaaataatcaagcaatttctgattttcttctcatgtatctttgttttttagcagtagaacttccttttgaaatgaaagcaaatatgaaaccccaattcacaaaacatttcaaagcagaactcctctggcaaaagctaagagtgtaaagcctgaaacagcctggaaagtcttcagggactttccctccacctctgtcatggccccagaggctactctgggaaatcatagattctaacacaggcaatttaaaactgtatccttaacttccttttctgaactgacaattgagaatctcagttactatgttctaattggttgcatatatttttctataattaatctaaagactaattgtgaataaaaccatgtgattaagttaaagtaacattttaatgattatgctcattttattcaattcaaattattttaatggccatatgtaaatgaaataaattttgactgtcactatgatcctctaaaaagatcatgatgcatcaagcaatgttctttcatcattatcatacatatttttccaagtgttctatttctgctgaattcgtactgaaattattacatttgctaaaggactgcattacatttgcattacatttttaaattcagtaacttgttaaatgatcaaatacaatttatctttaatgtattttataaaccctgttttaaacaggtctgtgcttctttgttgctgcttgcagtgtaacctgcagctaacattagatactatgtaagcctgcaataatttaagggggaagtcatttgtaagtatttatgacttgtattcataagataattgcattttctgttaaacccaatagctattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtatagtatggaaaaagagttcaagcttaactacacttctgtcatcagcatcaagctctttgtcttcatccattgactcacctgactcctaaagtcagtcagttgaggaacacttttgagttatatgaaaaatcattttttaaaagtgaaaatggattactgtgtggatgttggtaatattcataaacatcttctttttctaaaccactgaatctatggcttatcagaattagacttctattatggtacattataaccctacttcagatgacattcaaaatgttatatcatttaatattattattgagcctctctctctctctctctctctcccccctcccccccccccaccttggtctttctttatagattccaaaataagagaccactaactgaaaattatgtatattttgatatgcaaattgatgtactttaacttttagacatttattttagaagcatcttattttctaatgtctctaatatcatagttttaaatattcatttgaatattctctgcatgtaacatcacaaagtattagtagaaaaacctgtgtttagatatttttaaaagtagctgtaagcttctcttagctgttactcgaataagttctactgacatatataaaccaatatgatgataatatccttaggagattaggaaggcttatgacgtatttcaatttcgtgaaatttcaaagactgaacttttaaaaattagtaaatctttaggagttagagtggaaattgggacacttcattgtaaagtatccgacaagttctgagcattaaaatccaaactagggattatttcccagttatatctagtttttaagcatgcaaatatttttgttctatttaatatttatatacatttatatttttatcattggtctttcagatgttctgagaacaggggattatgtggagtgtgtatgtaaggataactataattctgtcttctagagtattaagaagaaattgtatctcatttttattttagcaacgagaggcaattagtataagaattattttgaataaaacagaaatgaatattatataaaaattcttgctaaatatgacatcaaataattatttaatattcaatatttagtttcatattatatttcctctctttttataaaagtgctaagaatttgcaagagtttatatgtatagaatttttagtatgtgtcaggctccatagcacatgtttgacacacagagataaataagatatgctcattatgactgagaagttcagagttagtgctaggaattcacatatcaatgaaaaacaactcaaaacagatgtatttccatcacaatatgtagccacagaaaaagctgtgactgtgtgagtaatgacaaagacaaggatgtcttcaagaaaggttggcatggccgggcgcggtggctcacgcctgtaatcccagcactttgggaggccgaggcgggcggatcacgaggtcaggagatcgagaccatcctggctaacacggtgaaaccccacctctactaaaaatacaaaaaattagctgggcgtggtggcgggcgcctgtagtcccagctactggggaggctgaggcaggagaatggcgtgaacccgggaggtggagcttgcagtgagcccagatcgcgccactgcactccagcctgggtgacagcgagactccgtctctcaaaaaaaaaaaaaaaaaaaaaaaaaagaaaggttggcatttgatctaggtattaaagaatgattaagggttttttaagcagagaaagatactctaagcagcaggacccacacagaaaataacccagagctgtaagaagagaaggacctatccagagaaaattcaagagttttgtgacttaaatgaaggtactagagaatgtatgatttgagatggtcccataagcattcccatatcacttgagggatgcttttacaaaagaatgattctttatcagaatagaggtaataaacagcatttaagacaaataacctggtcgtgtgagtacatttaagaaaaaaatggttgttgtacaacgtaatctagaaataatttactttatagaagttcagtgggtttagcataactatatgagttgttccatcgtatgaccctaggagctataataatatgtattaactcaccataggtattctgaacattggtgagttcagggacaactggactgattatcaacaagtaatgctcagtggcctaaagaagaaatgaattggggctctggagtcagacagatctggataagtgacttgatcattcattctcaaagcatcaattacctcttatcttgaattaagataatcctagtactgacctcagagtcatcatgaggattagatatgatctgatatgcaaagctttcagccagtgcttagcatatggcaagtccttagtgaacgtttatgaatattattattagcaggagtaagcatcagcatttgataaaactttcaaaccaagtaaacatgttggttttactgttgatccagatgcttgtttacaatagcatttcatttagttgtcgagggactcatatgtgtctaagtgccttcatagacaatttccctaagagtaactcacagtttctcatagggatgaggagggatgtggatatagatatataaacaagtgatcctatatatatatatatatatatatatatatatatatatatatatatatatatgaagtcagaaaaagatgcaattaaccatgccttggggacaggaaacaaacaactttatcatagagggattagtacatatgcagagctaaataaactctacaaggattgagcatagctgtagagagttgcagtgattcataattttcatcattaatgtccaattatttatacagccaccaagttgtagcatagaatattcataattagctaagaccatcagtaattttgaaattactctacaatatatttaccaattccaagggttggagaacatgagaaatatacttgtgtttttcaattactcagaaatcattgactatttaaaaataacatatcagacatgtatgggaaatgtaaaccaaaacaaattaaatatatatgccttccctatatatttttattatcaaatatcttagtgtcaaggaatgaattagagcttctggtctgaggagatttccacaagaatattttctgttgtaggagtgataattccccaaatgcaaccctgccttatattaatttcagtttgcattattgatattcacagcatcaatttttcaatttataacataactcaaaatatattcagaattttttattttcttgtaaaacagttttagatttattacttcgtggacaacataatctcaatttgtaaaccactattctaaatatatgaaagatgattatttcattttcatattgttggataaattcgataacttttactccttaaaaactcactataatgaaaatataaatgcttaacttgtagtaaatagaaaacagtttggaacagttctaagagtttaagtttaaaaaaagaaagaaagatatattaacctaccatgtagcctagattcaaccatttcttatattatgcgaatgacttttagaaagattttaatgtgttgatattttaaaatatggtaacttcctctctctacagcagcttaagtgtgatatgatcagcgttgtgtatggagagattattaacatatttagattgcttcatattgctgttctcatcaactaggtttactaggccttcttcaggacacccgtattttacagttggtattttagaatatgggaatccctgttaaacatcacacgtctgttgaaacgttttttgatatatgcattccacacatcagctgtcctgctcattttcatggcttcgggatatttgcttctttttcatgtattcaaaattcataaaaaagtattctccaaatcaaatcatcgaagatttcctgctatgtaactagtgtttggttattaatcagcattaatcctatgtattttgttaacaattggatatttgtctaacaggaatgatacttggcagttaatctctagctcaatatgatgaaagatcctgtgcaactcttttagaaatcaagtctccatttatgtgtgtattattgtttttagagaatttaagcataacaaaatataattaatattaaaacccctacttggatatttttattgctgattcaaggtctatttcaggaattaaatgcatccattcatctgaatatacatggtattgtaatacaatactaaaatgtgacttagattcttaaaaattcctaataggattctaggttaataggacattactgactttttgtttgtttgctaactggaaaaataatattataattccaatttaatttttatgtatctgggtttttacatattttataaatttaatctatattcccagttaaatcttattagaggagaaaaataccatttattaaaatatgctgtcagttaataaaatgaaagctcataggaatataattatatgttaaaacacatcttaactgcacaaatactatagcattcccaagaaaaatctaagttaatttataaataatcgaaaacccaccatgaattgcatcttaagttaaagctataaagttttttgattttttaaggaaaattaaactgctatagtcattcattttaattcagcaatatttctttctctgaattgttttatatatatatatatatatatcaggacatatatatagatctaaacataaaacaactaaaacaaagttctaagaaagcaagaatcaaagaaatacttcttcgagtttcagttatgtaagaaacaagcataaattatgactttcaaactaaaatatacagagatttttgttctataaaatacaatggtttaacctttggtatctggaagctagttggaaattccaagatacttaagtagtttacaattcctcaaaaacaaagtagacctctaattaataaaaaacagagaagcgaagaacatttttcaggttctaaaaggcctttccttcaggcaaataatttttgaaattagatactaagtaccaaatgaaaattcacttgttattttacagaagtagagaaaaaggtggggtatttttttttcctatttgtcatgcttaaacagtgactattttttagatgaattcataatatacttttaaactttgtctccacttactatgaatcagaattcagagcaagacaagtcaatctccaaccccacctgaagctctatcagggaactaccaaaagcatttgcttacaaggaaatcccttgatacagtgacaatacgaggtgacaatgcattcattgtatttctgccagatttagtattctgagcacgcagggatataaatactttaataatttgccaaattgactgtctctgatgatgttaattatggattcagcacagtttaatatgtatgggatgtacattactgcacatattttgatttttcttctaggtaagggagcgactgagggtttctttagaaagagtctctgcactggaagaagaactagctgctgctaatcaggaggtaacctgccacactttctcctcttttgaggtgcaatatcgctgacattacatcccttgtgtttcacgtcacttttattataactgtcacaaaaaataaattacattctgtctatgccattgaacaaggcttgttgaaattagttgccggagtcttgttttctgatttttggttatttatatgtgtcactactagaccaaaggaaaattatcaaaagctagtgacatgtgagctagggagatgaagatttagaaagactacaggcagaacgtcagtcgtttcaagaaggaaaacacagctcaaaattggaacacatatcaaataactgttaaacttagaaaatgctacaaataaaagtgaactccttggagagatatacttgccctcaggtcctgcctattcttatcttctaaaagcactgtactcatatttagtgacgtcactgaatccacttctgctactattcacaacccccaaaaaagttttttcaatcatctttttaagatttaaagagttattttatcttcggaagattttacttctcttgggttttaacgcacaaattatcttggataattaggtatatatagagagtacataaatttgtttatatatacatgtatctatctatatttatctctctctaaatatgtatgtatataatacctaagatataaaactatatatatatatatttatccctgaagtattattatagtctcctatagacagtgtggtacattttattgatattacatagataaaataaaattatatatatatatagagagagagagagagagagggagagagagagagagagaagtttaacctgtgtcagccattaaaatagtcccatctctctttttctctgacatttataaggctgcatttttcctacaagtttattccagtaatgtaatattggtattactagtattggacatactaatataaattagcaaaatcttcttactcttaaataaccaagggtagaggggagggaataatgaagagggttgattaatgggtacaaattttcagttagatggaagaaataggacctagtgttccatagatctagatcagtaggttgattatagttaacattaatctaatatacatttcaaaatagctagaagacagaatttaaatgttcctagtaaaaagtaaagataaatagttaatgtggtggatactccaaataacctgctttgatctttacacattatatgaatgtatcaaattatcacaagtacccccaaagtatgtacatctattatggatcaataaaaaataagtaaatataaatagatttataaaaatatatgaggctaatatcagtaaagataagtcttataaagggatttataacaagataatgtttacatatacattatgcatacagacaaatacacattttcaaaccactcaataaatcttctcagtacaaactcctttgttttttgttttgttttgttttgttttgttttttgttttgagacggagtcttgctctatcacccaggctggagtgcagtggtgcaatcttggctcactccaacctctctctgcctgctgggttcaagcaattctactgcctcggcatcccaagtagctgggattacgggcatgtgccaccacccctggctaatttttgtatttttagtagagacggggtttcaccatgttggtcaggctggtcttgaactcctaacctagtgattcgcctgcctcggcctcccaaagtgctgggattacacgcgtgagccaccgcgcccagccactcttttgttcttcaaaataagctagattaattaaatgagtgtatatatgcttttctttgtcccagccataacaatttaacctttagaaataatggactttcagctagtaggagagtaaactctatgtgaattaaaggctagtagtgttaaaaccataaatgatgaaatagccatctttaaaaaggaaagaaaactttttgatgaccagattcagcttagtaaacaggatggtttgggggaaaaaaaaaaaaaagaaataagagattggtacctctcagtcatcatagaagaaaagaacctctggaataataggtaatgagaaggagtacacagtctttgaaagagatggggttgataaattatcttcaggatggggtgtacttgttcctggaactatcagaaaaaaacgtaaaatgtgtattcatattatattttattaatgttaattgtgatttttatatgtgataaaattacattcattttggatgcatttctcaaaatattttattgataagggcaaacaaacaaaaagtttggtggctactattataaaagcatggcttaatatgaacgtgatagaatttctgtttgtcataaacaaaggtgtgatgagaccacttggctaaagtaagctgaaataaaagtgtcccataggccaggtgtggtggttcacacctgtaatcccagcactttgggaggccgaggcgggtggatcatgaggtctgcagatcaagcgagaccatcctggctaacacggtgaaaccctgtctctattaaaaatacaaaaaattagctgggcttggtggcgggtgcctgtagtcccagctacttgggaggctgaggcaggagaatggcgtgaaccctggaggcagagcttgcagtgagccgagatcgcgccactgcactccagcctaggcaacacagccagactctgtctcaaagtgaggctctgaaaatttgctccaggaatagcaactaagtagttacttcaattatacataaaattgaacagcagcccttgagaacaaaagtggaggaaagatttacgactgttttctggaatagagttttatccctcgagtattattataatctcctataggcagtgtggtacatttgattgattttacatagataaaataaatttttactttttagcactcctgtgtatctactgcagacttttctgaatgccatttgttttgcttaaaatcatttgtacaaataagagtcacttgcataagtaaaaatcacgtctgttagtaattatcgtgctcattattaacttccattttggttttgttgttgattttaactattgtccatgtggcttaactcgaatccctatttagaaattcacaagcccagtgataaagaaaatttactttagttttctaataataaatcacttatcaatagtgattcttttaagagagtaattagaaaagagtcaactttaacttcttaataaaattgatatttcaaaatgaaattacgaaaaaatcagaagacacttgcagtttgagttgttgattctctatagtaagagcaattggtataagaaatcactgtaagtaaagcatcatgtattgatgataagaagatatatttagaaacctgataaaatacatttagaaaaattcatactattagcagctttaggataagaactaggtgacttttgaatgttggaggcaataactgaagaagatagtttttaaaaaaagagcaaattttcatgaaaaagtttaaaaaattattaagagccgaataatcaggaaccagagcaaaagtcctgcgtatgactaaatgagcaaggagctggagaaacgtttatctgatgcatcagatttaactttttttttttttttttttttttttttttttttttttttttttttagacagggtctcactctgttgcccaggctggagtgcagtggcacgatcaaggcttactgcaccctccacctcttagcctcaggtgatcctcaagcctcagccttacgagtagctgggactacagttgcatgccaccatgcccagccaattttttttgtattctttatagagatggagttttgccatgttgcccaggctggtctttaactccaggggtcaaacagtctgcccaactcggcctcccaaagcactgagatttcaggcatgagccacctcacccagcaacgtttcagattttaaattaaatttaaaatgtatttacaagtgtcccttaacattcaaatctatttgttttctgagttcatattgccatcttgaagagtaagggtgctatattatgataatctgcttggttcttgagtttctccttgttacagtgacagtttagatataaaatcttatccaaacatttttttctgaattaattcaattcccaaattcagaacggataattaagagaagagatttagattgtgaatgatatcttgatatattcatacatacgcatatatgcatatgtagaatctgaaaagaccatacagtttattctatcatcattatatgattttaatatgctttattctctcatctatctatcattattatatatagagtctctttctctctctctctctctttctctctctcctcctcccaccaccaccacttgtcttattctcacggatgggtttggagttatcacctcctaatatcttttctttatataatctctttcattgatcgctcatctattctccccagacatccaggaattcaaccatgacttctgtagaaaagaaactaaaatctatagctcaaagtttatatactcttctgagctctacagaaaatttcaaacatccctttggcattgccacagggctttgttaattattgtatagattattctctcctacaaatttccagcagggaggtcagtgggagctgaaatatagctcagggtttgctaatccagacatgcaccagaggacatagccacctacaaggagtacattttctaatttacacaaaagtgccttatgctctggtgggtcagaaatgccacctagttttcctgatgtcctcttagattctatatggcacattaatgtaataaagtgagttgcctcattaaaaagaatacaaaactactatatgttcttttctggaaaaagccccaaaacattctgctatgtaaaaagaatgaagttgcatagaataatctcaatatttttcaaatataaataataataataattcattatgacaggaatagaaaaagttttagatataagtgccaaactgttattatttgttttctccattgtttgcaagtatatataccatatgtttctgtagtgtttgaaattttaataacttttcattattcttataaacaaataaaataataaagttgttttagagtcagattttattgtccataatgacatcaatactagatcattttatggagcacttaatagtaatcatagttaatatttattgctaaatacatatatgtcagtacactaatgctggaaggtacatactattattttacagatgagaccagagaagttatttctcctaatgtactgctattccctcctacttgaaaatgtatttatctttgaatttgtcttaactctctgctttcaggttgtttcaatttatgtatataattgtgtctataatgttccccatatctgtttactctcatctttttccatatgtattaaaattacaatatttcaggtcttcatgcattctcacctgacatattacagtaggcttttatctgttcttattgcttatctcttttgctgtgtaattctgcaaggttaaacttgctaagtgaagccccaattataatgattatttttgtaatatgttctcatctataatatgtacttatatatgatatatgccatattaatacactgataacataatgatctattatgctatattaatatatgttaacaatatagtgatatatgttacatagacttgtaacataccatcgaaaatttcttcagtgttcctaacctacagattctactttaactccaccacccctactgctctgcctgagtcattctaaggccttaagtcatagagtgtatttttttttaaagaaggcaacatttttcctaactctaaatcttatttatgctaaagtctttcctggaatacctccataaccccaaatcactcattgaaaacatatttcctcatttaagctcaagctcagatgtcacctctttaatgaactattttataattctttgccaacaggctaattaattaatggctaaagctcattacttcagcctgtattacgactgttcaacaagtattagggttaattttatacttgtgtaagcctatgtagttagtttactgagaaatagacttcatctctctcctttatatttatttcactcagtaacagtgatatgaacctcttgatcaatatatgtttgtcaaattgcattatctacacttcattctgactagtgttttcatgttgttctttgactattctcttaatgaaccatttgaacaacattcagtatgctcaataaacagcaatatgttgatcatatgtatcaaatgaacaagttgtttcgtctttcaatttaattaattaatctctaccatgtgcagaaaattttgagagtctctgaaaggaagaaatggaaagaaagaaaataaatgaggtattaagtaaattttcatataacttgccctctagtgaaagagacagacgtatacacgtataactaacatgtaatttagtgcaaaactaactaaatacaaaatacaggcacaagcaaaatacagaagggaacagagaataagcgtattctgtgccaaaggatcggagaagacttcaacctaaaaagacagcatttgagtatatccttgaaggaaggctatgatttaacttcaaaactgtgggaagtatttcaggctgaggagacagaatgattaagaaaatctgaaactgctgtttcaagaataaggaatgttgcattgataaaagtcagggtgtgaaaagatacagaagaggagggtaaagaggttgatgggatccagattctgaagagctaaaaatttgtagattttatgctttctgaaatgagaaagcactaaaggtaatattatgggtttttttctgttttttttttaatttttgttaaagtgaaaaccattaaaggtatgtttttgtgtggttttttttgttaatgtttgttttttgtaaagtgtaaggctgacgtggcaaagagctagaaagttggcataatttgatgcgtttggttaacataataatataatatgtgattctaatcatggtactttaacaaatacttattgggcatcttccagttgccaggcatttcattaagtactgggtataaatatgttaacaaactcatatttgtaaatagttagttctagccgggcgtagtggctcacgcctgtaatcccagcactttgggaggccgaggtgggtggatcatgaggtcaggagttcaagaccagcctgacctacatggtgaaacccagtctctatacaaaaatcatctgggcatggtggtgcgtgcctgtaatcccagctactcaggaggctgaggcaggagaatcgcttgaacccgggaggcagaggttgcattgggccaagatcacgccactgcactccaacctgggtgacagagcaagactctgtattgaaaaaaaaaaaaaaaaaaagttagttctgctccgaaggccagtatgtgagatagacctgttaatgttaaaaactaattgtaagctgggtgtggtggcatatatgtgaaatcctacctactcgttacactgaggcaggagggtcgcttgaactcaggagtgtgagaccagcctcagcaacaaagcgagaccctatctatttgttaaaaagcaattataatgaagagttagtatttaatgtgtacagaatttcagtttgggaagatgaatgaagttcggaagacagatgatggtaatggctgattaacaatgtgaatgtactttatgccattgagtagtacttaaagggcacacttaaaaatgattaaaaaactaattatttatcttgttttatcacagtaaacataattataatacagtatgactaatgtgaatataaaagtaggtacaaggtttagtaatattaccaaagggaggaattcattgtaggggtatgaataggaaaaacagatggtgctacaaaagtgactataaagagctcaccagatggacttggagaaagaaaatagaagcaggtagaggtaggattggggaggaggtgacagagagaggcagatctgagtgaggggtggctagagttgggctttgtcctgcagacagcagtgagccaacagaatttttaggaagagaagagatgtgattggattttcggttttatagactagtggtatctcaaaaagttaaaggtaagaaatgtattagatggtcaaggtactgtgtttaaggatagatttaaaagaatcttcatgatcttaaaagaatcaaggggacagtgtcagaaaatacagcattgagtagaccacaggtattatttagtgtggcatttcttatgttcttttagtaatggcaaatataaattttaaaaatcaaacaaaatattgtaaataaatatatacataatgaaaatgtgttgtaattttaggcctttttgaatggccccacttaggcagattggattgttaatgttgattacatgttccaggccattgtcctaaaaaagtgagcccagacaatttagacacagaaaatacaataaagtctttatttttttgcagagtattattgttattgcttaaaattggaaagccaaaaaaaagcacaataaagggaagtacaaggggtaataaatagattacatcctaacaatgtgttctcttttatcagaaacctgtacacttttaaaattatgtaattaagccagacgaaatggattattcagaagcacctgtaaaaattcaattgacagactaatttgcagtgaatacacaggcgtgcttattttaaaagcctttccacatgattacattatacataaaaagaactggcaagtgtagttgcaggctgaactatattttttattgcctttactctgtgcatacttattccaaccactgaatttaccaattttcaattagaattttccaaggaaattaacaattattgtacctcatctacaatcagctttatctctgaagtctattttcctaaggaaaaattaaagaacttgcatgggcgtattaagtaatattcacatttagaaaaatattgcatcaggatgttgaaaggagatagaggcagcaacacacattttgggggcattacaggcccatggatcatagccattgcatcatacacattattccatgtaatcatcccccaaatcctttgagttaggttaacaactagtattctgttaaatgcatggaattaaatggaaaactggaaaaggtgaatagatacaggcaaaggtggaagctattctaaaagcaaaaggctggaatgaaggaaggagagatatgagactcaagcaagtcaagagtcactgaaccaaattagagatagaagtagtgagatagcaagatattgagagagagagagagagagagagagagagagagagttttaagcataaagattggaggtgttcaatgtttcttgaaggcatggaggattatgtctgatatgaaatgatttcacttatacttaagaggtcactggaaatgtttacagagatagttgcagtaaactctaatgaaagtagaatagctgcgattaaaagtatgtatgagttcagataaatgaaagaaggtaatactcttttgagaaattcagcaacgaagggaaggagagggtatatgctgaatgattccagacagtattgagtgacagccttgttataatgggacaaaattgaaaatgcttatagccattgaaaacaaagccacaaatgaaggacatgaaattatggatggcagcacagtggaggataactataattttaagatcaatggcaagtaatagaactccttcctctgagaaatggaggaaggaaaatagaacatgtagtgtagtgatgaatgaagatattgatttggagaggatttctttttcatcaggggttcttctcaaggagatgggttatctgctaaggaaagtgagaacagagttactttttaggaactaaggagactgtaaacgagacaacatagaacatagcaaggaaccaataagactaagcgaataaattttagtatgggatggtggacccagatgaggttctcattaagttaccccagcaaattaaataaaagccagtatttcacagctcttatcaactgaaacaacatggattctccaatggtatttccttatttaaatctataaagttattttattcatcataattcaaaaggaagagatacaaatattgagctaaagttgtctttgattgctttggccacttagaataaaatcagtgttataacttttccctaaaatttgacacgggtaaaaattagggaacttctgaaatccatgagtagttcagctatatttgaatagtttaaaagaaacttaaatagctgataattatgcagaaaaacatggagaaagtaggagatttgctgaacaatactctattaaggaatttgcctagagggaagtaatagaaatactcatctgaagttataggatcgtttatttgaaaaattaatcaagtgactaagtcagttttctcttcaaattaaaactgccatatctgtgagtagaaagctccagatgtagaaaaagagaccactgcaaaatctcttaagttaaattatttcagaatcctaaaaataagaatcatttcttttgaggggcctttgcaaattactcacttttgtatttttaaattctatctcttcctcagttctgggagatgaaagcagatttaattttgtatgtctatcactgctttataaaaatgattactctcataatgactttctaattttccacatgtttatgcatgctacatattctaattccactgattagcttattttaaacattaggaatcatattagtaaattccatgaccaattttcagttaacattcgaacagaaagtcagataaaagagattttttgtttgtttgttttattaacaattgaaacaagtcgccatgactaaacttaccagatgacagtatgcgtttaatgacaacagtgtttgcataggacagtgacacccttggagctctgaacttatattccttaaagataatgcaaaactgtctgatgctatgcttttagcttgcctgccaacagttgtgagattccaaaagacccacttattgggaacgtattattcctgttggaaatgtatcatttttggttagaagattgtatagattttaatttcctagaaaagttgaataatggttgaacaatggatttttttttaattttagattggtaaactaaaagtttcagtattgttaaaccagtagttatttacaaagacctatgatttcttattgtacctcttgattatcctttatgatgatattgtattataaagataaatgaataaactgtaaattgtccaagttattatcatgaatagaaaatgtatcttttgctgttgatgattgtactgttataatacaaagaatctttcccagacaaaaaaaatcaaggtgttttataacaatacctgttaaaatccaacaaagaagataggtaacaaaattgctgtttgctacttccactaattttactagttccaagtcttgtgtgaagcaattatctaaaatagaagttaaaagtgtcacctactgtgtataagacatttgaagtttgtttgcaaatctttccagactctctcctattttgattagaatattttctttgatgagagcataaggtttttttttatttgtggtagcagacatagttctattgttgcatgtggagattttgaatgctttttttctctattaatagtaagatcgtgtttgatattaatactttgatcataagcatcataaattgacctattttattttacccatatttattcttattgtttttaagctaacattttgagaaagattacttattgcttagaaatttagatgaaatattgaactttggtgagaggcaagataaaaagttaaagaatattaactttaagtcagaagattcaagattgaattatagagctatcatttactaattccatagcacctggcaattaattcaacttctcagtgcctcattctttttcatccatgaaatagaatgtattagtaaattttggacgtatctttcaaagaagtcgtaatatttggatgagacaatatacagggaagcactttgtaaacttggcatactgaagttgtattgctattattggactcaaaagtaaacattagttattagttgagcaaatgaaaatacttttctgttgatactttgaatgtgataaaaaatgaaatgatagtagtactctgtactttatgttatacccacgactacatctccttttttttgtattttgaaatcttcttcttgtgaataaacaaataccttatttgttcatagaataattctgtagcactatatgcattttataaatgatattgcatttcacttattcacatgtttgataaaaataatagcatctgcaattttagaggaggttactgtgtgcttggtactacagtaaggactgtaacaataccccgaacccacacacattttttagttatcataattaatgtatgagaaaaggataattattactagcattttgaaagttaagaaattgagtcatatagaacctaagtgaattgttctgagtgttatcactagtcgacaggaatccaaatccaagatgtctgactttcaatttcggtgtagttactatgtcacctggcctttctcccaacaatatttcctcctgtataaaactggtatagtttcctcatctttcagtaatttgaatccatcatgatatcttcatatctagtatatatacatgaattatctcaaaatttataactccattacactgaaagagacataaaatgtgtaaatcaataaagcatgtattcaatcaattaatcaaattaaactacctttaaaaatgccaaatactttgataaaatttaacatttaactatacataaaagattaattaaagcatccagatatttacagtttttaagatacatttgattattatatcacagtatagacttcagtataatagtaataaatagcatgagaacattgcagtggccactatgttttaaatatagaaaatgtgacacctcaggtcatattaaacaagatgaaaggatttctgcagtacctatttgttcccatgtcatttttaacaagaaagtgcaatagctctcaagtcttgaaaactgtggaagttccaaataactgaactcttggaacactaaataaataaataaataaataaataagatggatgaaaaagatatacattaattgacttaattttttaattgataattgactgctaatgattttacttttaaaaaacttcctagcaaaaaacaaatataacttgatcagttggtatttaccatatactattacctgagtttagccaaactgcaacatctgagggcacagtcctccataggacctccctcacttctgataccaactgcaagttcaggaaattctcacatccacccttaggttcaataaatcactagaaagcctcacagcactcactgaaatctattatattatagttatggtttattataggtaaaggttacagatcaaaatcagccaaagcaggagaaacaaagtgcagagtccaggatgattccaaacacagagcttctgttatcctcaggacgtattacccttctagaattgacacatgacagagtattaccaaccaaggaacgtcaatcaatctttgaagtttcaatcaaggcttcattacataagcatgatcgattaattacctgtttgattcatcacagctttgaagttgggagagaaagctccctaaatcatctagttggtcaaactggcataactgtccctcaagctggattatcaggtgtagtcagcctcactttaaaataacacttttattgggtatgacaagattatctccttaaggctgagggcaaaagcctgacctcctttgggtaaggtcaaattctttaccacacaactataaatcatcttaatttttttaattgaatatttttacaaatagtgctgatagatctctcatattatgaattaataacatgttgataaagccaaaatggtatttttcatgtagaaaacagtgtcattgggagataaggaagaaaataacttacagtacaatcagaaaatgtgtcgtggaagttttgtaaagccagtgcagagagagagagagtcttttaaaagaaaattacaaaacaattaaataatactgtaggggctgggtgcagtggctcacgcccgtaatcccagcactttgggagcccaagttgggtgaccatgaggtcaggatttcgagacctttgagaccatcctggctaacatggtgaaaccccctctctactaaaaataagtaaataaatacataaaaatacaaaaatttagccgggcatggtggcacaggcctgtagtccccgatactcgggaggctgaggcaggagaatcgcttgaacctgggaggtggaggttgcagtgagccaagattgcgccactgcattccatcctgggtgacagagtgaggcttcatctcaaaaaagaataaataaaaaaataaaatactgtcactagcaagtttgggaaaggcaactggtgtttttgaggcataaggctgagtcaagtatatttatgtaagtgctgttttatcgttctcagaaagctccaaccacttacttacctttccctaccttcaagttgatggatccccacattacgaggttattgctgttattaacagtgaaaatgtattgagatcttgcgattatctaatcacctttaaaacagggagtactatcaccactttaaagatgcagaaaatatggttctaatgcttaaagtaattcacctgaattacatagttagtaaatgcctgagccatttcccttttcttggatgtattcatttcttctaatctctccttttaaaatcttttctccaggttttggttaatcaacacttattccaagaagcatacatttgtatctatccatggaattagatggatttgcacctgcactgatatgtctgttgtatccagaacaagtgggctgagggacataaaaatacgctgtatgggttaaagtgcctgtcacagatggcactacttccagccagcaggtattatagggagctaataaacatataaagaaaacttttaagggcgagatcaggaagtagcacacatgactcttacttacatgccattgaagaaaacttggtctcacatcactctaagctgtaaaagagaccaggacatgcaatctctattttcatggccatatacaaaagttctattgctaaagaatgtgagaatgaatattaatgtacaaaaagcagactctagaacacacaaaacataaagaatgtttggaatttattaatgaacttaataaagtaatataaaaatgtatatgtaaatatcagtagtattcccacaccagcaataaatagaaagcattagtgaaaagcatatttcgttcaaataactataaagatagatatatagatgtattttatatgtaaacactgaattatgtttagaaatttttagctaaagtagcaaatcccattgttttaggaaatacaaaatgtcctaaatacatggaaacaacagtttcatttttgtgtctggagctagatattgtaaagatatctatttttcccaagttattttataggtgtaattcaatcaaaattctaatataatggttttgagatttaaataaaataattctgaaatttccttattaaatattaatgtaaaacatttaataatgttatgaaaattaaaagattgttgagtatggggtttccctagaatgcacagatattaaaatacattttaaagttttttaccactttgattaagtttattgctaagtatttgattcttttcattgctattattaagggggttgttttcttaatttcctttttatattgttgtttgtgtgtggaaatgcaactaatttttgaatgttgattttgtattctgcaactttactgttttgtttattagttaaaatagatattagttataacagtgagcctttacagttttttatgtctgtggtcatgtcatttgcatacagattatttacttcttcctttccaattgtttgctttttattttctttccctgtctaattgctatggctaggacttcagtactatgtcaaaaagaagtagtaaaagtgggcatccttttcttgtgctggatcttagaaggaaagctttcagtttttctccacggattaagatgttagctatgtacttttcccgcatgatctttattgtgctgaggtaattttcttctataccaattttgttgagaatatttttcataaatagatgttgaactttttcatttgccttttctgtatctgttgagataattctgtttctaaaaaattttgctgatgtgttgtatcatattgattgatttgtgtatgttaaactatccttgcattccagagataaatctctcttggtcatgatatgtgatctatttaatgttctgttgcattgggtttgctagtattatattgaggatttttgcatgtttgttcatcagaaatattggcctgtaattttattctcttgtagtatctctgattttggaattaggggatcctgaccttttaagtgttactgcttcttctattttttggaagagcttaagatgagttggtatcaattcctctttcagtgtttggtagaattcatctgtgaaggcattggttcatggacatatttgggttggtttattactgattcaatccccttatttgttatttttctgttcggattatctatttctttttgattcagtattggcagattgtatgtttattggaatttacccattccttcttggctctgcagtttgctgggttataattgttcatagtagtctcttatgatcctttatattttttaggcattcgttgtaatgtctcctctttcatgtctgattttattaaatttattaattttgggaaccaggggcagaaagctatggcttgaatacatctcccaaaagttcataggtttgaaacttaatcccagtgcaacagttttgggaggtagagcctaatgagtggtgatatgatttggctgtgtccccacccaaatctcatcttgaattcccacgtgttgtgggagggacccaatgggaggtaattttatcatgggggtaggtctttcctgtgctgttcttgtgatagtgaataagtctcatgagatctgagggttattataagagctcctgtatgagctctctctttgcctgctgccgtccatgtaagaagtgacttgtttatcttaaagagtagcccttgactcccttccatctgtagtaatttctttagcaaatggttgcttggccacattttttcacattttaccttcccatgctgtgaattttccaaggtttttcactctgctttccttttaattataaattctgcccttaagacaatccttttctgtcacacttcactgtaaacagttaaaagtagtcatgcagcagggtgaatgctttgctgcttagatatttctttcaccagatatcatagttcctcactcttaagttcttcattccataaagtccaataatatagacacaattctactagtctttgcagaggtgtaacaggatggcatttactttagtttccaataccttgtttctcgttttcatctgagatctcatgaaaatgacatatatatatatatatatacacacatatatatacacatatatatacacacatatatatacacatatatatacacacatatatatacacatatatatacacacacacacgtatatatatatgtatatatatatacctgtttatataatcaccttcttgcctctagagacagttctagacttaaagtctattttgtctgatataagcatagccattcccagctttcttttgattaccgtttgcatggcataacttttcatgatataagcataactacccctagctttcttttggttaccatttgcataacataactttcttcagctcctcattttcaaactgtgtgtgtctttatatgtaaaatgagtgtcttatgaaaaataaaccactggatcttgttatattatttttttcctttaaatccattcagccatgctatgccttttgattggtgattttaattcatgtatatttaaagtaattattgacaggtgaggaattactaatttctttttgttaattgctttctatacattttgccattgatttttctctctctgctctcttactgtcttctttttaattagatggttttttgtagttatttgctttgattttttttcttcttgtatattttatgtatattgtgggaattttatttgtggttagctcaaagctttcataaaatatcttgtagttacaacagtcttttttaagttaatagcaacttaacttcaattgaatacaaaacctccacacttttactcccctttttactctgcccgatttgtgttcttgtagttagagtttctttttatattgtgtatccattaacaattttgtatctctaacctttatagtaggattaaaagtaatttatacaatacaattataatgttactttaacctccatttctctgtatgtttaccttaaccagtgagatttatactcttacatgctttcatgttgctactcagcatgtttttgttaaaatttgaagaacttccttgtgcatttcttttaaggcaggtctatagttgaaaaactccttcaattttcatttgtattggaaagactttatcccttcttcacttttaaagaataattttgttggatatattgttcttggtagacagttattttctttcagtactttgaatatatcatcccactgtctcttggcctgcaatgtttctgctgagaaatctactaatagtcttacagggattctctttcacataatgagttgcttttttcttttggctttctaatctctttgtccttgacttttgataatttgattataatttgtctcggtgcagtgttttggggttgatcttatttgggaacttttgagcttcatgaatttgcatgccatttctctcctgagatttggggatttttcagctgttatttctctaaatatgctttctatcaatttctttctttctttttctctttttgggactcccataatgcataaactggcccacttgatggtgttccatagatatgataggctttcttccctttttttcatttttctctcctatgactggttaagatcaaaagacctgtccttgaatttttagattctttcttctgtttgatcaagtctgctattgaagcactctattgtagttttcattttattcttcagctccagaacttctgttagactcttttttatgatttttacctctttattgaacttttatttttttcatgtattgttctgctgattattttcaagttgtgtatctgtgtttgcttgtagcttgctgagcttctttaaaataattattttgaattccctgtcaggcaacttattattctccatttctttgtggtcagttactagaaaattattgtgttccttttgtggcattttcttgatttttcatattctcatagacatgcattgatgtctgcacatttgaaggagttgtcacctctttaaactttatgtactggcttcagtaaggaaagacctcacctatgggaaggtatgaagccaccaactgggtgggtatggtagcttcttctctgaaggacacagtggctgttccagctccaggagtgggcagcagttagactccaggtagttccatcagctgaggtcagcactggtgaagactacagcgtttttagtagacaaggctgagagtgtctgcaaaggcagcaatgacttgcagggtccccagtcatgaaagcttttgaagtcctcctgctttccttttcacccacaggagaagttgtggtagaggggattcttcttggtgcctgtgtctgaactgtgaacatacatcgaacaatggtggtactaggtctggaatgcaggttcatatggcatggctatggatttggatatggatgcaaatgcacatggccaaaccacttcatttttaaagctaatttatatccagaagtcatgtatatactctttattccttctcaaacttgaatatccaacataaataaggtgaaaaatgagttaaatataaaaagtgaaattataactagggaatgaaatattatttgtattgaaataatacactgacatctttcaaacaatacaaggtatagcaaaagaaaaactgggattccatcttagaaaagttaaaatttttattacaataaaaaaacagaaaaaaatgaataccatgtaacatgattaaatcaaaacgtgtatacaagggcaatatcatgagactttatgtttattgtaagaacattcattcaataaatatttataaaaacaacaataataacacttatggattccctacaacatgtgaggttctcttgtaagtactttatatattttaactgattttctttttttcatgaataacatttcagactgatgttgcaaacatcattactttatagataggaaaattgaggcagagcgtagttgagcaactggtttaatttcagtgttagtaagtggtagaaccagaattctaccgcacaaatcataatcttaatcagtactttatactgtctacttggtggataccaagcaatgttttggatgtcaagggcatatcagtaaccaaagaataaactgctttccttaagggtcttatattagaaatatataagttaaaactatttttatatactgataaattcggtgaaataaatttcacctctatagaaggagaatattgaaaatgcaattgacattcaattttaaactgttttttttctgtgttctctcaactgtttccattttaatattaaccaacatcattatattatctgaatctctgctatttagacatgagtagacaaaatagcatgtgaaaaaacacattatcactatcaaataatttcattttcaggggtaattttttctttgtacttatgtgaaggaaattagaaacaacgtataaacctaaaactcaggaattttagttatagttctgactttaactgtatccatttgaacagtttttttttccttaaagagatagacaagaaccactagaccaggtatcagcaaacttcggtaaaagtccaactagtaaatatttttggctttatgagccagatggtctctgtcacaacttctctaccattgtggagtgaaaacaatcatagacaatgtgtaaacaaatgagtttggccattttccaattaaaatttattcatggacactgaaagtgaatttcttataatttacacaatattattctcttttaatgtttttcaactattcaaaaatgtcaaaacaatttttagcttgcaggtctgacaaaaacagaaataaggagcaataaaagtatgaaatattttatggaaagtggatagctttgagtagttagaaattagcgttggcaagtaaggaaaagtggtaaataaaaaaacctttattctaaatagagtatttacttggttccagtaaatatattctactctggaaatagaaggctaaggaaagagacaaacctactccaaagaggagctataacgcccaccaagtgaaacttactttctccctaagtcattctgctattcactagctttgtaaccataggcaatttcctttttctttttaccttaattggctgaaccataataataacttataatgatgttgtgagttttaaattaattaatacattcaaacaacgtaaaactgtggttggcataaagagtctttcagtaaatattatgcttattattgattttggtaatgtcattgtggtctttttagatatgatactatccatctcctttaaaggtaattgaactgagatttagggaggcagagtgtcctgtctacagtgagactgactagatggcaatttgttggagacaaatagaattatcactattctctgtaaatctcattttctttattcataatagtaagggtgtaaagaccacttaagttctgcttccttctcatactgacattattttgatatgtgcacatttaaaaatcacataaaaataaaatggaaatgggtacagataaatgtaacatgataattaccattagaactgaagtaaatggattactttaaaaggaattggccagaacaatgggtttagtatgcttttgttatttctaagaaaggaactaaatgaataaatcctttttattgccctagcttgctttgttatatgcaagattgattaatgaatattgtttctgctttctatatttttttcaagcacttttcaaacactttgaaacgcttttccctaaaactctcttctttgccataatagaactaaaataatagatctaggacacagcctataatttcgacacatttgccatgattggagaaaaaacaaaaaaacacatgtatacttacagtgttaaccatgcacggctgaagaggtcaaatttcatgatgctagaggaagaatatagaaatcaataagtccatcttcagagagattcatttcagtgtaacattttaagagactcaaattgatggaattatagtgtgtttggattattaaagcagaatgttagttctaaaacatccaaatattcccgaaagcaaatggaatacacttgaataaacagaagacaaagacatgattagaatagggcagatttatctttttaaatttaatactattaacagtgtttgctcaaagtatttttatacttcttagcatacataaagtaaatgaaatataaacttttagtcatatattaacatttcattttatttaaaaataaatatttattgagacttttgaaaacaaatgctctcattcacagagcatgtttcctgctttataaaatgatcacgtacacacacattggattatttagtttgcattcactctcttctcagcctaactcagtatctttaattttgcttttcctttttattgtagttggggagataattaattactgcagtcagttgtcatttatgcccttagctgaaactaaaccaagttagcagattttgatacctctgactttagagggcaaagagccctgtgggagtgattgtgaggaaccagtatgaatcaagatagcctccattctgtacaaagaagtactttataataatcaataccttcagtaagttctgtttgctgttttcactgtgagacacctatttccctttttgaataggatttttctgtcttgttcaaggaggtgagaagttattagcaatagcatcttccttggtgatggagattttaccatattttctttatgaaattcaaaacttttaacgcaattactgccaatactgtcagcactcaacactgaattattgcagtttctttatctttggtagggcacttctcagtactgtttaccttaatgaatactctctacccttccttatttatctgcttatatatattctaaattgagtcttgctttcatgcagtgatacatacaagtggttaagaatgtgttttcctaccactaacacttttgaaaaactgtttagaaattggtgtttgctttcattctctggattaattctttcactttcctgtattaacagcttccttggctatttttcttactattcttccatattatgccactcttagttgctaacctagtaaaataacagtcttgccttaacaatgtccactaattcttctgaccaatataaattgttttgtatattctgtagccttttacatgcctctaatgaagatgctagtattttattttattgtcattttaattattagggaactacatagatggttaaaataaatgatgcattatcaagcatcagaaaatgtattgactgaaatactgattagacaaaaagaagagagatgttagtacaaagttgtaattttcattagaattacatgttaataacaatgacaaagtatagctattgtcaaaattactattgttgaatattataattctaagttaaatggatagtgtaaacatctcctgcaaaaaagcaaaactttctacctgagaatatatttgatttttttttttttgctattggaatcattctgttttaaacttaaaactaaaaataacagttttgcattccagttactgttttaggaagatttcttttttaaaaaaccctttaaatattaatttaaagaggattttttaatcattataaactaactgagtttgaattccatgtgtatttagatacaagaaagactagtttagatgtaaaatttggaaatagccaaatttatgtactttttatatgatgtattttcaattaaaaggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagccaaaattctcacaatgcaaacctctcattcttacctcaaagcaatttgattattcactggaacagtttggtgtcacaagctttcaaaatctgcccatggttaatgaaagccatttaaattgaatgttacatgtaagctgatcaaactgcacagactacatgaagttgctctccattggttttaacgtgcttcagtgatgcttataaatcttatttccaaatgcagagctagaaaaggaaatagttactggcttgggtttcttaattctatttaaataagtgtttcaacctttatggtttcccaattaataaatagcgatacaaatgcaaactattgtgactgaaagttgcttaagtttaaattgtaaatccctactgttttactagttttttcttgttgtttgtgtgtgtgtttcaacttcattataatctaagcatggaattcagctagaagtagaataagtatctgtgtagaagcaaattatgtgttggtgtagtgagacttcaataagtgtcaccctgggaattgttaattgaatttgggataaaaatagatgaaaagaatctttgttaattagatgtgggcactatctggaagttgttaaataagtagagacaaatattaatttaaaaacatgagaatgaaaatccctgtagaaatagcatgaaagattttatgtagatgtagtttattttaaaaagtagttaattttttttcagggtaagtttaagtgcttatgctgtatacgagttataaatgaaaataatcagtaaggtaaaaaccatgactttttttattttggggaatatatgaagacaccttttaaatgtttttgaagacatcttctaaattgtttgccaacgcaggtcaggaaaagccccctgcaatcagaccacaaacttgtagtcctgaccttgataaatatttaaattgtgtatgcaatgaatcatttcactgattaccaaaaggcattacagcataatatttttaaaatgttttgaaggaatcagacctgaatcagaaatatctctgttgtgtctttttctgtatgacttcaagtatattacatatttcctctgtgttagttgcctcatttgtaaaatgaaaataaaaataccaaatttacaaggttactggaaagattaaatgaggtaatgtatgtaaattgttttatttcatatggggcatgtaataaatgttcaagacatagctattattacagctagaagttcttaattagaaatttaatttctcaactcccatttcttcatgtatattaatatttcagaaagacaaaggaaaatgaagtgaatactaaatcaatttacattgcttttccttttttattggaaaattctattggcagaaattagtttcttagacactcttagaattccatttttctgtccacaaacaacgattcattctaaatctaaagcaaatacacaatgtgcttcaatgcatgtgaatcatattacctaagctgcagtatacttgagaatacattttaatgttatattttaagatgcaatgaaattgcctattactttgagtttacaaaacaactcttgatgactttcattaaactgtccttccatgatcctgctgctagcctcctttacagttgcttatgccttctactttatctgcctcctcacgctagagcagtgactttcctacaaagccattgcagtatttcccattcttttatttctttatttccccagtgagctctacccagaatcctttttaaccttgaagcctataatatgaacatttgaaagaccttcaagttcttatattcctctatatggataactaattttcttctccatgtatacatcctgtgaacatttctgtccaatttttccaactcctcatatgcttttttttcattcatgtagcctgtcatcattttttttgacattctacaaatatttctagagtgcctcctgtttgtcagtcagtgtcctaagaactgagaataagtaatgaatcagaaacagtttctagtctcaaggcactgtgtcaaaatggttggtgagaaaactaacatccagttgtgataatcacttgcatgacatgagttactggagattactaaggcattctgtaactccttgggaagatattgtccccgaattcatctgaaagacttaaaagctaagtgactaagaggcagttaaagaggaacaaaggttacccaggtgaatataaaaactcacagccaagacggcactttttatatgtgtgatcgaagcctttcagtaagctagagcacgcaatatgaatagaaagataaaattgaagaggcaagtggaagtcaattcattattgtcattgtcattacatagcaagtgtttaatgtacatcaaatttgactaagtattttacaaacaaatacaatataaagtagatattatttgccctccatttgatataacaagaacctgaacttgaggttaaatagcttgtacaagatcgtacaaccagcaacaactacatgggccaggattcatcctcagcctttcaagcatatttaaggaatgtttcacttccaggaatcacctttcaaactacttgtacctgattattattaggttggtgcaaaagcaattgtggttgttgccattaaatataatagtctcagggtcttttaccaagaaatctcaaacctggaaagaaaagataatgtagatgcaaagtttatgaaaagaagcaaatttatataatgtacttagcacagtttctggcacattataagagctaaataaataattgctattttgttattgtagtcctactgcttcctttttttttttttttttttgcctccttaactagaatgtaatctacacaagagaaggaaactgtctgcatttttcccagtattttgtgatacttagaacagtgatcaaatgaatatttgttgaataaatgtattaatatttattaaaccctcaagaaatcctaaaattttagcataaaaagatatttaatggtctttgttatttttgcccaaatcatttttttcatgataatatgtttccttaagtctccaaggcatcaacttgcactgatgttttacctctcttttagggaggacattttacatcattgaaagaactccctgaaatattgttataaatctcaatatttgttttcaatagttatttacattttctagaaagttattctcccagatatccacattgctgttccctcttgtcctcaagcccatactcagaaatcacctaatttgtaatcaaattatacctcacagcattcctcacttggtttgattttctcttttctgttaacaccatttaaaaatatgctctacttatgtttgtttataacttattttccccaatgagagtacaatttccattaggaaggatttctgccttttcctcccattgtgtttccctaacgcctggtatgtcatcagtgctgaatgaatatttttgagataaatgaatctctccaggatatcaaagaaaaacagttgttcacaggcaaggagctagaagagagtctgttgcaagacatagtagtgttcaagctggtagaaaagaaaaatgaaggctaaagaattttgcagactggaggcccagccgccaagactaccagttgtctattgtgtagggtcagagcttgtcagagccaaaatcaacctgacagaggcaaggatatgaatgaaacctagaagattggcttgaaaatataacgtgtttgagagtgcctagaaggaatggatcaggctgttataagcttatgagcaaccagaaaacacaaataaggatcaagacaaagcaataagccagagagaaaaagcacacagatgcctgagatttagttgaagcactttagctttgctagtcccatcattcctccaactttttccaggtactttttgccacaggaatattaaacaacttacagtgcgaggaacacaaagttgtagaaacacaaaatgcctgtgatcttctacacacctaaaaaagtcttctaccatgtctgtctggtaaattcttagccattctccaaaatcctcacttaggtattgcatactctgtattgtcttccatgtttcctgctgcatttgcaagtcacttttagttgcaagtgacagaaaaccatttcaaatgagttggggcacaaaaggggaaatttggggcttggatcatattactaaaatgccaagggtaggaatgatttaaggatgcctagaatcaggaccagaagcaatttgttagggcctcatctcttccatgtgttttctgcatgaataggaattaatggcaaagagtacccctttcatattctaccagcttaccttccttagtagatagagagaatcgtttcccatagctcagccagaaacatgtaaagtaataatattctgatttccctggcttgggtcatgtgcccacccatttgccatgggctcttggttccttcattgacagtctctgtgggattagaataagaaaggaaaagtctccagtgaaaatataagatgttattatcaaagaaatgtgaagggatacctgaaagcaaatgtcaacagacacttgataaatgatgattgaacattaaaaacagttgtgaaatatttatcttgaacagagttccatgagccttcagtgggttgctaactcactgaaaatatatgcaaaactttgcctccatatgaatctgtccagggagacgtccaatcttaatgacatacaaaggattccagcaagggtatcagcccttggaaataaaatgattatgcttcctatcccagcccgctattaacttctgatttagtagaccccaaatttaaaaggggagccatttgagccaatgttacaaattaggaagtataaggatacggagttaagttttatttgactcttacttcttagtccatttgtgctgctgtgacaaaatgtctgagactgcataatttataaacaatagaagtatatgtatcacagttgtggagacaggaaagtccaacatcaaggcatcagcagatttggaaggactgccttctacttccattatggcaccctgaacaatgcgtcctcacatggcagaaggtggctggcaaaaggcttaattagctagtacccttgaggccttttatattggtactaattccatttatcgtctcctaaagaccttacctctcaaaactatcacattgagccctaggtttcaacatacaaatgttgggggttggaggagggcatatattcaaaccatagcagttgtccccattaatctttctttatcttaatctgatcatttgttaaatatgaatcatacccccttagcagataaaaatagtttagcacagtacttgtacatagtgagtttttcagtacagttatataagaactgggtaaacaacaggacttgtacataagtggttcctcctactcaacatgtaatcatatttggagtagtgtcttagtctgttttgtgttgctataacagaatatcacagactggatgatttttaaagaaaataaatttatttctgaaagttctggaggctgggaagtccaaggcatgacactggcatctggcatgagtttttatgatgccttatcccatagtagagggatggaagggcataaaagcatgtgagatgatacagagagaggatgaggggcaaactccatccttttatccagaacccactccaatgataaataacccactccagagataacagccttaatccatttatgagagcaaagccctcatgccgtaaaaacctgttaaaggtcccacctcttaataccattacaaaggcaattacatttcaacataagttttggagggaacatttaaaccatagcaagtaggccatgttgtttagtggtgaggcatccagacctacgttagttttcttgtaggcaatttgcttgggccctccttctgacaacattccctctcagtgagagcctagggaatattttgaggccattagcttcttttcattctatttattgtcccaagctggttccctagccatctcttgtgttcacttctcaaaccagctaagagaatttcctaaagaagtctgtgctaccttaggctccagttatttattggtgacctcttcactctttaaaacagattgaagaaaatgcttaacacccaaaggggaatttttaaaagagaactacaaactttccccctttccccagtgtcaaaaataatccacttattaacacccacaattaaatcaggtgctgaaactttggtttcataactacccaggataatttgttattggagaaaatagcatattacagtggtagagaatatagaatatgtcacatttgttcttctgtatcaagagccaacatttttagccttgattcatttttacaaaacaaagtttgcatgttagtggttgaaaattatgtcatttttggaactaattgtcatgtatacactgtagcaaacttgaagtttagaattttaaaaatcatagtggctcaattatatttgtacttttttctgaatgaatttgattttttgattattttttaatagggacattaattcatcttttcactgattcattcaataaacttttatagatggcctgctttatttcaggcaccaggacatatttgaaagtcatctgtttattaaacaaatgtaagctaatctgtaagctgagagttaaatttgttctttaaatattttttaaatgtctcccttcacttctgagtagattaataatagaacaaagcatataatttttaaatggcctggtactttgtattagcatttctgttagtcatagatgttttcttagtggaatgtcaacaaatgatacttgaatattttaaaatttataattcataaaatctcatgtatcaattgtaatatttatgcaaaaagcaataagttaagagtgtaatataaaaatgatatatctaggagctattttattcttcttgtcattcctttgatgtaatctatttccatgttgactaatgtgaaaagaatgtttctgaagttttttttacactccaaatctttatcttttgttattttttgaattaatcaggtttagattctttgttttcccatatccatgtattatttaattcaacacatttttagtgaataccctgcacataataatttgatgtgctacttcatatgaaaatgctgttttcaatgaagcattcttttgaaaattattttctcaggagatattattaggacttgtgctagctaaataaataagcaaatgaggaagtggagaaatggaataataaactttattgagtgctacatgcacaaaaataaatagggatatattgtacaaagtgtttgatgacaacacacattcactctgaggagttgtatctcaactgtttttaaagctgggattgtgtcccctgtgatagctgaggaagaatgttttagacaggaagatcatcaaattcctcagttctgtgtaagaaagagacagatatgtttgagggatggaaaggaggccagtgtcgctgaagcaaagggctcaagtaggacagtatagaccttgttaagaagtttaaattttggctaaataagctgggaaaactttaggtttttttaacaaaattttaaagtattttattttattttattttattttattttattttattttattttattttaagacagagtctccctctgtcgcccaggctggagtgcagtcgcgcaatctcagctcactgcaatctccgcctcccaggttcaagggattctcctggctcagcctcctgagtagctgggattacaggcgcccaccatcacgcccggctaatttttatatttttagtagagacaggtttcaccagttggccagggtggtcatgaactcctgacctcaagtgatctggccaccttggcctcccaaagtgccgagattacaggcgtgagctgccgcgctgggccaaacattagttttgttagaaagctgaagggttacacaatctaatttaagtttgaaagatgtacctggctgctttgtggataatagattgtagatgaacaagagtaagcgtgagggagccaattatttggtgtttacagttatacgagagaaaagaacatatacctagagaaggatataccaaatgctcaaataccagagatcatatagctagatcaactgatgtcatggacacatggtggtaatatggcattgaaatagtgtcaagtagcagggcaaacacccaaccccttgatatcatgtttttttcagttaatgattattcgtcttgtgacatgttggtcttgtaatttccacatgtaagtttaatattattcagatcttattgtgcactaaatactatgtacctttatttctcccagaactaatattgactactatctgagttgataatacaataaaatatgccatggaataaataagttacagcattaatataatgtaaaatattttcaaagtgatatatatatatatatttagcaaatgtattttaaaacatcattttaaaaagactgaaatactatttttcactctattactaggatcacttatgctataagtacccgagaatttgttttttaattgaaataattatgtcattaaaattgagctgaaagtttgcaagaataactgctttcttaatttgtgtttgcaaattaactaaatttggtaaaataatggacattaaaattataataataaaacaaatttaatacatgctcatgacagcattacaaatttttttttaagttcagctgtgtgtctgcttatattaaattgcagatgggctatcagtgtaggcgaaattgctgtgctcataattagtctttaaccttcaatcttttatgtttcttgtatactttaaaaatacagaccaaaaaaacatttttattacatcctacaaattaatttaaaaaataatttctgaattaacatcacgtgaatacaaatatatcattgattttagatacatttccaacaagaaaatattttcttaggtaaattttacagtgctttaacctcttcttagtagagatattatgaatttttgtaaatattgttcaaaatggtgacctacattgaaacacatattttgaataataattcagtaaaatgtaatgttcactttctggttatttgttagtgttcattagttcttaaccacattgaagtaaattcattttctttttatattttattccctatttagactttaaaggcatagtgcttttattttgcagattgttgccttgcgtgaacaaaatgttcatatacaaagaaaaatggcatcaagcgagggatccacagagtcagaacatcttgaagggatggaacctggacagaaagtccatgagaaggtatgacacaccccacatgctcttacatggaaatgtttacttcttatatcatttgacaggaaatataaaaaccacataatgaacatttttttagtatttgttgattctttggtcaaaggttcaaggtttatggttatttcctttctaatatttgttcttattttgattctcttaaatataatacatatgtgtatatgttgtgtgtatgcatatacacatattcaaattttttacctgctcttaattgattttcttaaaagtatttaaattatatagaattgaatttataatatgtataaagaatataatttaaagtacatatatacacattgtgtgtatatatggcatatgtatatatatgtacatatataggcaggactattttaagtgcaaaacaacacttttgaattgtaagtgatataatatacaattggtaacttatttgttgtttatgactgcgaaaattgttggtaatcttttatttgattagtatttttcttgcattgtttgaggcctcagcagtactcttgttaatgagagataacataaaatgaaatgtgaagtcatgggacttttacattttttataatggaatgattctccttttgggtgaagtttagtcccacacaaaggaaactagcgctctgttgctccactagcaaaagacaaaaggtgtctgtgctggaccacctctttccaacagaagaggaagaaggtaagttattggtaggtctagaatcagatgaaaattacatggaggcattcacacatcctgtgttggaaactcaggagaatcatttgcctgtaacaagttatatctttggattcttaagctcctaaatgaagaccacatgaatcagctagctaaattgctgtaattgaaaatgtcaagagtttctaaaacctagcgattaagaagcaagtgactggacaatacaataaatagcactagaattcttactataaattaagtttagcatttcctcacttatgtggttagaaaaaatagagggacttcttatgtttcttccttcaagtagaaaagcaaaataaagtaagtaaatcagatgaatttccggaaagaagcttcaattctggtggctgacaaatgaacagatcttcacataagaccacgaatttagcctttatccatgtattttatagaaatcttaagctaaatataaaacataaactacaatttgacgtatttcattagctgtatctgagattagaataacattatttatctttccttcaactaaataaactgatactgcttcagtagatacaccaccaagctctttaataaggcattttcactcagcactcagtttaggaaaccaacatgtaatttgatattgctctttcattttaattatgtcattagtagtatacctctcctcagagaattatagaatcacaattggctggttataaaaaatggattttatggtcatctagtctttttcataaaaggctacaaattattgttttctataataatgctgtatttatgctaatctactccagaaatgaagaaatatacctttctcagacatgaacaacttcagattttttttatcccctaacaggttatttcatacttgaagtgttcttcttatggaggaggagggcagggaatgctcatacatatatatttttttcaaatattttttcatcaaggtactgttagcagcagcaaatccatacaggtctgcagcaacctcaattcttgttttctcagaagaaagaaattgactgtggggcatgaggcaaagggagagaccaaggcaagtttcagggcaggaaagttttagagcaggaacaagaggagataaagtacagctggaaaagggccaaatgggcaacttgagagattcaagtgtgcaatttgacctctgaattggggttttatacactggcatgcttctggagttgtggtacttctgccctgattcttcctttggggtgggctgtctgcatgcacggtggcctgtcagcacttgggaggggccgcatgcacagcatgtttactgaagtcctatacatgcttactggaggcatttttcccttaccagttgagtgttcctagaggaatgttctattcctataccagttaaatgctgccattttgcttctcagtgcacatgcttgagtccacttgcccaactcctgagatcttatctggaaactgctgatcaccagattcaatgttttctatttattacagtctgtcttccctggcactggcagcaaccaataattgttttacagagagagtttaacaaccacctgaccatcacctattggttgcctaactacctactctaacaatataaccactaaatatttgaatatgcagacattagagaatgtaagacagtttatgacagattatttttcgggaactggttacagaattaggatgaggatttatgcataattgatatttgtctctattggtcttcacagatataagtgcacatatggaggattttgagacattggtgacccaaagcaattgtctttaactttttttgacttccagttcttagtgaaggcatttcagccagtggagaaaagaaattgtgtgccaatgctaagtcattcacttcttgtgttggtgtaactaaaggtttttaaacattatgattactggtattcatttgcttttttcagcttccttgaatttctaaaacagtgatttctaaatgctttagaataattatatattattatcatgcataatatcatgcccatatcctttggtgtaaacctaaaatgtgtataatgtatcatatatatttagtctaaatttaaaaatatgtaaacatgtttcaatttatattaatcctgtgattgatttctcaggatgttccaataaagtgttgtaataagaagttttatttatgccacatttttaaatttatttttatttacatatttttgagacagtccaggctgtagtgcagtggcatgaacttggctcactgcaacctccttctcctgggctcaagcaatcctcccatctcaatgttccaagtagctaacattactggcgtgagccaccctgcctggctaattttggtaatttttgtagagacagagtttcatcatgttgaccaggctggtcttgaactcctgagctcaagcaatctgcccacctcggcctcccaaagtgctggaattacaggtgtgagccaccgtgctcagctataccacatttttttacctgacatttcttgataaaacataaaacagtatcctgattattattttcattgtccttatataaatactcccaagttacacacatataatattatagagcatttttcttatcaaaatcatcctccatgacatgattattcaaggtatattaatgccataaaacaagttgtcaaaggattgtaatttaaagcctaatacttattttttttttattgagaacttttaaaaaggtatattcaaacaaaagaaaagaaattattattttggcagattatcaacgatgactgtagtgttagtgtgtaaattgaaaagtggttgatcaggacaaaaatgtaaaactattattagatactgatagaactaagaaagtgacttctaaatcctagttggaaggattaccctttgtttagggcagttaatttgcttaagttacacagtcagggtgggtgattagcccaaagaagatgttttgtgtcggtggattgagaactctgttgacaaaatagttgacaaaaatagcctcacaaaagcacaatctgaaataggccttattattcatggaaaactctggtaattattatcagcctttttaaaagaaaaaataaaaagaaaaaatacacttaactgaaacgaatttaaatatttctgtgtggtcttaaatttaactgattgagaagaatataaatattcaaggataatacaaattttcataacactaaattccaccttttcagaaccaggctctaataactttttcctatttctttctagatggaagttaattggtgaattttaaaaagtaaacatgctactcttgtaaaggttataataatgctcattacttgtataatctgtacttctaattattttttcagctgcaagtatttgctaactgatgtgaatcagtagaatattagatatgttagagattcagaagatatagtctgtaataaatttgataagaatctacagtgagaaataaacatgcccaaattaatatcataaaacatgataaatattgtggtatcaaaaataatattagagtttaaaaacaaggttaattaatcctcattgaggggtgtcagagaggcaatgtggaatagcgatttgtttgaagttcctgtctctgccagctaccagctgtatgaaccttacccttaacaccgctgactctgagtttcagataaaatagtcttgccaacttacagagttataagaatagaaacactatattcaatgaattacatcatcttaggcatattgtatagaagcaataaatgcttattctatttattaatcctgtgttttcaatcaaataaatatttagtggcaaccttattaaaggtgctaagaaatgggccctattctaggtggtaggaatataatgatgataagacagttgagggtacaggcaataaacaaatatacacagtgtaaaagggcatagatatgatcaagggacccgtacaaggtgagtggtgaagacattaaagaagggatctttttaagatggtgggatttgaactgatgcctgaaaaagtaccaggagtcaacaatatgaaaaactttcacaaaacagtagtcacacttaactatatgcagtgaatttttatacgtgtcatgtattagtgactgagacactagttcttcatagatcgaagagtggagttgactgatccttcaatgaccatacaacaaatgaggcacatcctcggcatgtcacatgaggttcttcccaagctggctggcctcttctcgcctcccaggcctgtttgcttatcattcccactttgagcttaattactaagtgaactaagttaaagcttccttttttaagttgttgctcttattcttctctcctctttgaatctgacatttattcgtgactgttctctaaaaatgcaacataacaatttaagcaacagtaatatggaaatgtgaaagctgaataaatgtaaaatcagaaatagatttttgtttgcatgttttcagttctttagttcttgtcagatagaagaattatggacaaaaaagtacataaagcaaaatgaagaatcagtggcaagaataatcctcagatcggtaaatttaataaataattgtctagtatttttattatagaactactgttcatgaagaatattgagccaaagtgataaaaatggaatacgggatgtgcctttatcaaaattaagggttttgtggacttttagcaatacaatgctgttttagaatgaacaaccaatgacaaaaataggtacttagaacaagccaacatagctctacaagcaatgtgatcctcagtggagacaaagtatttcattccatcatgctattgtgaaatattgagatatcatagtgtgaagatttgcacactctcatgcaaacctgtcagctgtccagttaaaagtttggcttatcaatatctcatcctattttaaaatactaataaacatcatttatcacaaatgccattcttttaatcattctcactaagttctgactaaaagtcatcatccacaggcatgtcttcaatatattgactatattttgttcatttttttgtgttcatcaatacatgttaactacggccaacaaccattctttcaaagattcagtcttgtcaactgtagctcattttatgcattattgattccctctctcaaaaatataattgggcttatttacaaatggattgcactcacagaatattttcttctgtgtattgattccatatattgtattctaattccttacaaaacataacgacttgaatgtttctcctttattcttcaattgaattgtcaagcagtgaaacaccaaactgaatggagtttatgaatttgccaacttggaaagagcaggtctaaagatatacatgggctggactggcccagaggttcaatgattggctagaaaagggaccaaaagagtaaggttaggatcttccatggcttatccatatatacatgaagttgtatcaattttctagaagctgagttggcgaggaagcacataacgaaaggtctggaatcttctatatgcaatggcaaaaataaaagtcttctaatgctgtgtggaaactcattaggttcaaaacaaatcgctctgggtgcagtgactgggttattgtgtgttaactaagaccttgttagatggaaagatgaagtgaaatccactctgctgtcttcagtaagaagtatcatttgtattagccaggatttgagggactcagaattttttttttttttttttttttttttttgtgaagaaggatatttccaaagactttaaaagactgactgactggaaatttgttcagttacctttatcttattaacataattggagggttcattttgtgccaaggaatctgttgtcttttggtgatgtacacaagaataagttctttttcctctgttttgttttgtgcgatctgttaagcaaggctaggagaatttttaagtttttcattcagaagttcctcagttgatctaattgtattttttcactttggtagaatttatctatttcatcatttctcatgaaacacaagctccccagaaatttagtgggtgtttgataggacccactcacccaacaaatgaaattcccaggagaagcagattaggaaatattgttgtgtacaatttttaactggtgtaagtactacagtatttatattttaactcttagtattgtcgagcgtcaagaaagaaacacagtatgtagtgtttccagagacgctctttacccacagggaaataagagtatcccagaatgagaattcaacaggacatgccttaatatggaattaaggaatgctggtgcttaacctttaaagttagccaaattgtttttcaaacttgtctggaaacctcattaacaaagcggctacgggtctttaagaatgagataagtaaccagcataaagtcctttatgtgagttgttttatttgatctctgtaacaacaaccctgtgaggtttgcagagcaaggatcaatggctcaaagtaatgtagctcatgaacagggggattggagataaacaggtaacaagtaagtaaagaataaatgtgaactatggagggaaaaggcagcataaaaactacctgattttatagatttcaaaatataagattatttactttaagcaaagtcttaaacctgtccatgtttctaagaggatggaagagtttattagactgagcatgaggcttacaaaaatttcaaaaaagcctagtcaaagaaaactttgttacaccatgtgtaatgtcttcagcaaacatttaatcaagtatatttccccagcaaattttactgctctttcctttgccatcattttcttttctttgtctactccaatggtccccaaagtttttggcaacaggaaccagttttgtggaagacaatttttccaccaactgggggtgtggttggggatggtttcaggatgattcaagcacattacatttattttgcactttatttaaattattacattgaaatatataatgaaataattatacaactcaccataatgtagaatcagtgggagctctgagcttgttttcctgcaactagatggtcctgtctgacagtgacagatagtcaggcattagattctcataaggagtgcacaacctagatccctcgaatggacagttcacaatagggttcacactactttgtgaatctaatgctgccgctgatcttacagaaagtagagctcagacggtaatgcaagtgatagggagtggttgtaaatacagatcaagctttgctcacacctttacctcctactgagaagtctggtcccaaacaggccacagaccagtacatgtccatggcttggaacgtgggcacccctggtcgactgtattcttataatatacaaagtttccctaacttaaaaaaaattatcttttggccccacattttaaaatcccttataaacctatttcaataaggttttgccccaccatagcacagaagccactcctgctacagtcatcactaaatttatagtgctaaatataaggccaattctcaggccttgctatagttgatgtctcagcagtatatgacatagttaatagttttcttccttcatatacttcttcacttgcattacaggaaactacattgttttcctcttacttaccagtggctacatctccatctattttcctccctctgacttctgaatgttggagcatctgctctctgaagaacagatgataagtctgtcttggcatgacaactcccagtttcttctcttcttctctttctttcttcaccccagggctcagccctccacatgttctctacctacactctctccatgattccaatcaatctcatcctattcatatactaataatttatgaatctttacctctagttcagaccctacaaccaaatgcatatatccagccacaatcgaacatctccacttgtatatctaaaagactttgcacatttaaaatatcaaaagcttacgtatttgatatccccccttaaaaaatttgatccatcatctccagtttacatgatgaaaactttgcctttccagttgctcaagctaaagaatttggaattactctcacatcctccctatgtctcacacctcccatccaactataaagaaatttgatttactctaccttcaaaatatatccagaatcctaccacttccattgatcactctgttttgaaccactgtcatctctcagctgaattattgtaatcaatcactttttatgaggtctctctgcttctcccatgggccatctccagtctatttttaaaacagcatgaatcagagtaatctgttcattttcatttttaaaaaaatgtctatggatatattctaattatgcatatttatatggtgcatgtgatattttgatacaagagtgatgttttaaaccatatatctgaacacatcaatcgtctgctcaaaactctgcaacttctttccacttacacaaggctctacataaatctcactgtctttatcttctgacttcacatccaaatccaccccagccacactggcctcctgttgacttttgatttcctctttcctttgtctgaattgcctttcctccagatacatggctaacttccccacttccatccagtctttgttcaaatgtcataacatattctaacatagtaatgtattatagcacagcatgtgtttatatgctttacttatttataatgtctgtaatgtattgtctgccagcccagttagataataacctccataaaagttaggatccttgttttattcctgatgaagctcaggtacctagaatagttcctagaacatgatgaacacttaataaatacgtgttcaagaataagaaataaatatcacactgttttaatgattaactttataaatcttgattcttagagcttaattataatatcaacttttcaaattccatttttcaactctgttgagattgtaggggccaaggagaaaattttcttccaccctctaaaggtttgctgaaaatgaattgagggaaggcagattaatgtgaaaaaaggcacacaaaacttattttaacacgcatatggatataactgccatttacaatgtattagactggaagaggggccagagggctgatgcttaaatattctcgacataggagatatgtatggattcaggaggcagacattttgcaaatgattctttttggaagctgggtgggactgacaaattaaaggaaagtaaggggaaagactgtgcaggaataaatattgctttattattgcagattaagtcccctgggtaatctctgggagctgtcctctgaagaacagattataaatctgtcttggcatgacgactcccaatttctgctcttctctagtggttaatctgacaggattcctgaagaggggaatcttgagacaattacattccttgtggaaagaagtgttttcagtcagataaggaaattccagagagagagagagagaaagggaggagaggaaggtcagagacagatcttggttctaaggattatttctgaggcctttcaattttcaaagcgctcaacaagccaaagtcatatttgggggaatcgttttctgtgccccaacaagatttttactgcaattgcttaaattaataaattaacttcgggaagttattgcctctattgtatactgttttaccatgtgtacatatggcttatgtctccattcatttgtgtattattttatgttcttcaataaaattgtttaatttttcccatagagatcttatatatgattagatttatttctaggcatttatagttactgtgattgttatctcctttatatgtttttcctaataaattaatactggcatataaagatgctattgattttccaatattgatatggattacagcaaacttgcaaaactattagttctaagagtttgctatactcttggtattttctaagtaattacacagattgggaggatttacttttctcttctcttccttttcagttttcatttattgttattgtccaagacatataaagcttgtaaaagtatagactttaataataatgctattcattaatgtgatgcttatcatagtaactggtagatagcttttatcaggtttggaatttcatttacaagtttgctaagaagtattttcagaatacaatatactcatctttcaaaagtagtggatttcatggacagtttttttttttttttaacttctgggacacatgcagaatatgcaggtttgttacatagatatacatgtgccatggtggtttgctgcacctatcaacctgtctctaggttttaagccccacatgcattaggtatttgtcctaatgctctccctccccttgcccccaacaccctgacaggccccagtgtgtgatgttcccctccctgtgtccatgtgttctcgttgttcaacttccacttataactgagaacatgcggtgtttggttttttgttcctgtgttagtttgctgagaatgatggcacatattcttttggaactgtttttcttttcctagggataaacaacttgattttttttttgtatgcatgattctctgacagaagtgaaatttttaaaaatagaaaataaattaaactctgttgtacttgattagtgttcattatttctatgcctaccattaatcctttacatacataatttttgtgacctggatacaggcaagttgagctcttttttgactatctaaaatatataagagcccaagtaatccaagtaacagtaagtctggtaccagcctcttggggccaatgttgttctgcctaagttatctaaaaactttcaaaacttgatcagaccaaaaaggaatttttttgtttgattgtttgtttttgttttttgtttgtttacaattcatgaaaagataactggaaaatgtgataaagtaacaagtgagtaaatttttaaaaaactgctattgcatatttttagccctcaaagtatcacttttgaaacaagtgttccctcaaaatccaacaccatccatgcaccactgcaataacccactgtcatacaggccaaattaaaccatcttatgccaataaatggcctagtttttccaaactagttccaccagcagtagtgacaacctctaccaaagtgattcttcaggaagaattttccattctccaagttttaccagttgaagtttaggttcatactcatgttcccaaattcatcaagatgactgagccaggaaggtctttcagattccatgccagaaccaccactgggtgttggaccatagttcaaattcatactcttacttccctcatggtaagttctctttgtggactcttggtactccttgtgatctagtcaattgtcagtctaccagagaattaagaaaaacattgaacttcacaattgaaaggggagcaatctgttttttcctctccttcctgaagtttcctggtttatgtcaaatatcttcctcctccactctcttaatatcaagacacagtagaggagacactttttgtcagggttctattaaatattcttccttgggatgtgggagcctacttgacttatatttacacatctaaaaggactacttggtaattcatccaggaagaaagatccactctagtgttgattctttattttatagatgaacaacaatagcaacaaaacatttgaaagctttcaatttgatgactttctctaaagaaaaaaataaactcaatatacacaaaataaactcaatatacacacttctcatctcttcaaactatacagagtaagaatttcacagatgaatgtttttctctatcaatcattaacatgtttatttcatgctgtaatgtgggacctagctattttttatatttctgataattattaacatttatcatgggaatattcacttaactgcaatgtaacaggatcaccatgaatcagtctgactgctataagaatgaaaataagaaacaaggttagaaaaaaagaaccagttacaagattgttacagtaattcaaaggagagtagatgacccagacaagggtgacaatggtggaggtcatgacagtgggtcacattcacatattttgtgaaaagaaagccaacaagtttttctcatagattgtataaaagatgggagaaaaagagagaactcaaggatgactccaccgtttttggagaaagtgaaaaagtgaagttctcactaattgagttggggatgaattaaagcaaaacatatttgggggagaagcacgttctgaacacagattttaaacatattgagtttggaaagtctgtttgacagccaagtgtgaaaattgtattgcagttgaatgtacaataatatataagttaagatttaaacttttaatagagataaaaattttaggaatatatattttggtaggtgagaaagacaacaaacatattttgtaaatatataatatggcaggggtgaaaggcctttctgataaagtaacaattgaagagagttctacaaagacgttattagtcatctttgacgaccccctacttcactccacaggtgatctcatccaatgttatagctgcttgcagaaaacatccatatattcactattctttactgtgggcttatacaatagcttgcctgacacctttattttgacatctaattagtcatttcaaacattgttttcaaaacccagtccaggattttgccccatcctaaccacaaatctgcttctcctacagattttctcttctcaaaaaatagcaactccatctttctaatcgaagactacaaatcttgcagtcatccttgagtctatgctttttgtcccatatcatattcaatccattcaaagaatatgaccccttttataacctttagtcctattaccctggtctaagccaacgtaatttttcacctcttaattcattttcttaaattcctttttttgtcctgtcttttataagaggactgaggaatccatcgaaaatgtaagtgaaatcatgtcactcctctgctcaacaccttcctatagttttcatatcaccttgagcaaaagccagtcttaaaatgatctcaagaacacacatcatatttccatctatatccactcccaccctcttgctttatttagtccagtccattctagctacaatggtctccttgaaaatcctaaacccacttgtgtcactttgtctttgatctttctgtttcctctgccagaaaactgcatgatttatgcttgtattgcagggtttagctcaatgctttcttttcattatcaattcccctagtataagcttgacccaaatactgcatgtgacatcattacactcaagtttttcattgtttattgaaaattcaaatctaactgtacatcctatatttcatctggcaaccctagctgtgaggatattgaacaaacaagcaaaaattatccattacagataggaatggctttatctgaattaccgggtttgtgatgacagagtaacagtttacttgcacagttttacatgttacttccctgttcaaacaactttgatggctccttgtcattctatctggtacccaaagtttattctattcagtatggaaaaacaaaggccatcgtaatctatgctggccttccctttcaagtctcatattttaccatttccttatagcacatgttttctgctctgcatacaggacgacttacaattattcttcagggatatccccctccctttgctcatgttattttctgctcctagaataagtactcccctcctttcctttacttgaaatataataactcatctttgaagacccaactcaaaggatatcacaaagatattctctgctttctgctcccacacataaatatgaagcaaaataaaactttatgataatactttattgcaatgcatatccttgcctatttgtgtattacttctttgcttgatagaattgccttgatgtcagaaaagtattatcaccttttaaaacattctaaaacttattatcttccacttgacaccaaagtaggtgattaataaatattgatgaatgagtaaatataaatatatattttaaaatttaacatatgagacaccattgtatttgatcattaataatttcaaatatatacttgtactgctttaaaaaattgaaaatctttatgaccttctgttggggattgattttttagaaatgacaccgtgagcccaagccacaaagaaaaaaaaatgataaactggaacttcttaaaattaaaaacatttgaaattcaaagaatactatcatgaaagaaagtgaaaagatggtctacagaatagagaaaagctattttcaagccatatgtttcataaaatacttgaatcaaaatatatgtaaaaaattcatgtaaatcaacaataaaaatacatgtaaatcaattaatatgaaggcaaataatttaaatagacatttctccaaataagatatacaaatgaacaataagtacatgaaaagatgtccaacttcatcagttattaggaaatgcaaatccaaaccataaggaaatatcactttgcacccactagaatagctgaaataaaaagatagacaataataagttttggtgaagatgtggaaaattagaactctcatacattgctggtaggaatgtacaatggtgcaaccactttggaaaacatttcctcaacatgttaaagatagaattgtcatatggtccatcaattctactctaggaatcgatccaagagaactgaaaacatttgtccgtataaagacttatacacaaaagttcacggcagttatttatagtagccaaaaggtggacacaacgttaatgtccctcaactgatgaatatataaataacatgtaatatatccccatgatggaatactattcatcaatgtagaaatgaggtgtggataacatgctacggtacttgaacgaaattcaaaaacatcatgctcagtgcataaaactagtcacgaaagaacacatgttcagcaactccacttctgtgaaaagtccagaactgcgaatctgtatgacagaaagtagttagtggttgtctggggctgggggtgtgtcagtgattgctaataattataagatttccactaagggtgaaaaaatgtgagattaactaatgttgatagttgcgcaactctgtaagtatactaaactccactgaactttttatgtttaaagggtgcgttttatggcgtgtaaattatatcccagtagagctgcttaaaataagtactgacttttaatacagccatttgtcatttaaattaaagtgccacaatttattttaaaggtaagtcaagttaacaatggtttggaacaaaaacaagatctttttctaagatataaatcacagttttaatatgactctttattctgcaattattaagacacacagtaagctcacgatacaatctatttaaggtaatgagaacaaataaaagattatatattttctgcaaatgcaagtttcataaacactatggaataaaaattgagagttttaaaatctcctcatgggtaatcccaacacagtagcataaagactatgcagtgaacatttactgcttaatggaatttaaaaagttaacattttaaaagcgttttattttaattgcctgattactatctatagttagttaaatttctcttaccttgagcccatttaaaagtatgcaattttcttgttaagtgcattaacaagattttaatggagcgcaggtgcacagaattggaacaaacatttttcaaattagaaaataaatatcgttcatttgcaccaaataaatatttatcaatattatatatatataatatatgtgtatatatataaactccactgaatacatatatgtgtgtgtgtatatatatatatatatataaaatattgaataaaattcaaaaacatcatgctcagtgcataaaactagtcacgaaagaacacatgttcagcggctccacttctgtgaaaagtccagaacagcgaatctgtgtgacagaaagtagttagtggttgtctggggcttggggtgtgtgagtgatatatatatatataatggtgtgtggatgcttggtacctgcttggtacatgcctataccatgcgtcatatataattttatcctgttgatttatatgttctgattagaggcaatgtggtaaagcgtaaattaactgaactgggaataaaagttctgcattttaattcagatcacctctatgtgattacctgagtctcagtttctccaaaattcttcagagctctagaatcttaaatatgatttttcaattctatgaaacatttttcaaaataaaaatttgtttttcaaggtttttataggcttttaagcaaatgtattaatgtacaagtaacatacaatttaagtgcacaattctgtcaattttgataaatatatgtgcctccgtaaacacccaaatcaagataaagaacatccccataaaccttagaagtgctctcatgcccccttgaagtcaaccccacctcccccattccaactcccagcccaggcaacaaccaatctgttttcctgccatgatagattaggatgatcttttctagaatttcaaataaattgaatcacacattatgtactcttttgtatctactttctatttctcagcttaatgtttttgtgattcattcattgtattggagagatcagtaatatgtttgttttcattgtacaagcatatcaagttatatttgtttaccccaagagtacaatagtttcttctatttttaagaagtgtgtttgaatttaattatttagcatgattgcattgtacttttatttatagtatgtaaacgttatttccaaggaatccctgttggttactaaattgtctcttaagatacaagttgaatctacagacctaattctttgaagatatcattccatatctgaacatagaactcctgtattttgggtgccaaattctatttaataaaaggggtaagtgctgctacgaatatgtgggaatgttggagtgcatactgcagttcattaatcacatttccctttagagtctgtattcccctttctgctggaaatgttgctggttgaaggatcagagctgaacatttctctgggaattgctcttagagggagggaattgtgaacttctacagtacacaactatctgtacactgaactcagaaaggccagtttataatcattaggcagcacccaagatctggattagggaagatgggtggaaccaattgccagtcagttatttccaaatttgagataactgaggtatgataactgattttagaggggttttgccataattttaaatatcttcaaatcctgtataaagtctacaagtaactagaccaccataagatttattagaacttctaccttctcacattgagaaattcctctagtcaactttaaaaaggcaattgtctctatctttctctgctcttttaattttgattctctcagctatttctccacactctcacattgtttaggttattggacttacagtacttcttgccatttgcctgcatttcctttctctgtgttttatctttctcactgctttcatgatgctttctgttcttctcattcttctatagtccattctactctatgtgtcatttgcattcctaaatatcatgaactatgcaatattgtgcaataaaaatcacagggcttaagggggtaatgaagtttatggcacaacactaaaaactttatcagtgtcacattaaaataaaagtaaaaaagctaataaaaatggtagcacaattttacacctgttaaatagttggagatagcacaaatacagtgataagtatttttttttccccgagaaagagctgaagtttgcttgtagaagtgttagaagacttaaaggctttcatttcttgtgaagtggtagaaggaaaggtatctgaaatcagaaagttgtaacacaggtgtcgatgggcaaatttatgacatacaaggggcattgaggtcagttttagatatttgaggaatgggcatgtgtgcattttatgtgttcctatgtggcttgtttcagccaggtgtggttttctgtatttagccagtgcttctcaggaacaaaattgcatattaaaaaaatttgcattacattgaaattgttttataatatatctatcatgttgaaacaaattcatgtttttaaacaagtgctgaaaacatgagcggaaatgactgtactttctgtattttctctccatactttttgtttctacttatgttctttttctcttagttatttctcccaaattgctgcaccgtcctcactacaaaacttctccaaagtagctaggctgaggagcatacttttatttatcattattattattattatcattattactattggtcagagcctcactctttcacccaggctggagtgcgctaatgcaatcatggctcactacaacctggaccttctgggcttaagcaacccgcccacctctgcctctctagttgctgggactatgggtgcgtgccacaacacctggctaattttcctattttttagagttggagtctccccatgttgcccaggcaggtctcaaactcctggcctcaagtgatcctcccaccccagcttcccaaaatactgggattacaagagccagccaccacatacagcccatactttcttttcttttcttatttatttatttatttatttatttatttatttatttatttatttaaaggttgtaaggctctgttgcccatgctggattgctgtggcatgatcatggctcactacagcctcaaactcctaggctcaagccatccttttgcctcagcctcttgagcagctagcactacaggtgcatgccaccacaccctattttttttttttaatttttttctagaaatgaggccttgctatgtcacccaggctggtctcaaattcatcgcctcaagcagtctcctgcctcagcctcccaaagcactgggattaaaagagtgagccacaacaccaggccttttactttttaattgacaaataataaatgtacatattcgtgagttacaatgtaatgttttgctatatgtatacaatgtggaatgattcaatcaagttaatatatccatcactcactcacttatcatttttgtggtgagagcacttaaaatctactcttctagcaatgtattatttattattaactgtagctatcatgctgtgtaatagaccattattcttactgtataattgaattattttactctttgactaacatctcccattaactcatcacagctatcctttttttccagcctctggcaaccaccattcttctatcaacttctatgagtttgactttttagattctacagataagcgaggtgaagaagtatttgtctttctgtgcctggcttatttcacttagaataatgtcctccaggctcatccatgttgtcacaaatgacagaatttccttcttcttagaaactgaataggatttcattgtgtatgtatgccacactcgcttttatccattcatccgttgatagacacttagttaggttgattccgtttcttggctattgtaaataattttgcattgaacataggagtgcagatatctcttccacacagtgatttcaattcctttggttatatacccagaagtgagatttctggatcatatgataattttgattttttgaggaactctcatacctttttctgtagtggctatactaatttacatttttactagtagcatacaagggttccattttaccacattcttattcttttaccaacacttattggctttttgctaatagccattctaacaggtatgaagtgatatctcatcgtggttttaatttgcattttcctgatgcgttgttggtattgagcattttttcatgtatctgctggtcatctgtatgtcttcttttgagaaatgtttattcaggtctcttccctgtttcttatctggggatttattttctttctattgagttgtttgagttgtttatatatttcggactttagctgtagggcatacttctgaagacatatttttagaaaaccctggtttctaagcagtcctttcggaaagaagaaaaatcagctctcaaaatatttaacccctttcaacctccttcctgtgagttgtgtgcacacatgattttatgttaatagcaatatagaaataaaaacttttctatactatatgtttgttccagctaggtcagattcacagcaggaataatctttgataaaaaatatttggtaagttattcttctgggcatcattgaaaataaaacttaaaaatttacaagggatcttgaagaaaaattttaaaattgtacaccttataggtccttacccattaattaaaaataatgtatggtgttatatcatagcattgtaaattaataataaattatatatctaatttataaaatagtagctaacacttaaatgtttaggatacatcaatgttttatgctatgttttatatatagagagagcatagcatagcatatttcaaatacatctattaaactgtttgaaaattactgatctaccttcatattttaatgtcaattaacagtttccttagaaacttagtttttcggcaaaactagttcttttcagaatttcttatttctcactgtgaaagcagtgtcagtttaatttctttaagtttattttaaattttaaattaaagatgaaaattcttaagtgccatttctttttctatttctgcagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggtaagtgattcatgccactttcagtctttgatttctgaatgctgcttctgagatactgtttccataatttcccgtaatgaccatacactttttacttctcaaaagaccatactttggcatgcattatattagttatgaaacttgttcaatagcgcaaacatagtttacttcatgagcattttaaatgcccatgatatatggaaagaaatttgtgctatcaagggtcagatataacaaagacattctgaagctgttaataaaattttttaaatgtaagcttttaattttaaataactctagatatgtgtatgaatcatgaattgctatactcttagcatataggaatactacaaaaatgccttaaattgttccattgcttattttggttttgtgtcatgaaggggaatgtatctctgttaatatacatatacacgcatatgtataacatgacctttctttgtctatatattaaattcctgttagacataacatccctttttctacttaaaaaaatgagtactttagtcatttctcagtctcttggctaatatcaagtgaagagagtactttaagttactaaaaaaaaatactaggagatgtttaatttgtaacactgtcaaatcattttacctgctaaggtgaaagtttagaatcttttcactttttcaccttttcagtcacaactgaaaagaaaattatatttgtggaaattgcgttttctgactttttgccttttccatttttacatattcttttaaatgtatttttatcttttaaaagtatcttttgtatataactagctagttgttcatcaagttggccctattctatgtgtccaattcttttcttcccattctctcgtaagccaattgtatcttactttttccctgactgttccaccaaaactcttctcataaaagtcattactgacctccatgttactgaatccaaggttcaattctcagtcttctgaagcacttgatccattttccagaggacttcttcactgggctcatagcacattatcctcttctggttttcatccgtatttacttgcttacctcttcgaaggctcctttactgcttctatttctcctccccgaccttggagtgtcttcccttctctacctacctttatttccctggtgaatttctgcagtctcatggctccaaaagccaccatcatcttaggattcccaattaatatctccaacttgtccttctttcctgatttccagatgtttctctctcagtcactaagggatatctcaaaattagcacttcagactcttttcttgatattttctcagcaaaccagaccctcctgcagtcttccttatccattattattgttgctcaggccaacaatcttgaagctgtccttaagatctctcccctcacacacttgctttgattcagcagtaaatcctgttatttacaatttcaaagtattcataatgggacctcttctcagaatcttcatggcttttgctttttctacacaatcactttctctcactggattatttcaatggtcatctgtttcctggtcttcctgctcatgcgttcagctcacctcagtctgtgctcaacacagcagcttgagcagcctgcctataagtcagttcatgtcacttttctgcttaaaacttttcagtgactacctattctacttacactattatcaaaaccctcacagtggtctacaagccatgtacaatctctctactaccaccttcctgacctcttggagatcatctactgtctcatcctaacatgctctgctcaactggagtgacctcttaagcaagccagacctgttttgttacattttcttttctctctgccttttgttcaatgttgttttctcagtgaaatgtcccctgaccttgttatttacacatatacactctccctcttcttttgtttgcttatcccacaggactttctatcacctgacacaatgtatattttactgatatacttggttatcatatgcctcccaccccaactattcgtaaacatctataagagctagggtttttttcttgttttgttcactgctgtcttcagagaacctgcgcagctattgattgtataataggcactcaaaaaatctttgctgaaagaatagatatttataagtaaatatcagaaggtgtgaatgatatcagaatatgtactacgacaatgcctgaaagcaaaacaaaacaaaacaaaacaaaaaaaagagatagatgaaccatgaagtggtagactgctccactgcagcacagataatgatacaactttttatgaattaatataatagttcatggatgcatctcttctcttcactactccccacaattcaaactcagagaattcataaagtaaaggcagtttaacccctcttctgtatcactgttaaggaattactaggatttctggctatcaaatcaccgggctcacttcttggtctgttgttcattctctccatcttcattctcttggccctggagatttagatgatttcctttcatcttagtactcattgctctattaatgcttatctaatccagcatcacttacaggtaaggcccaacattcaatccccattttctaactgcctatttaaaaataactccttgatactaatagcctctgaatgtaggtaacaaaacacccagtcagatggaaaatgtcactcctatgatgccaggtgttcttttattaagaatccattctaatgggcaaaacgttctcctttcatgtggaattattttaaaatacaactactcttatcagccccatcgtttctatgtatatattttagaagagtttcctgagaaaggaatatctctcatcatccacctttgaagggaggttgcaaacacaaatgttttcagagccaggctggcaatggaaaagtgtaaagtgccaggtgcaagactgtaggaactgatggcgttgatgaaacctgtgaaatggcctacactcagcctgcgttactgcatgcatcacttttttttttttgtatacacacacacacacacacacacacacacacacacacacacagcactgtgaaagctaaataaacgaattctgaaatattcaggtctcaagacccaggcccatggtttatgaaagattttttaaggacgagtcacatgtgaaaactattacgggtgtattacatggaaagtctcaaattcctcacaactggcaaaaggggcaatgctaattattatctccatttttctcagatgagacccacaaggttcagtgaggtaaagtaacttgccaaagatctatgcagttccctcctcggcagcacggaagagaaataagatcagcatggcttcaaaacctgtgcttcttccactatgaactgcttccaaaatcaacacagcacaataaataattcagtgatagcaactatcataaaatgaagctacaacataactgtcctctaaataatcaatatttggatctttttttttcaataagcaggaagatgtgaaaatcacgtacttaaaaaacaaattacttagcacttaaagcttttattttcctgaataatatttttccgggttatggtcacatagagtcaactggattgcaagtttcttttccttttcttaattattcttttaaaatattatttatttattttagagaaagagtcttgctctgttgtccaggctgaagtgcagtagtgttttcagctcactgcaacctcgaactcctaggctcaagcaatcctctcacctcagcctttggagtagctaagactacagggcacatgtcacgatgtctggaaaatttttgtgttttttgtagagaaagggtcccactatgttgcttaggctggtctcaaattcctggttcaagggatcctcccacctcatcctcccagtgggctgcaattataggcataagccacggattgcaagtttcttagtagaaaaaaataagctcgtttttcttgatactcctatagcattgctagcatagtatgatttataaattgtacaggtaataaatgtatgttgtaataattgagtaaaaattaggaaataagaaaaaacaaccatataataaaaaacagaaatataatttgctttgcatgtgaggacattctaaggtatctaaaattaactattactttgaatagcaaaaactgcaattacttttgcaccaatctaatttataaatatgttccactgatggcttcagaatatacttttgtaatttttctttgtcaaaaaagaaattatccaaaatttaatttcattttacattttgtcttcaaacaaaactccttaaattgattttgatctaggaagaatacgtgagttggattaaagctagacacagcactcaaattagaaaaatagacaatctcatacaagtggattatctctccagtttttaatcaaaaggattattaattgtgtatggataatgatatatcaaatacatagctgtgccagtagctaaaattttcagtggagtattttaattacattttgttttgtgaataaaaccatcctgtatttccaacttcctattaacagttcttcagaatttcactatgtgattaaatgaattaaatacatctcagtgttgccttttctgttatctgaaacatgtagttatatttttcactttaatagatctaaattaccagagagttatatttattaaatatgaacaaaatccaatttatacatgaacttcaggtcaagagatcattgaatctttattttttctcattttttttgtaggtagcaagttttagggactagaaaaagcttcctctttcagaatttttcaaatgacagagggaaaagctatttctctgacttgtaaatccagtttatttttggcaacacagcctgcagttaaaaattgaatctcccacatgaatcactgaatcaaaaaatgcagtaccaaaattacaaaatgcaaaaattcctgcatgtaatctacgtcatagagtgagatcatctaattgtgtacataatagtaattaataataaataacagctattatttatcgagggtgttttctgcatgagacaccatacaaagcacttcctgattcttaacaacaatgctatgtgctacatattagaatctcaacccacacaatatatgaagaaggtgaagcacggaaaaggtgaccaatactgatcccttataacagagttaataagtgtcccaaactagcatttggagcaagtatgtactacttcagtgctcacgttcttgagaaatgtgtgtatatcttttattgactttattgctgttaaaatttagtaagaagtttatttacacaggttagctttagacttttctcttcagaccacaaaattttcccagagttctgtttgcaaatgaaactgacagaatacaatattaagcactctgaaaagatcctctaagataaaaactctaccatcattgagataaaaaatatgtaaagtagaaaaagtcaaaagtgaaaataaatagctttttaaatagtaggcattatttaggatatctaaaatctaggagtatgtatataatatttcttaaaaattagtctggctattttttgctgaattcatagattaaatttaattttttatgtttgcactttaatgtcaacataattaatcaagtagcttttgactgggtcttggtggtcagtaggattgagctagacaaagaagacagcacacattccaggtagacatgatgtcagagtgcattagttttgtaaacctgccataacaaattgccaccaactgggtggcttaaaacaaccataatttagtcactcactgttttggaggctttaagtctgaaatcaatgtttcagcagggccatattctctctgaaggctctagtgagatttcttcttccccccttctagcttctaatggttactgggagtcattggcattcttggctggtagcagtacaactccgtataacgcaattctctgactgacttcctccttcttcccggtatatctctgtgtccccaaatcccctccttgtaaaaacaccagtcattggatttagggcctatcctaatcctgtgtgacctcatcttaacttgattatgtcaacaaaatcttatttgcacataaggtcacattcacaggttcagagtggacacgaattttggggggatgttattagccccagtacactgaagtaaggaagtatcaggtcacaaaaccacttttattccaggctttgtagctcagattttaccctgaagatggaggggaagaaataaaagtattgaaaccaagaagcaatatgatcatttagaaatatctctcaggcagcagcgtggaggaaaagtaaggagaataaaagacaaaaaatacaagagagagagctaacttgtgggtgggcaggagactagggacaacatgatgagtttcatggtggatctattcctttttctttttttttttttcttgaaatggagtcttgccctgtggcccaggctggagtgcagtggtgcgatctcggctcactgcaacctccacctcccaggttcaagcgattctcaggcctcggcctctctgagtagctgggattacaggcatgagccatgatgcccagctaagttttttgtatttttagtagagacgggatttcaccatgttagccaggcaggctggtctcgaactcctgacctcaagagatctgcccaccttggcctcccaaaatgctgggattacaggtgtgagccatcgcctctggctgatctattactttttaattaattttaattttttatatatacaaaaattctcaaagtcaaataatggcacgtataaatatggtacatgtataaacacacacagcatctcacttcaagttttcatcccatttccctgaaattcttaatttcaacccttttatccactacttctggtattttctctctttatttaaacaaaatttatgtcttgctattatattagattaggacattacctattttatttcttattttactttttattcaacctatcttttcattagagttatcatctgaaaaaaaaaagaaagaaaattggaagaaaggctgtctgtttatctgattattatatgtgacaggactggctctggaccctgtaggagagtgacaaaggcactgattaagaataagtgatgaaatgattctggataataagatatggaaactatagccatttcctcaattccaggatccttatacaaagaagcttcccacattctcaggaaacaattccaggccaatgagcctcacttctgcacttgattttcacccaacatcttgtcaataaagtaggttatctaactaccaataaatttccatgtaagctgtgaggtaaaattatctccatattactatctataaattctattatttaaaaattactgtttaaaatattatcaatgccatgattttctccacttgaacttgattttttcctatatttatgtgttcatggacttctttaaaatcttatgtaattgaaacatatataactaggtaaatggctaagtttctaagtcagctggtaaacttataaataagatccaaatgtactatttttttttttggcctggccttttaaccacagagttcctctttcttaatgtaaaggtaagaatacggatggtatttgttatctatttgaagactgctttacaatttagaactgtagccaccattttaacaattttatgatttgcaactctactcattattgtacttaattttactgcataatgaactaatttatctgccacttgtcttacaagaatgccaattctacagtagagagtttcaaaagctactccattgcattcttagacagcagaaagcttttggttaaccgaagatacaaaaataattctgatagctaagttgggaacatgcacctgcaatctcacattcgttcaatgaaaagaaaggaatgagtatttacttcaagaatgcaatagtttttatgtttcttttttatttaactaacaagacaataattaaacaatctgagaatctgatttgctttttctaaattattttaattgtaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcaggttcagtatctctgtcttggttttcttctggtctgtgcgttctcatcattctcacaaaacggagtaaataaaatagggtacttcttgacagatgtttgagtaatcattctctaaaatttgaaattctctagcaaaacaaatacgattttcagtgtgaaatttactttccagaaagataaattatttatcttaatagtaatacaaataatgactctgatttacttttcatataggcatgagccagaatctgtgctaaacagttttcatgtattacctcacttaattctaaccaccacctatgaagtaggtggcgttattgtagtaaagacactacagttcagagacagtcagactttcccaagatcatacatctgctaaacaccagagccaataatggaatactaagtttattgggctctagagcagaaacaggcaaactatagccgtgggccaaagctggttggttgcctgctcttgttaataaagtcttattggaacacagccatgcccaatcatttaatcattgtctatgactgtttttgtgctacaacgcagttgagtatttgggattgaggccatatgatacaggaggcctaacatttttactatctgacctgttacagaaaatgtttgtcaaccttatctctagagcctggatcatcatgctacattacctctccaactccagtctaaataccatgattttcaatattttgctacggtggtatatctgatgtcttagtactgagctatattccctttgttaaaatgtatactcatgagtaatttctttcctttttgctgccagtggtaagagcttcttcattgttttaatgtgctgaaatgtatgaaggaaacagataagcaatatatgataacaagacaacaatcaacactttgcacatttaggtgtggtagtggctgatttaaatctagaatcatggctgaagtgcaaagcccctggcgactggtgtttgctatccaaactctgactctttaagtgtctctgctcccattcccatttcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggtactgcactagaacaactggtcaacctagatatatttgtagaaaggacttgtaatcaaaatggaatgtgtaaagattttctataggctttatgaaaattaagtttaatctctattatattgagctgttattaagtcaatttttttcttgtcatacatatttatgccagcaggaataattgttatacaaatgtgatgatccccctgcctatttaaacattaacaaaacaagtaaaatttcatgtcattgttatagttaattttccatggtaatatttgtataataatcctggagataaacaaaaaagataatgttatatgagacataacaatttaacaggcttcacatcaattgctattagaagtatagagaatatcataacttcttgattcctctccaactacagtataaaacttgttagaagtgggaagttagacttataaaagtctgaggtctaaaacaattaaaaatcagaaagcagttttatagttgtaatttcatctgaaaattaaaatcaataatacgctgaagagtgttcaaaattttctgtataatatggccagtagattctgcaactatctgaatattttagaattttacaagcattataatgttaaaaagaactattctgacctctgacaatcaaacggaaatggcatcatttcaaagtgtatgtatatgtcacaagttatataaaactacattttgtcactaaaagcatgtttgacatttaatatgaattcaaaaataatcacacaatttatatttttatacaatcattaatatttgctaagttttcaaggccactacaataagtgagtatgataggtatctggacttcaagtttaaaattacgggattaggatttacccaaaataattgatgcagcaatgaagtagacacacacatctgattttctaaaaaagcaaataattaaaaatgaacagtggactgatcttcctgttggttaaaataggacaattaaccaggtaatgaaagacaaacctttgactgcgtagagcaggattagagagcatttaaatagttgcttgtttacagagtgttggagtaactagttggataaaactgattaagatgggattataatttggatcgttctgtagtcacaaaccatgccagtaaaccactctggcaatttcaggaatatgtgatttctaagataaagattaatttatcatttaatttgaaaaaatatttaaacatgttcatattatttcattttttcttgcaaacacagatcttaaatgactataacctagactaagatatgcataattaggcctttcatctaaagaacataaaggactttcaaaaagagttatctttttcaattgcactgttttggggggttagatgagttactgaataagaaaaataacttttgtaaaattgtagcttaaaataattatcaatattatcttgactaaaacacaagaaaatctgcaatttcccccaagtaacacaatttacaattcagaaaatcactgccccacattaacctttgatagactgagaataaaaacaatttaaaatataatatttgacataaaaaacactatattaaatactcccaagaattattgatttagaatatataaaaataactggaattaggtgccttatattttttcctcttatcttgtctagtctgttaagttgatatatatatatcttgggcacaatattaccttgggcacaaaaaatagctcccctcagctttctcctccctttactgtccctgaacctctttgatttcatttttcagaaaattggaattcttccaaaaagtcttcaaatgctctgattcactctcctttttatcactttctcttctgactggtgctttgtcaacaacatattttaaatatatactttttatattatgaccatattttattcattatgaaagctccttaagtactgagattttatcctgaacacattccttttgcctgtcattttttttttttaaacatttgaggatcactctttcattccttttcccaagttttgtggtttcaacagccttgtactttttcttgtactctgttctcaagacctttagggtctatttttatatctgttttttttttttttttctgtttcaatttgtttctgatatttccttattatggatcatcatagtctttttctgttcattaaccttttgactactcactaaagtaaaaatatttcttcttagcttaaacatgggttcctcctcctatattttgaatgatattcttaataacccctcagacattttatttcaccaatatacgtttttctactttactgtcacctttttttcttcttttttctaggtctttctctttaaatttaatttcttctccctttctgaggttattcatgttctcaaaaccatttctgcctgtagttcatcctaaaactttagtatattttaaattttcctatatcatattaaggagtgaaactaagataaacagtttttcaccaaggagtataaaaaatagcagactgtttctgtgtgatctttgtatttacaacaattgctaaaactatagttttcacatagaatgcaaatcagtagtgttggttgaaaattggtcccagtatatattatttagatgggatgtctgaatgcattctttggttgataaactatttttctccttctaatgtgtttgtgtgtgtgtgtgtgtttgtgtgtgtgtgtgtgtttgtgtgtgtgtgtgtataggcaaagcttatttatgtcttttagaaagtcagaatgattgattaatggttatggatacaactaaaagttttgctttggcgagtttatacgcaattaaccaataaagattactttgggctcccagtcttatgatttataatatctactttttaattaaaatgcatattcctttagcaaggacataattcatcttgaatgaggtattttatttatttctagtaccaataaaatgtatcagcaataataggaatttaaacaggaccaaattctttttttttctctgaagggaattttcacaattttggtgttttgtgtgttttttctttttaagtttgatgtgtttttaataagtaaacagaaacaactagaagttttaaagacctctaaaaacttgtatttttgaagacacagttttggcagctgaaatattcatgtctcaagtgtcttgagtcagtcacctaattaatttaaacactactaactgcatgttaaaatgtaattttgaaggatcacagatatctttatgaatttagattatataatttcaacaacattttgatccacttactgtattcttaatagaactctaaaatttaaataatattatttaaaaaattatggcatttggggaccatggtaactctgtatagcttctaaattggaaatttgaggacgacttggaggaaaggaattggttatcatgtctttattatcttccacatttataaaataagaatatcagaaggaaagccttacaaaatgtaaatgttgaattgtagtttgcataagcacaccagaattgaaatgttaaatgtttgctttcatagattaaatttgaatttattgcataaaatagtatatatgcatctgaatcaaatgaataggttactatttcttttcagttactgcatgacatatttatatatagttctatattggcataaagtgagtttcactgttttagaatgagcttataaaatgtgacagaatatgctgtggagttaaatttgtagtcctgacatagagtcctttaaatgtaataattacttaacttgcaatgattaaaatgttgatataacttcatatgtaatccttgcataacatactaacaattttgctatcagcaatgtcacatgtgttgaacactctgcacctgtggtaacctgacggtcacctccaagacatgtatctaaccttggcactgggcaaacatgagcttacaaggaaactgtgctgcctattcactttaggcactattttgtttccacagcaacaaatcaatgcaggaacagtttgggattggcccctaatgtcatttaggagagtcacaaacaagatttcttgttctcacagcattgttgtcaattgataatttgaggactttcaatcattttcatttaaaatttctaattaaacctatctgagagtaagccattaaattctagaccaatatctgagagtggaccgttagaccaatatttgagaccaagtatctgagagtaggccattagattctagaccaatgaccatagtgtgcattcagagaccagaagtcatttcataagttttcctgttgctgaggaaactcaatcttgcttgaattggggactactcacaataacccccaggcttagtttttttatctttttttctacagagcaaggtttagaataaattttgttccaaattaattacacctgagtcattgtctagcattttcctcaacattgtgaaactactgtttccattatttttaagtaatatagacaaacaaaccctaatacaaacttttaacaatctatcagagacatattctggtgtttggtttcccataattccaattattatataactctttcagagttgctttattcattctgtagtagtctttcattgccagccatcactaacctttcatatcttaggttgatagctttttattttagtatattattgttttttatttaaaaccatcaactgcatcgtgttcaccaaatatcaatgtagttctttccacataaaattctgtctattaaagtattaaatttgctgtcacacttttcttttaagcattctgtgctatgttctgtttggtgtcagtgtctttagttctgatttttcaattttgtccctctccttttccttgactcgttagtctgatccaacctcttctacctcatctgatgattatcaatatgttatggaagctaaactacaagaaatgatctccatacgtaggaaggtagtcctactggactttactttctattgctaaatagaatccatctaagtttttcttttcatttataaaaattatgttacttttatttattgataatcaaccatctgtgcagttcagtgcttcaggagcttaagattggacaatggcaggtttgtgttcaaaccatgcacagtctgcatgttacatttggctgatttcattgctcataaataactccaatgttttgctgatgcttggatgtaacaggcctttgtagctgacacatttcaagcaatgctgttcagctgcctgtttgaagaaagtttattttttaaaaactatgtttgcagttggtagtagcttgctttacattttatttcaatttatttagaggaaaagtgttaaccaaatcttacatttcaggtgtattcttcatatttcttaacaggctgaagagagacatggaaatattgaagaacgtatgagacatttagagggtcaacttgaagagaagaatcaagaacttcaaagagtatgtatattaagaactattaccccccaatcattggtttatgaattcgtattctgtatataagaagaaagcctttaactgagtatgggttatatttaaaacttacaaatatgacctgttgacttgaataaaatgtttccaccactttaatcaaaacagatgtaaaattaaattcaatttaaaactagcaacactataaaaataatctcaaacagtttttgaatggatttttatgtcattttttaaaatgtaaggctaggcaaagagagaaaatgaatgaggagcataacaagagattatcggatacggttgatagacttctgactgaatccaatgaacgcctacaactacacttaaaggaaagaatggctgctctagaagaaaaggtaaaacgatagaagggtaaaatcacatgaatattttgcaatgctcatgtttgttttatatacagctgcaatcattgtaatggtcagatgatccatttacttagtttttaaaaatgcctggtatattcttagaaaggaatgcatattttttatttaaaaaagtgtaagatcaaatttgggatgaataaaaaatttgcatgatatataaatcttttatattcacatgttcatatgaggcaaatgtattaaaatatgctgtgcttttatgatgaaaatattttatatatcctttgcctggtatgcaaaatagaaaagtgatgagacacaagtcaatacttttttggggggaaggtgatttgaaatattcacgtgtcaagtgactgatacctacacaccagtctaaaagtcaaaatgtaagtgagtttatatcatcaaaagaactagtatcaatcccagtagagggtttaggaacccagtattttcagctgcattatttcagaaatagtgcttctgtacagtctgcaatgtgatttacagttatatatgtctcattgatagttggcagctaccagaccagcaagagttatgagagctggttaccaattccagagcataaattaaggtagggtataaaacccggatgatcacatcattttagaaatctagattgaatgccaatcactattttagctagacattttccattagtacataaaataaaccaaaatagggaaaatgttttgacaaaaagttagtttgattaatttacccattagaaagtaataagacatgacttcctctcatacaacttcaaatacatggcccctatgcaattactacactcttagtttaattttattctataactttgaaaaagaatacattattttaaataatgtcttatagtacttgtgtgttttgtagaaaaataaataatttttaacaacaaaaataattttctggcaaggtttattttaagtatctatgatgccaacttatttccactgactttgtgacatgtaatattaggtttctgaatagctagagtttgttatttctctaataatttaagtatcattataaattgttaattccacattgcagtagatgtccagaaagtgaaattttaaaaaatatgatttcatgatttcttctttcttcagacaatagaagtgagttcttctgaattttttataacacctctaagatttagcttgttgctcactttttcttacttgaagaataaccaatagtttctgatttaaaatgtggtctgagaaaaggcaaacagaagtagcttaaaatgcaatatttatttcatttgttcattcaagtgttacaaaatagcatttcccatttaaattatgtattttttaaatgtgaaggtctcacatttgaaaatttcatcaaagcatggtttccatggaaaccaagaaatacctgaactaaggaaggaatctaagaggattcttgagtgataagatattaatcaatatatttttaagtattttatgtttaatttattaattatttctgctattttcttttctttagaatgttttaattcaagaatcagaaactttcagaaagaatcttgaagaatctttacatgataaggtataatggaaacttatgttttgggcccattttctatttttattttctattccactgatgaatgttttgttgtaaaataaatttgaaaaaataattttagtatgctatctttgtaaaacaattttaactttttagaatatgtgcagaaaagcgtacatagagaggaagagcttcatgaatctttgtaacccaaattcaccaaaaattagcacttcagaaactccccccaaattagtctatactcatactcttccattaaaggataatcactatcttgacttataacattaaaaaatggttttgccttgctttatgccttatataaatagaattaaaatatatgcgctaatttatgtcagttttagatattctttcagcagaaatacattaaatactattataaatagaattatgctaagttatatatgtccaaacataatcctagttccaaaggagctaaaaaaatctaactgaggagagagaacacagcccttacaaaccaatgaggatgcagggtagcagatgccaaatgccaaattagtgaagtaggcagtaagagctacaggtaggaaagaccatgatatattgctgctgtgaagaagacttcaggaaggagggacttgactgaagatttaagggaaagtaggactctgaccccaggctttcaaacatagtgcatgtggcatgatcacaggtgcttggtggggtgagaggatgggtaatgagtgtgacattttaaataataggcacaactatttggctggaatcaattattccctgttgtagggtatgtggtagaagaggaaactaagggcagattgtgaaattttaatggtaattgctaatagtattttccttacttcattagcctttaaagttattgttagcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggagggatagtatgggatatagaaggtattggaaaagatgaagaatagaggaaagagaacaattatacatttaaccctactggatgctgcatattatgaagcaattaaaaataactaattctacagtcaaggtgtccacaatctcctgaaagataggtctttagaacaatgtaatgtggggcctagaatatagtatctgattctttctgaggtagttcacaaaaacaacacagagattacatttttagtagcctcttaaagacatatatgatcttcataaaggtagagcattctaagtagaggatgaatcctctgcaacggcacaaagaaaatcaagatgattgatttgatgaatcatcagaagtttactgtgactggtatgtatttaaagaagtagtttttgagcagattgtgaattttggacgtgatgctgttatgcatgttatgttatccaaagctctgtgtgctcctggcaatatccccagaacccactcccccaccacctaccaaagccttgtaactccaacaatctgcctaagcaaccaagagtactaatcatgccatgctttgcatccttgcttatgtcagtctccagagagagtaaatcccagatcatatctcatgtctgaactatcatcccatttagatgggcacattcactaatctgaccacatcttctataattcctcaaatttccactaaactaactgtactcacagtccattatcagcaaaaccctctgtaggctcaaactcttttctcagtgtttccctttccatctttatctctacaatttgaagtttctaggtagctttcctttcttctctctgattcacccctagtgacttcatctgatctcctggatttaaacaccatctataaattgagcacatccaaatttagattacctactgggtcctcttccctgagagagtttatatattctattgccaactcaatatctccatttggacacctaggtacctcaaatgtaacatgccagtctattctcaccccactcccacacatcaaacaccaccaccatctaacctaacacaccagcagtcttctcagtcaatcataattacaatttctttctttctttcagttactcaggctaaaaaacttggacttagtcttgacccctatgtttgtttcatatcccacatctagtccaatatcaaatcctcttatttctactctcacgatatagccaaaatatagccactcttaccctaacaccattcttgtccaaaccattactctcttgcctcaaaatttcctctcttttctgactcccaattcaacttgacaatctatttcacagccattagaatgatcatgccacttctctgctagaaaatccaggaaacatagcaagaccccatctttacaaaaataaaaattaaaaacaaattagccaggtgcagtggtgcacacctgtagtcctcctaactacttggaaggcagaggcaagaggattacttgagccctggagttcaagactgcaatgaactgtgatcacagaactgcactccagtttcagtggcaaagtgagaccctgtctttaaataaataaatacataaataaaataattttttaaaatccttcaattgttgcctatctcatgcagagtaaaagccagagtttgaagtggtttacaacctcttttaggactaccattcctgagttctgcaatcatacttttaaaaagtatcctctatttgtcaatttaacctctgcaatccagccacactggactccttaccctctactccatttccactaagaggcgtatgcacgtgttgttgcttttatctgccatgccttttcctaagagtctcattttttaatttctcctttatttaggtcattgtccaagtatcactttattgaaaaacccttccatgactcccctgttttctcctttctaacaacatgctatatttctatattactacttgtttattattcatcttttctactaaattctaaattgcatgagggcaagacatttgtcagctcactactgtatctcaggtgcctgacacacaagaggtactcagcgcacttttgtgaaaataatgaacaaagatatttacaaatcaataagaaactattgaacattttaaagcaacacattagtttattgtacatgtgttttgaaattatatgtctagcagagaaatgtgtaggaaagagactgaagctggtaaaaatcattcaggaaaaagataaaaagggcttagagtaggatggtagtgacgtagtgagaataaaaagaacagaaaagagaaacattgcaaaggccacattaacaaaaaaaaatgtggtgagaaaagtttgagtaaagtaaaatatcaagcactggccactgggaaggggaaaaacagtaatagaaaaatctagaatgatacatttagacctgtaaaacaatataacagttataatcattaaaaccaaattgaatgcttacatgagcagttaattaaagctctaagacaacccctatcttcataaatttatagaccagaaaatgccaatttgagaaaattataattaagtacaaataatggtgacaatatcaagctaattggttattaactttactttttaaggtgcactccagcctcagtgacagagtgaggccctgtctttaaataaataaataaattaattaattaattaatattttttaaaaaaatcctccaattgttgcctatctcatgcagagtaaaagccagagggtttactttcctttttctttcaatccaatcatctttttccttcacccatatgtcctttaaccctcatagaataatgaaagttcttcatttactgcataaataagacattttctttattttcaaaactgcatatgatttctactctgcatttttaagtgacatctacatagctagtcataattttaatattcccacgaattttcaaatattcaggattagtgaatgccagagattgtagataaatttttattaatttctgctatccacattttttattacaaggggaaaattttggcgtgctttattattatgtgtaataacctttaataaaaatatatcctcagtttttcctttttaaaaaaaatcattaagactcatttatcataattgcttgctgatattactggcatctgagtaacactgttttgattttttaggaaagattagcagaagaaattgaaaagctgagatctgaacttgaccaattgaaaatgagaactggctctttaattgaacccacaataccaaggtaacattaaactaaaagcttatctataattcactgaaaatcaacatgaattcccttatggtttcatatgtcctcaactaaaataaatcagtacttcctattgctcactagtcattatcatgttttgactcttcactgatttgcagtttttacattcaaaaataactttttaacttagagattatttctgtagataatcaataaaaaattaaaatgttaacttttgtattctgcatttcattatatatataaatatattaaaagattcttaattgaagaaattgaactgtgtacagggagattgcatctcattcaagaagaggcgtcagcccttctctttatatgtgttcaatacagaaattgaattcgacataaaattttctatatgtgttcagtgtagaaacatgcagaaatatgttcaatgcttatgtgactaaacaaatattattgattatggtcacttagcatctacctatttcggtaaagtaattgcaaaaaaaaaaaagaggaaaagagaaatgaatcagataaaagaaaagaaaacaaaaacttcaaataaatttagccatactcatctactttgattcactatctcatcttaagaaaaagaagcaatggatggcagcttacttgatagatcatagatagatagatagatagatagatagatagatagatagatacatagatacatagatagatacatagatagatctatatgttaataattcacacataatttccttttgtgtttgagatgttttatttaaagttgttagaaaccctagaaggacacactcatttagtcacttatttactaggcaacacagaataatagcagccgtttgaaactttccactaccataggcttttagtagaagttcatctttcttggtgttatgttcatctttagaaagttaactccaccagaggatgggtttgtatttgttttgataactaccataatctcaacacctaaaaaactatcttgcatatagtatgctctcaagatatattatagaatgaataaatgaatatctggtaaagcatttttcagattctcaaataaaaattcaaattgaaaaaatcctgaagtgtcttaaattcttttcaatataaatgtaaggaaaaacaatatttgatattttaagtacttccatactcaattgaatatgagaaaaagttcggcaggcataaaaacactcaaagaacttttacatatgtaagtcattaattgagaaaatcgttcttatttttcacatttttaagattctgatttttacatgtgaactgaaattattatttcaatgttatgtgttcacatggttatgatgattataatgaggatggtggagaaggagaaggagaagaactggtaaaatatcaggggagtcaatgcatagaataagcattatcaaatcaatagattaaatatatttgattaagaataaatggccatttccttgtttttttgaccttatgtctcaaaatacagagtttcaaagtgttgtctaaaagtctatcactgcactgagtcattatgggcagcctaacaatgtgacatttatctacaatgaaggatgatttggcctatatagaacaattattctttgatcaacagattgtagtggaaggaaccctagaccaagaataagacaatccacattcctaggactcacagataattacaagctgcttcattttggaaacctgttttccttaataacattctaaataaatacatatttgtacctaaatatgcataaatgatatttttctgattatatcacaggcttggtttgcagataaaataagacaagcagtagggattatatgtatagtaaatcatatcacaagtataaagtattatagaaataattaaggtaagctagctaaacagaacttattataataagttacaggataactgaatatttattaaacaacaattatttatagaacattcatgcttctgaggacaagtaatttcgtaaaaacaataatggaaataggaggtgcatgagaactcagtctactaagttttgatctaataggtggagaggtgaggagagataagctaaggtgagtgaatatcagtgaccactcttctctcttaatatctcatctaagaagaaagtaaaatgagttccagagtgactacaaagggcttgatttggctcaactctgaaaaaagatagactctgggtaattggaaaggacaacagagaacactccaggaagcagagcgatgggtaataggttttctctaaaaaaattcttacctggcttatttatgcaagttctttaatgagattacatgcaagagtcacaggagattcaggaggagaagctacagggttcattgcttaaaggaactgatgcctattttgtgacttacttagaccttccaaaagcctttcaaaatactgaacacctagaatgatttaaaaattgaactagtatgataatattgcctctgttttctcctgttagagaactagctcagagaactggaaaaaagaggagagagatgagtttgaggactggtacaataaaaaagaatactaggagctagaagggtagatggcaatagcacttttaaactgagaccttaaaactgttaaccacatgtgttgagactgttttcaggagaacacaaacaaacaaacaaaaacaaaagcatgttcaaagaaatgaaaagaaagtgtgagttactggaattgaaagaaggtcagtacagctgtatgaaaagctaggcagagagtaccttaaaatgaaactggaaagtggcaaaggcccaagttatagagggcctttaaggacattgaataattttaagcaggaaattgatatgattagatctgtgttttgcttttttttaaaataaattatctggagctgtgaaataaatcaacaagaaaacaatgctcctaggatgatgagttataatgttagaaacttcaccctgatgcctaaagggacattaaggtaagcagccacaggaaaaaggaacccagactgatcacaacaagacagtttaagcctgtcttataatcatttcttttatttatcatcttgccagatatttatgaagtgcttattatatgctaggaacgccttcctggacataggaaggtgactaaaatctgatctttgttcttcatgaaacttagagcctctgcccaagagataaagacagagttgtgtcctttatgaatatggcctagttgtttttttttttaaatgtaacttatccatgataaaacctgtttacttgattaagtctcaaatacattgctacaaaaacaatagctgtcacctatttgatggaaaatgttttagttcatttgttctaatgccccatttggcaaaacaagaactttcttaagttagtgtcttctgctgttgcaaacacccaaacctcacctcccctttttaatgttaccagatatttggaagtgcttgtctttgttcacaagaataactgaaaaagagagtatagtcaatcagcaggagcctcaaattcaatagaactaacagctttaagtatatttcctactgatgatagatctgttatttcattttataggacagcattatgtcactgttattatcatcattattgtaacaataaaatgaatttgctataaatctacatataagtaatatgcctggagaagccttttctgcactttgattatagggtactttattaccatgtttattgaaaactagtgtaatgatactttccaactaaaattttccgactctttcatctttaagcagatttaagaatcaaatgtgcttatgaaaagatttttcttcatccttttgaaacaatgtcttattaaaaacttaaaaaatccttttggtagtatatcctattttcttttataaaaataagaccataagccttgggtccatctaaatttaagcattttgttgattctctaaattgaaaaatagaatgtgaaaaatagacaatgtgaataaatttctccaaaaattttaagattggaaaagttctgggaccctcaaatttcagacatttttagctagatgtataagaaatatttaaaacaaatacagtaatcaatagcacatactgtgatatacacaaaagagctcaaactaaattgccagaatttaacctaatggattttgattatcagtcttattatgattcattttactactgcatttgaaaatgataataaacagaaaggttataagcactgtatattctaaaagaagaaagtgcacttgactttcaggaatggacctaagactgcagcttctgacataagtctctaaagaggcctcagagagtcatgacaatttatcggttatctttcttgaggtttatttccttgaggatttctgctttattgccagtaaaacagcagatagtaatttcctggtaagtttaatttttgagattggattattttatatttttccttttttccagaactcatctagacacctcagctgagttgcggtactcagtgggatccctagtggacagccagtctgattacagaacaactaaagtaataagaagaccaaggagaggccgcatgggtgtgcgaagagatgagccaaaggttaatcttttaacttcaactcttctctagttttatttaaatacatagtttcatttttgatagaattttaacactgagataattagaaaatgctagcatttttattaatttgaaacacagagtatgacatttttaaaaaaactataagtaacataaagcccctactatgggcccaaagttgaataagcatttcccatgtatttattcatataacattatgaagtgggtactacttgtatactaagttcagacataaaaacactgaggctcagaaaagctaaatgttcaacattgcacaggtagcaaagtaatggagtcaaaacttgggcctatgtttgtgtagtttccagtactattagtagtgtaatattaactattatgctacattgccaaacatgtagtcttttgattttcttgggcacttgagcaatggcattcatgttgttcattcaaattaacttaattaaaattggtattttaaaaacactttgaagaaaatgtacatagactattccttgtgttcataaagaactattaatgataaggggcagtgctagccttccattcagtcagtaacttaatttaaaatttgcaagctgtttgttgaataatgtagttgtattttacagagaagtaaaatagtcctttggtgcctaagcatagtttattctttcaaccacttttattcaccccaaatactatataatccatttgtccatatttgtacacaggcccttgatgacttttgggtttgaactggcaccagtatgccatgtattaattaatccatcatagtaggcattcaatatctgttgaatacatgaataaataaatgagcaaatgaagactaaattaagttaatctcaattcttttctcattattatgtgacaaattaattagtgctacttgataccaaaacaaattgtaacacaaatactaattctggttctcaattcttaactcaatgctcagggaagtatcatgtggtcttccatagaaatcattttatatgatcacaaaaataaaaaccaattttttaagaagcagaataaaagagatctaggatctgtcttttatgctcagcctcctcatacattcagataacagcttgaaaaacactggtcaattgcttacttcaaatggaagatttcttgtatccatttaaaaaacataaccatgtaaattagcatgccttgggcttaaaaattacaggtataccttgttttactgtgctttgctttattgtatttcacaagcattatgtttgtttgtttgtcagttttttacaaattgaaggttcctgataaccttgcctcaagcaagtctatggatgctagtttttcaatgcatgtgctcatttcctatatctgtctcatattttggcaattttcacaatatttctttttttttatttttttgagacagggtattattctgtcacccaggctggagtgcagtggcacgatcatggctcattgcagccttgaattcctgagctcaagcaatcctcccatctcagcctcccaagtagctgggaccacaagcgggcaccactatgcccagctaatttttgtattttttgtagtgatgggatttcaccatcttgcccaggttgatctcaaactcctgtgctcaagtgatctgcccacctcagcctcccaaagtgctgggattataagcgtgaaccactgcacctaccagttctcgaaatatttcaaacttttattattattattatatctgttatggtgatctgtgaacagtgatctttgatgtcactattgtaatcatttgggtacaccatgaaccatgccaatataagatagtgaagttaatctatatgttgtgtgtgcttctgctccaacagccatttcccactgctttccctttctttgggcctttgtattccccaagacacaacaatattgaaagtagatcaattaataaccctacaatagccttaagtgttcaagtgaaagtaagagttgcacatctctcactaagtcaaaagctagcaacaattaaagttagtgagaaagacatgtcaaaagctgagttaagccaaaagctaggcctctggcatcaaacagccaagttgtgactacaaaggaaaagttcctgaaggaaaataagaaacaacacgcaagtaagaaaacaaaacagccttactgctgctatggagaacgttttagtggtctacgtaaatttgatcatttagtgataaacaatcaaagcatggacaacattcccttaaaccaaagcataacccagagcaagaccataactctcctcatttatatgaagactgagagaggtgaggaagctgcagaagaaaactttgaagctagcagagggttgttcagttcataaagtttaaggaaggaagccatcttcacaacataaaagtgcaaggtgaagcaacaagggctgatggagaagctgttaaaagttattcagaagatctagctacgataattcatgaggatgactacactaaacgatgggttttcaatgtagatgaaaccaccttccattggaagaagatgccagctaggactttcatatatagagaagaaaagtaaatgactggcttcaaagactcagaggacaggggtgaatgaatgcagctagtgactgtaagctgaagccaatgctcattcactatgctgaaaatcctagggtcttcaagaattctgctaaatctactctacctgtgctctatgaatgcaacaacaaagcctagatgacagcacatttgtttacagcatggtttactgaatattttaaacacagatttgagacttactgctcagaaaaaaatactcctttcaaaatattactacttattaacaatgcacctggccacccaagagctctgacagagatgctcaaagagattgtttttttcgtgcctgctaacacaacattcattctgtagcccgtggataaagcagtaattttggctttcaagtattataacttaagaaatacatttcacagggctataactgccataggtagtgactcctctgatggattggggcaaagccaattgaaaacattctggaaacgattcatcattctaggcgccattaagaacatttatgactcatgggagaaggtcaaaacatcaaccttgatcaggttcaatggctcacacctgtaatcccagcactttgagaggctgaggcaggtgatcacctgaagtcaggagctcgagaccagcctggccaacatggtgaaatctcatctctactaaaagtacaaaaattagctgggtgtggttgtgcacctctgcattcctagctactctgaaggctgaggcatgagaatagcttgagctcgggtggcagaggttgcagtgagccgagatcaagccgctgccctccagcctgggcaacagagcaagactccctctcaaaaaaaaaaaatcaaccttaataagagttaagaagacattgattttaaccctcatggatgactttgaagggctcaatacttctgtggaggaaataactgcaaatgtggtgaaaataacaagagaactagaattagaagtagagcctgaaaacgaaaccaaattgctgcaatctcatgataaaacttgaacagatgaggatttactttttatgaatgaacagaaagtggtttcttgagatggaatctactcccagtgaagatggtaactactcttggtgaacattgttaaaatgacaacaaaggatataaaatattagattacacagttgataagacagtttcagggtgtgagaggattgattccgattttgaaagaagttctactctgggttaaatgctatcaaactgcattccatgctacagagaaatctttcatgaaagaaagagtcaatcaatgtggcaaatttcattgttgtcttatgtttaaaaattgtcacagccacccaaccttcagtaaccattacccttatcagtcagcagccatcagcatcaaggcaagaccttccaccagcaaaaagattaaaactcactgaaggctcagatgatcattagcattttttagctataaagtatttttaatgaaggtatgttcattttttagacacagtgcaattatacacttaatagacttcagtagagaatgggcataactttcatattcattgggaaaccaataaatttgtgtgactctaatgtcatattcactttatcagggtgggctggaactaaccctgaaatctctgtggagtatacctgtacatcattttgcaatattttaaataatattttgttagaatcgatgtaaataaatgttgggaagagaattcctgtgtaatttcttatgtgataatatttgtggtctgagcttataataagaaaatataggaagactaattagtttaagtcgtgagtgcttgagtacaaataaatagattgttatatttggaaataaggaaaagtattacaaatacatgctttaaagtaattgttaccttggaatatgattgaactataaaacatatagaagtttatcatctttatttctactaaaatcttgatatttatactgacaatccctcacattacttaagatgtcaaggaactattttatggaagcaaataaattaaaatgttaataattggttcagtttttgcaaggtcagttgtaaaagcatgcctgttgttgttgctgtctttgagattaatgctttgaaaatgagcaatatgataaatattctgcattttttcattcaccattcaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggtaacttcaattagtactgatgatttcaagaaattagaagaccttgatactgtactaaaaatgtaattactagatcagaagcattagcattaactgggagcttaatagatctgcagaatctcagacctcaccccgtacacactgaatcagaatgtgtattttcagaagattcccaggatattgtatatctcctttataatattaggacagcctttgtaaggaacatacatgaaacatataagattaatgacatcagtgacagtacagaagaataagttaaaggcaaaactttctccagtgaattttaaagcactttttaaattaaaatttactacttaaagggaaagtgtgtgtggtaatcacgtacattcttcagatacattacatactgcaataaaggtaccaaatagtatgcaaattaatgtgcattcagattccttaaaatatttcaacattggagtgaaattaatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaccttgatcttgaacttgtcagaagagcaaattaatttcactccaatttttaaatacttttaagggatctgagagcctttactaaagaaagatttatggaagacctcatgtaacctcaattacctcctccagatcctattttcaaatacagtcactttggcctttacagcttcggcctatgaattgaaggtgggagataaaattcagttcatagcaaagcaaatgcagaaagcaggatagagtcctcttctctgcctggaacacttgagaaaaaataaaagttaatgcctttaaatgggataaaccaaacatattactactattcttaataataaaaattacatttctgtattaacatattgcatgaaaattcagatttttttttatttaaatagggtctcacactgctacccaggctagtgtgccataactcagatctggctcactgcagcccacaacctcccagtctcaagcaattctcccacctcagccttccaagtagctgggactataggcatgtgccaccatgcctgtcttttttttttttttttttttaattttttgtagagacatagtctcccttgcccagggtggtcttgaactcctgggctctaatgatcctcctgccttggcctcccaaaatactgaaattacaagtgtgagctaccacacccagcctcagattgttaatcttagtgcttgtggctgtttaattgtgttcactggtgcctaaaacttgcgtttgaagttgggctgctaccatatcttaaactgagacacaattcttatagagttttttatgattaatattcttacatcagtgaaaatacatttttcacatattaatgctgaagtttataacaaatcaggctgatcattaaaaatcccctagcattttggggacatatgtgcgaacattttctaagtaaatggggaccaaattcatttgcattctttaaatataaaaggcttactatatctgtgagacataatttaatattatagcctaacaaatatctttattatattttcatttcaaaggcaataaaacatatggtgatatgaactatttcatactagttatgaaaaaaatgtactgttgctatatagtaccctaataatagatggttttcattacaattgaaattggacaaattaacatttcaaatattgagaaatgttggcactctgatacttttattttaatttaatatatggtttcttgaattccaatgacatcagctttttctgtcatttccttgactaaccccagtgatgaacccaattgtgtcaggtagatttgtgttcttctgaatatcaacaaaccattcttaacttgttttttcaatgggtgaacaggttttaagtcttttgaacaatgcctttcttttttctttctgggtctagctaaatcagttggcttccttctactattattcaaattacctatcatcaccctactgcactttagaatagttttttaccttatgacaataaccattactatctggtttctttgtagtatgctagttctccatataccaacctaactacagccagagaagacttttaaacacacaaatgtgtttatgtaatccccctttttctaaccattcaattgttcttaggataccaaccacactttttaatatggtctacaatacctcacctgtctcaccattctctaaccatttaccttgcctactttctagttccttgatgttccatgctctttcttttgttgtgtcatccctttcttctggaacattcctgtcattccacacccttctaccctaacatttcactcatgttacccttactcaccatggacagctcctccatcacttcttcaaggaacgtagtactgtccttcagttctttaccttcactagattgtaacttttatacaggagcaagaaatgtatctggctttgctcacctttatttgcaggtcttagcacttcgcttgatatttagagagtgcttcataaatatttgattactctaaatagaaaaataatgtaaaacaagtattaacggaataacggaataacactttctgaggctgttcagctaatggtcgaatttaccaaattaagtttgaaatcaagtctatattcttgtgatatttatttgcaccaaagagatcaacacaccctccataacaagctatttctcttcagtgactcttagctttgtaacattagggtagtaatttctagtaacaatcttggccagtaggttaatatagttgtttatttgtaagattttaaaaatacatgaaatgagattatatcacatttaaaagaaatagtcatcttgattcaaaccaggtgaactgctaataacaaccagaatttttctgtgattaagatttttcttctttcataaactaatctagccattaaaaaatgcatgttttctgtcttcacagctcgctgattcaaattacttcaaactcatttgccacagcaatgttcattcatctgtgcttttatagttagctactattgtctgttaaattaaacttcaatatactctcttacccaacttgttcctctaggtttggctgtcttgtacaatttatagaatacctaaagttaataaccaaaatttctgtgtacagcataaccatgttacatctcaccagaaaaaaatttctaggagtcatttttctactaagtattttaaaagtacaaaatgtcttcttttttttacatttttattttttgagggtgaagatagttttttctttcaaatgtgtgttaagctatgttactatgtactatgttacttgattaaacctttctttggagttctgaccttggggtgaagttaaaaaatgcattcatgaaaataaactttgagagtaacagaattcatgttctttttctaagtgaaagattataattaagtgtaaatgtgcctcataatgttttaaccaaaatgaacctttgtgaaacatatttgattagattttaagtccatactttgtaagatttttaaacagcctattaaaatcacaaagatcacttattccaatgacatgtaagtagactaccaaagtactttctgcctggccagcaaacacatactacttaaaaactgaaagatttgcagaatagttagtgaagacaccagcagtgagttaataatcaaagagctggtgaacatataaaaacaggtgagtaaatgtagctcaacttcccatagtaaacgtacaccagagaagtatttcctattgaataaatttagcgaataaatttagcaaataaattacattctccattctaaatatgtaaaaagaaaactttgaagtgatcataaacttgaaggtacaggttctatataagaggggatcccaataaaccatttgtaatcaagaacaaaatagctcaggagaattttacgacccccttatcaaactatactggtacacagtttcattataacaacatacaaaatgtgtatagatttaattcaggattcaaataggatttttacacaacctagctaaagctctttcctatttgtgcctttgtaataaataatttatataattttttttctcactctgccacccaggctggagtgcagtggcgctatctcggctcactgcaaactctgcctcccgggttcaagcgattctcctgcttcagcctcccgagtagctgggattacaggcatgcaccaccatgcctggctgatttttgtatttttagtagagacggggtttcaccatattggccaggctggtctcgaactcctgacctcatgatccacccatctcggcctcccaaagtgctgggattacaggcgtgagccaccactcctggcctagttttatttgcaagttactttttcattatttatgtattcatcatctatctatataactatattttcacattattaccttttctggtacttatttaaaggaggcttggctaagtattaatattaagaaaagactcagggttttatttggctaattatgaatgaccatttactgaggatactatcatttaaactttttcattaggtaggaggtaagattcaatgactttgaatcttaagagggatatttacatgtaattataatctttcactttttctaagctattgctagtcctttgccatctcaaggctgagtttctaaagtctcttttagtggttcctgaggtcaaatgtaagattaggattaatggtagaaattaattaggttcaagatttttaaatagttttagcaggtggtagtatacaaagaaggtaaaactggaagttgtcaggaaaaaatgtatcatttgaaaacaattttctaaactgcagccaggaagtccctggaatttactgcaagttacactatttagagaaaaaaaaaagatgaaaaaattagatttgatgtaaaatgttcaagaatagtttctactgatttattatgtgaattccaatgatccttacagcagcatataatggatccatattaaattatatatggatcataattaaactgtatctttcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactggtatggtgatgtgtccagagaacctttgcctcctgttaagattaatgatgctttagctaaaacttaactgggtgtttgttctagtctaagtactttctgtgtattttattgtttatttattttcttattcacaacatccctatgtgatcagtacatttatgaatcccattatgagatgaagaaatggtaacccacacaggtgctgtaactttctaagggtcaaatagtaagtcaatggtagagcagagatctaaatagcacattataaatgtcaatgaatttctgggcatagtggctcacagctataatcctagcgcttttggaggctgaggcaggaggattacctagaggcaaggatttcaagactagcctaagaaacatagcaagaccgcatctcaaaaaaaaagaaaagaaaaagagaaaaagaaaaaaattagctgggtgtggtggtggtctgtacctgtagtcactgctacttaggatactgaggcagcaggattccttgagcctaggaatttgagactgcagtgagctatcatggcaacactgcactccagcctgggcaacagagtgagattccttcttgaaaaaaataaaataaaataatttttttttaaaaattgaatgacttaaaccattaagtacatttttattgatggcatacggaggaaatcactttggactctgtgtgtgtgtgtttttaacataataagtaacaaaacttagtattataattgcttcaatacaccaagatagagttttataacttttcaatatataacataaatttcttgcattatttgtgttaagagccataaaaaacaacagctactaattcctaattttgttttagattttatattcacattttcacatgtatacattaattccttatttcatttatctttatatttgggattagaagatggaagcctaaattaggaagtctcctgaatgcaactgagaaaaagtcaaatttccccattctaaaaaattttattataaaaatatattaatatgtaatatatgtatttcattataaaatatatttcattatatatatttatatataataaaacctctggaaaatatgattgtgatgactgctgaataccatgatgttagtcatttaattctcgtggcaaaactggaggtagtagggcattatctcaacagagagtggaggttttgagagtataaatggagtgcccatattcaacacagctaataaatggagctggatttttccacaaatttgcctaatttaaaagcatgtactaccatgtctttctgtttcagtcattacctagaaatatagtatgttgaaatgacaccaatgatgaagattaaaacattctgaactgtttatggaggtaaaattatgtttttgtagtgaatatgcattggcatacttacaattttgaggcttccaagccataaaacttatgtaaaagaaaaattgtgaattttttttaaaaagaagacagttacctctttaagctgctgagtccactattttctgctcatttccaaaacttcctactaaaaatgttttttaaatagaatagacaatggccaaccagaaaaaatgcccagctaatcagaactgattccacttggatacagtacaaacttttagccaatgtgctgagatatactaaccaaacatacggaactacattgtgatctgcttattttagaaatttaggaaccattcatctgattttgttagttaaaagtgttattgtctcttgcttagtttctgcctatataagatatgctacatagtattaatgagcaacttagtaccaaacctatagtaagaatcctggaccacagaataaaatttagtcagcattcaaggcaggaatactttgattatttttgtattgcttttatttctgacatttttacaacacagttttacacttttaagtctttttataaacataagcatcataactcttgatagtgctattactttcatagcaataaaatatttataatcctttagatgtgattgtgtgtgtgtgtgagagacagagagagagagaaagatgccagtgctttcatgaattctcttgaacaattagtaataaataaatcagtggaatatgaatattattacattataattagagtactgaaaaaaaaggcatttttagaagagtaaagaaatatttaaagtgtttaatatctaagtcagagaagcaagaaatgaaatccaggaagtccttaacacctaatataattctgtcatcaattgtatatttttaataaaatatgggtaattttttttaacctgaagaaaatgcttttggcatttgtgggaaagagaaagattttaggatgccaaaaattttgagatcccacaggaacagcacatctgcccaaaggaggcccaaagctctgcatagatggggcaaaaacaagaatttataaactccttgtatatgcattggatcttcactcccaataatattttcttgaaaagatgcagtctcgtttatttctagctagctcactcttctagctagactcactcactcattccacagtttctctttcccagggtccatgcctcgtatccagtgcctgtacagtacacatggccccattatggaaacaatcatctgacttatgttacctgagaagttccctctctaaatttaactaccaggcggagtgcttttatagtaattaaaatatgtttatttagaaaataacaaaatgaagaaaaaaatgatagtcaagttgtagacactatttaaaattgtaacttggtcaaatgattgttaattcttaattaattgtgttttatgtttttattactgccaatcacagccaagtgatctgaggaaacatcggagaaaggtacagtaaataacttttacatcattacgaattgaatactgttttattctatgaaagctttaaaataatattccctctagtcgaatgttgataaaacattaaaaagttgagagtatttaaagtgtattgaattgtttaaatttgattataatagaaaatacttcaaagataaaattgtttatgatttctggagcaataattagattataagaaccataatatcctgttttccattgaatatttaaaccaaggatggtgtaattttatattttaatataagtatttatatttattaatataatatagtacaaatgttttaatatttaatatataataaataatgctcgttgttttcaaatattttattattattattttgatagggtgaggacaacagattgggagaaagctgtcaaaaaaagatagcttgttactcacagttcccaagaggagagagtactctgtgcctcaggacagcaccagcgtcagtcaggaggcagaaggagcagggcagaaggttttctgaggtatcttagggaaaggcaagacaaggcaggataagcaggttaggatggctagcctgattaattttgtctggcctcaggatgtagggactctctctagttgtctcagcctggcccacaggtgattagggcagaggaatattgcctcttggagagtaagagccagatggagaagatgatttagagtatgggctgtgagttgtttggtttgcatgtgaaaggtgtacttataggtgagtgatgtgctatttccaggaattaactatccctagggttagaggagcatcctctccagatgccagagcatcaagactatgcaaaataaaaaaatatgttcgaaacaccgcttttctgtttggaatgaaatcaagagaataaatatggaatatggaaaacaaaatgaactgaagttctgattcacaaaatgacatcttattagataattgagtagagctttcactcatgggacatcagatgaaaaagatttcaaagattcaaacttctattcagtgcaaaaatctattcctcagcatcttcgagatgtggtagtcagcttacacccaaacactggaacactcctggaaccagataacttttatgtcctttttttaaaaaaaataaaggaatctatattattcttacatggcttgaatagatggaattaccattttattttcctgggctattatctatctacctatagcctcttctccttaacactaccagttcattcttatttaccaaatttaccaagtataatgtccttattttctttgacctccatcaccttaaaaagactatataagtttaatggctgtaagaaatagaaaggtaggatggaaggttctatacgaaaatgtagtctcaaataattcaggaagtaacaacataatttgtgagaaaagtcatggaaagagggaccacaaccaaaaaaatcttgtgtatcggggaacgagttaaataaatgatggtatttacacttcaaaagactacattaagaaaagtgttgtatcacttccattttattgatgaggaaatgtaatattagagcaggtaagtaatcagcctatttattcaacatttaagaaaaatcagaattcaaatccctctctaattccaaaactctaagtgatattcagaggaaagttttgtacatgatttattattattattattattattattattattatactttaagttttagggtacatgtgcacaatgtgccggttagttacatatgtatacatgtgccatgctgtttttagaagctgttattgggaataagtatagtttggctggcagggaggacaaagagggtattttataagatgtttcagaagcaaaattctgacagcaaaaatggccatgcttagcagaaacaatcagagaagagtcatggtgggatcacagaactgtgaaaacactaacatgtattaggaatagttcagaaacacgcttaagagtttagctgggttgtgggtttaaaaaggttttccacagcatcagaatcaatccgaaagcagttattgaaaaaagattctcctgatggcaatatgctagttgaatagagcaaaggaattatataaaaatgcctacctacctaagctgttaaaaggaacctaagattgggtgacaaaagtcctgacaatttcatgaagttcctcaaagttacaaggtctttattatagataaacacatttataaataacagctttacataaaaacaaacaaaatatttccctagaactttaaaaatttttgtttagccatactaagaacttttttcatcagaactctaaagccataagtctttagctgtgttttctacaatcctgatctctccatattgtgatacacaacgatgccatgaaaaatatgcagcattgttgtaaaaactatgtctctacaattaacttgacattggaaaaaattttaagttacagctctatatcttcatctctgacaaaatggatagtatcctgagtcattctggattctgtactaaagtgttctttaaggaaatccctcccatctcatcttcttttggttttctgtatgtctttgccagttttcccatcatggtagtaaaatggaacaatttgaaaacattactatcttaccttttattattctctttaaaaagagatttttttcttacaaaccacaactcatattttaaataccctgtaatacatttcattaggctgactgatttaaaacactttatctgataaagttatattttatcaacttctcatttcaaaaatccctacttaaaagatgtctttattatgatagcctgagtatgtataatgctatatgttagtgaattgttcaaatgtgtgtttaatacctttttgtaaagagtttatattctgatgttataaaatatcatagatcaatgtcaataaacactatagatcaatagtcagcaactagttgatttatggcagcagtgtctaatcttttggcttccctgggctacattagaagaagaattgtcttgggccacacataaactactctaacactaatgatagctaatgaactttaaaataaaggtccgtgcataaatcgttttaagacagtttacgaattcgtgttgggctgcattcaaagccgtcttgggctatatgtttccagcaggctgtgggttggaaaagcttgatctatggtgtttttattaatcaaacatttttgtgtagtgggtctatgatttttttttaattttaatgtgtccaatttaaatatttgtgaaaatcaaactctttaatgggaatttatgtatgtaagacttaaatgccccaagttttgttgttttattttgtattaaaattactcgacagccttgttctcatgattctccatttgtgtcaatttcaactgaaatttagaaagggtttatttgaatgtattgtttttgcttctagattgcagttgtggaagaagatggtcgagaggacaaagcaacaattaaatgtgaaacttctcctcctcctacccctagagccctcagaatgactcacactctcccttcttcctaccacaatgatgctcgaaggtaagactctgcaggcacactgcacactgaatgccctccttccaaaaatattcctcttccttcgttgttgtcgaatagactgcttaacaatttacattatttgagccagaattctccagcttccctttcccagtatcacttgtgaaataaccaaatttcaattttgatatcaaatttgtatttttaaagttaactgtatctttgtggtcttattattggtcaatatagataagaataactcttctattttttagtggatattttctattacaatgagatcaggctagaggaaggacttactagaaatattaacaaaaaactaaggagactgtaggacaagatcataaatttggattgcagtataagcgtaattaaagtctgaaaagtatatgattgtgccttttagcagacaggtatgtgcatcctgtgggtactgctgctgccagcagtaataactcctcagtcagaaagttattagaaaataaaaaaatccttggctaaaatattaaataaaaagataagtctagatggagaaatatgtcatttgtcatcacaattctttatactgtcttatccatatgcataaagcactgcaaacagatctctataatcactgatgatatgaatatacctaagcatgtagtttatatctgaaatatatcttctcttattgtctcatcaattgcagcatctgtagacacataattaatataaccaaatataatgacttaaggatgaatgcttcaataaaaatatctatcttctagatattatgttttacaataaatgcttttaaaagtagggctttctgtgttggcagtcatttcttttttccaactattttttgttgttaatgtggaaaaatcagttacttcagcttcaaaatattacttctttcactctccaaaaaagagtatatttcaacatataaaaagctattgcttgaaggttagggaatgtgagttcaaattaattcacatgagtaagtaaaagtaagtaatttatcatggtgttataaaattaacaactatagaaactaataacaatgtctattgatcccatcctattaatacggtgtcaaatatattgaccataaattgaaacttaaccaactgcttgaaaagcatttcagtttaacatgtatttaaaataatatttgagtactctaattaggaaaacacatacattgatcacgaggatacatggtttgttgcttccaaattgcacccagatgattttaaattaactgaatttggctccaaaactgagaaagggaacgatggctagaggaaaatcaagtaaaactgtagattagaagagcagcttcaatttcacaatagttatatttcagttccttgctgtaggtcattatgtttaagattagaaaaacagactctgagaaataaatagacaatggatcaagtgctccataatagaaggccatttatcatgcagttaataactcagcctatattcactgattagtttgagattataccaaaaaagtaaagaaaaaaagacattcggagcaaaaatgaatttatcttatggaaatttggagtttcagggcccaaaggctgaaaaaaaaaactgcatttaatatcttaaaaggaaacatgggaaaataggggaaaaaacaacattacaagtctgcttgttcctcctttggtgcattttataaaggaaatgacttttgtgtaccttgtggatgttgcatgtattttcctcttttgtgttttgcagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgtaagtatgcatgtgttaagactttccactgccactcattttagtcatgtcacagtatccatctatctttcatttcatttcattgctcttcttttcatttcttctcttttctacctgacaaaatttatattttgattagctttaaatgttcaatttagctgaataatgcttaatacaacttagtgaaagggtattgtgaacttttcagtcattttatttctctctttataacaatagctagaatttatttaatgctaactcttgtgacaggcacagttgcctacaaagtaaatgctagtggtataaaccttattttattaatgagtaaataatgtcttcataaatcgcataactgtgatattcatcgtggtgccaatgtttcaaaatcagcttaaaaccattgagtatactgccacttaaagcatgaatgtgtataaaagcttagctatgtagatttaaaggtttttttgttgaaagaattgataagcctacaaaaaattaaaaagaatttttaaaaagttagaataaagctttataatatgttacataaaatgtaaagaacatgatttttttttttgcttaaaactatcatagcttccccctaataaactctatggtgtatagttgaggaatggatgtggggaaaagaatagggcaatagatattgtgttataattagttattgtcagtgactaatagaataaaaatgtagatcagtacatttgaaatggtactacttaaatatgtatttagaaataagcagatatatacatacatgatacatacttacataattgtcagaagaatctgtgatatttctgaaatgattatatatatccttcacttatggggggttgtctttctatatattaatttttagagttatattattgggaaagaattaaactcctacctacagtggtaagtgctgaatggaatgatccaaatttcttagtacatcctttggtttctcaaatagagtaataattatttgcaaggaatacccaactccaggacttagttttctgccctaccatcaaaagaatttctgattgcgatattcatgtttgcagatttatgactacagtatccaaaaatgcctttcctggcttccatagtgtgaaacccacagaaagcatcggaagctacaggaaactgatgtgtggccagtgtgtgattatatgttctccagcaaaggaattaaatctttttgtattcctctttctcagtagaggaactctttaggctatacataatattattgcatgaggaaaaaagagagacacagattattttgtgtttaaaatatacatgccagacattattttaaaatttgttttatcttatttgacaactagtggttgaccaaatgatctgtcatatccaatatattacagtgtcagtcactatagtgtgagtggttatttttgagtattaattttgctaacatcatagtcatatttatttatatttcaacatatatattcatcttagttgccataattgacactttacttttaaaatatatttaattgcccttatcacttaaaattttatatttttatttcatatttaactttgatgagaaattcctaaatcattagaaattttgccaacaatattctgtcaaaatcaaggtatgcaagatataagttaaagtctagaaaagtatagaacctttgagaaacttagcctttattactcattttcactgactgtgtgttttaggtcagagcagataagaattaactcaattactattatattctcatcaaccccaccaaagtcagaaactagcaaaagttaattcaggtcacagtttatacctgggaaagtttctgagctctgagtaatattgctttatttcatagaacagcagaggtagagtgtaaacaaagccagaatcagcagcttgttaaggactgcaatatggatgaggaagacaggagcaaaatgctatacctatgaaactaggtagaagctacataaatggtgaatcaaagcttccaggaaaaagaacaaagtctttactgaaaatgagacttgaagaaataaaaataaaacataggtctaaacaggttccagaaaaccatatttgcaccaaaggaaatgatacatgggccccactgatactttagttaagggctaccagttttaggtctgctttggtcctagaaggggtatccaagttgtcatggaaagaccatgcacatttttccaacccagggactacaacctagtactgcttattcatgcatctgaggaacctagggaaaaatctcgagtgattatgattttaatgtcttgatctggaaaattctaaaacccaggagcattgccagtgttctttcttctaccagtaaaaatagaactagaaaatagaatagtatgccagggaaagaactacgggaaagagatagtgatgtcaaagtaccaaatttgaaattctgaaccatgtgctaagatttataactcttaaaaggtttaactcaaaagagcagagacacatgacttaagttgaaagcagctatactacatgtctataaagaaatatggtgtggaaagggaaagctgtataaatgaaactatgaaaatgtttccttggttctatcagaaatgatgaacagcaaaggagatgtttgtagtaattcacaaagggaaatatttggaaaggatatcttgtttgctttatataatacttcgaaatgctagggtaataacataaacttcagataggaaggatcagtcgatgtgattgtatggataactcctacccatgaagaatcaaactcaatatgtgcaacaatatgtctgttcttactaatgtattactagcatagacaatatcagtatggaaaccccaaaactcaaaggaagcactgtattgaaaagcaattgaataaacctaacagaaaccaaccaaaattattttattttaaaattttcttatgacatccttttcaaatggttagttcactcaaattacaaaagtaggatagaaaaagctgtggtactaataggagatttcaagtttttatatatcttttgaaaaaattattctgttcttactagggtttacagttctcatttagattattattacctataatgtaggagcaagatttcccaactgaaatgtgtatcagtgtatgggcagaaaataaataggagtgatgtagactcaaatgaatcagtgagggtttgttcttccatgtaaagaattcaaattccatttgtaagtactattcaggaaaaataaagcataatttaagccaagtttacctgaaggccacaattgaatttagggaaacccacctaacagaggaagcattccttctagcttactcggggatctggttttagagtcatttctatttctttgtatttttgttcattgtctttttgttgttgttgttgttgttgttgttgttgttgtttttagacagaatttcactctgtcacccaggctggagtgcagtggcacaatctcggctcactgcaacctccgcctcccagttcaaatgattctcctgcctcaacctccctagtagctgggattacaggcacccaccaccatgcctggctaatttttgtatttacagtagagatggggtttcaccatgttggccaggctggtctcttaactcctgacctcaggtgatctgcccgccttggcatcccaaagtgctgggattacaagcatgagccactgtgcctggccatttattgtctttcaatgtcacaaatcccaggatgaaaaattaaataaacaggtttggtttgtatccccatgacaacaggaccgatatgtacttctgctgacttcctggaacatagattcaggatgtaatagcatcctgttaagacttgacagcacaatgaccatgatctctccccacccctcaatttatgcatccatatgcaatgcatctctgatattttcattattgctcaaatatgctcatgtctaattcacacttttaaaagctatcacttgatcttgccattatctccaaatattgacttatctttaccctgcatttaatgtacaagactgagttgttcactacttttttctttcctcatctgtcaatcactttacgacctaccacagcatcaattccaaacacactgctactgaaacgctagaaataggtgcagtcttaactaacatggaaaggtagttaggacaccaaaggctgtgtactgtcaaagcaattccagaggatggtaacacacaattatatttatgatgatgtggattaaggaagaagcaatgtatctgaaatgggagttttctgcctaaaacagacatgaaatgatttgttacaaaaattggaaagtgagaatatgacaaataatagatagaagcaagtggcatcgacatgtaaaagcagtggcaggaatgccatccatcaaaacagacagacaattggaaaaatcaccaagaccaaagtgagaattatagaatctatattgttacttttgtttagtaatgtataaatttagagaaaatgaatgaaatgaagatttatctgatgtgaatagaatatgcaaataagtggaaccattcaaaaactcatttttgtttctatctgtttacttgaagagaaagagttcaaccagaatataggcattaccaagagggcatttatgacccagagttgaggagatttatttttttttttttttggtggagggagagaagacatagataatccaaaataatttatttattcctactttcagtgaatagacatatattgaaccactcttaaatgcagagtaccaattatggactttaggaaaatgactaagacatggctatcggcatcgaggagttttcactttagcaaagatagtacgtaaacaaatacaaactttatacttaaaactaaaacttcactatatttttggcccagaaaagttttatctgctacattgtctgtcctgtcagaactaggaacagtggctatgaaccctaagatctgtgatcatgcataaataattgcagtcctgactagcttgacttttaattttatctgaaggcattaatctattttgaaacaaagtaaattaacctatgttaaaaatagccatgtcagactaatgtcctttgtttgtttggcaactttacttagtaacagataatgaaaggtggtgagcaagccatcactcatgacatccctggggacaagatgtcaaaatggggcctgagtgctggaacagttaggtgggatttataactggttaaataatccttgcccactgatgagtggagtaacgtcacctgggatcaaagtttctcgtggcatgattaggactcactctgttcttgatcagcacatccaaaatcacttggatatgaatgtttccacagctcaggtatctgattgatggattactaataaggggaggaatcctaagtgaaaagattagtattacccctaaatgctatcccccccaccaaaaatagaaagaatggatgtaagtgggatctaaattctcctactctaaaagtatagttcttggaagcaagtttttaaagaaaaaaaataaaaaattcatgtgactctaaagtcaatattgattaataagtttaggccacattaacagacataagagttgatatgaaagttttttctactctactctgctatgataaaagaacagccaagcaatggaatccatcctggttactgtacttttaaaggcacatcatcaacctggaggaaggttggaggagaaaattaggcacctgtagaggattggaatcacgttcggagaacataagtgaatggtgtgtttattccctttgctgaactaccaagtagctgatcacaacatttgaagagttgttctgtataagagctattgtccttttcattgtaagtaaggatacgaaactagaaccaaagtattaaagttgtacaaaattattcttcatctcgatgtaagaaagaacagtggggtgtcagaattctatacaaaatgggctggcttatgaggtagtgagttatttgtcacttggaaattgccgagcaaaagctaggcaaatactaggaagagctgttgtggaggggatccaagcattggaaagctgattggactggatgatctttaagatctacttcaaccctaggaatactgaatctatgaatctctaacatttaagtcttttctctggcaactcttctttatacaactaaaacaccataaaatatttactatgaaaataaatttctgcttttaagattacagacttctagagctgtatgcctaaagattctagaagatatgtgaggatcatgtagttgtccacattctatacatatcgaaactgagatgatttcagaagacagagcagctacttagtaagagagttgatagtgaatcctggctcctacttcctggtctgatgatccggaaaggaaactcttgggattatttcaatcaaaaaatacttcattgagttcctatccctgtggaacaagtgtgggcacataaagaaattaaaaatacgattattcaagaagtatataacatcttgaggatatcccatataaatgaataaataataactcaaggcaacaataaaaaatcacacagaaacattataatttttctaatacaagatacagacataatgtttggagagagttctgggttaatctttctctccctgtatatgtttgattctactaggatcatctaagtgcaatcttcctacgtatttgaaaaggtgtaaaggtagagtttcaaacgggacctatctttgagaaaagggtattgaaactatgttaaacagcaagctccagagagaatgtcatggaaatggcgttttctgtggttaaataggaagtgggtactggctgggtcagaagtgtgatgccagcttatgaagcaaaggaagtgattagcaccaaagatcaagttacccagccacagacagattggaactgcagagattgggaggcagcatcttgaagcagagccaaccacagaaataagatgatctgagttccagggtcaagcatccaagcagaagtgagagttaaggattagagcaaacgagctctgttttccagaggcagtttgtcagcttagaaaaatgatgatagtgtatggagaagagacagaaatatttaaacatttactatttctagggaaattaactgctccataccatcttaacatactgatttgtttgccacctgagaaacaccaactcttttgagtcttcacagagctctactaataattacaatgaagaaacaagaacacatctgaccaacttagctgatgtcaatagtgaatggttaggataaagaagaggctactgacaggcatagcaaaagatgaaacaaatctaagacaaagagatattcaagacaagggagtgatcaaatagagccaaaacaacaaagctatgaaaaaaataatgaaaacagaaaagcacgttaactatgaataagcagaattcccaattgcatgtataaaaatgcatatattattaggttagggccactttagcaagtttcctttaaatgcgtatgaaaagcaatatacacatttaaagagctttttttgcctctaaatggcaattcttttatggttatctgccagtttgtattataattgtctgaactcattgacctactataataggcttaataaaaaaataatttcacagtgacaaaaacacagcttcagcagtacaccagcatcatttcacaagtacagtcgtgcattgtttaatgataaggatacattctaaaaattgcatcccttaggggattttgttgcacaaacctaaataatataacctactacctacccaggctgtatggaatagccacctacacacctagactataggtatagcctgttgctataaaaaatccacaatatgtgactgtactgaacactgtaggcaatcgtaacacaatggttaagtatttgtgtacctaaacataaaaggtatagtgaaaatatgctattatagttttatgggaacactgtcataaatgcagcccatcattaacagaaaggtctttatgtggcgcatgactgtatttttctacctctaaaatttgggtgtctgtgtcggcctttacgccaaaacttagattgttccttggtgctaaggaaccaatagttacaatgtaaattccacaaagtgtccattagaaatgactcatgctctgcatagtgaaagggtctttctttaaataaagtagtatttagctccaattatgactgtatttgttacataccctttatgagccaggcactgtgtatagatacagtctccggatagctaacagactaacagatgttgaacaattaagtaacaatttataaattcaaatgtgttttaatacaaaccatgtgctatttattaatgatgaagacagttctactgaaagaaagatgaagccaccaatcatcagcagattgtagtagttagagatctctttttcacacaatgacagagacctctgctggacaaatggaaggacagaggccttgcaatatgggtttgtcaagcaatttctacagacttgtatctcaagggccaatatgaaataagtgattttgaatgaaatttaaggactgggaaatggggagatatttgtctttgttgacctaaataccaaatagagatgctctctaaaagaaaagatgtttatttaggaatagagcattgtgataagaatatgtatgtcatagtaaactataaactatgtgtatactcagggaaggaaaggaagacaaagatttttaaaggcaaaaaattaagaacattacataattttttgaaataattatctttggctactcaaattaataacaagcgtgccaccagtcagaggttggacaggcaattgccagacagatatacctataaaaatattttttggcatgggattgcaatggccttcgtgcaaggttgtggctttcgtagggtcttttgttgttgttgttgttgctatcgtgcgtaggagcatgagaatcctctgttcatggccttccctggctctacttgccaggattttcttaacaatagtgactccattttgattctaacaacttccacaccttcacaatccaaatgaatagatacctccaactagttccatccacagatctaggcatgtgagtttccttcctgtgccctgagccctgagccttcgcaagccctacattttgtagcaacttccttgaaaaattttaagactccctctgatgtctgggaaagttcagggctggcagtgccatctgggcaaggcacccccagctgagacccggacccggggtctaatcactggaagcatcgaaatgttctcagttaccgttcagacactgggaccagaagggaagtagtgccatctggacatgttgcccgatccagccaaacagcaggagcctgggtccctgtttctccccttcagggttttctttgacactctacgccacgcatgcactcgaccagatgccccagggagcctagtgagtcgcatctatggagtcatcctgagacagtggtctgaccctgttttcaagagggtggtctggcaattggatccctcgctcccactggcaagaatggtattgtatgagattgaatcagtagatcgttgtcccactgattttttggtggttcaaaactgtttacacaggaagaggggctggcaaaaaaaaatccttgactgtgcctgtcacaccttaggagtggtcttgccctcaataattccaagtcctcgaaggcctcacaaaagtaaagatgcctgagtgatagccaagaaaactttgagggcaagaaggctgccttgctcatgcccaaccactaggcggaccctgacaaggtgataaacaatttattatgtaagtagtctgctgaatcatgggactcaaaccttcaagcccaagcacttcaggccatgaaaggggtggagttcattgtgttctttccacatagtttcctaatagacctcctgaagaatgagtaacccctagtttccacaggccagtgtttctcctctgaggcactcatcattttgagaatgacaagctaggccaggcatggtggctcacatctgtaatcccagtgctttgggaggccaaagtcaaaggatcccttgaggccagcagttgaagacctgcctaagcaacatagcaagacctcatctctacaaaaaatagaaaaactagccgggcatagtggcacacatctatagtcccagctacttgggaggaggatgggttgagttcaggagtttgaggctgcagtgagctctgatggcaccactgcactccagtctgagagagactgagaccctgtttaaaaaaaaaaaaaaaaagaaagaaagaaaaaaagaaaaaagaaacaagctgcaggttctctatttaatgaaggatgtttagaatccttgtcccctgtccaatatgttccaatcattataatacccaaaaaaatgcaccctccctcaacatacacaaacatttacattccctctgtggatgtactgtatccaggtagaaactctggtatatagtgctggccaacattgatacaatataagccacaaatgtgaaccacatatgtaattttaaattttctggtagctacattaagaaaagttaaaagagataggtgggattaattttaatcctatattttatttaacctgatatagaaacaataatctcattttaacacatgatcacttaaaatttatgaattacatgtatttttctaccacgttttcaaaacctggtgtgtattttacacctacaatacatcatctgaattaggcacatttcaagagcttaatagtcacatgtagggagtgaataaaatattggtatagataaatagatatttctgaagttcacatagccatatgagcccactgatgcctagacaagaatgagacagactctcactggatttagataatcatccatagagtaaaataattagtaagctggtttggctaaggtcacccttaccagctagtttatcaagtatgtggaaagataaacattagatgagtgaagcagctaggtcaattctgtgaaaaaatgtcctccctcagaagtgttttaattgggctgaaaatatgcacttgctgggacttttctcctggttaagcgcactggcctgaatgtgttgcttaaaaatagctttacttacaatggccttacgtcccatttgtacttggcatttttgagtaggatgtagttccagttatctatcaaatgctttgaaaaaagatactagattttgcaatactccgagtatttctaagttcttcatgctttttattttatagttatgagaaaataaaatgtctagatttaactcacaaaatattcctagatttttctttgcttttatttcaagttttattatttaaaaatgtgatttttttctattaaaattttgggtatatgaataaatttaaatcataatttaaatgttcttatattgctcagaagaataaaagcctgattcatctagccacctggtggttgaaaatctttccttgtttattgaatatgtctgcctcatcaatctctatgtccctatatggaccattcaagaattttataacttttaagtgactcattcattttcatttacatttcaagaaaacatttttattattatttgaagactatgaataataatttattgatatacagtaaggcaaagatacagatgagagaaataaaatgaaaatatgcactcactgtacataatggaaaatttcccatttgaaaatgtttctttcccaagagtactttagtcaccagtagaaggctttcctaatccataccaagaagaaaaatctttcataataaaaaaagatttaagtacccgtattcattaaacatgtgaataataactaaaacaaattttggccctcaaactccacatctctgaattagatctatacagcaataaatgtgtttttaattaaaggagacttttaaaaaattatatagttcagtaaaaaggttatcaggaatgagattaatttatttatatcaatgttcccaagttaatattatccagtattataaattatttggtaaaataaagtattaaaaacagtaacatcaaaatttgcttttggcaccttggtaagatattttactttgctaaagagaaaccatatcttggtcgagtcctgcaaatgttaagtaaggaagtgtccactacaatgagagaagagcaaaagttgtcttcaatagttatttactgatatagtgatgaaatttcttgcatagtctttgtgagagtttatattagcttaaatctttctacctaatcttgaccttaactggagtttaattttcttttattaaaaaaagtatataccttaactcatttaaaaatagtgagcattttcatttagctcgacttcagaacataggagtaagtccttatttttcaattacaacagataatttatgaattaattttgtaagtttagaaatcctgtgatatgtgtttaatgtacatcatacttttctttcttcttccttttattacaaagttatataaggtatacatattatatattgacactaaatgagaacttatgacctacttggtgataactatttttatcaagctcttttgaagaaatttagaattttttcaaaaaatattatgaagtttaaaaaacaacacaagaacctgcccagaacacatcgagttctggaagtaagatttatagtgaaggacataggagtcagccagtagagcagaacaaatttccaggagcagtctatgaagagctcttagaagtcagcaaatgtttctccattctctcaacttgtaatagaaaacatatacttgagttcctacccaattggctatcatttatcccattatatgtgaaatattgcaaatacttaacgtgttgaaaaaataaacaaatctcacacgctgcatagatatttgctcttattttccataagaaaagtataaaaacagactttaagacttggggacagtatatttaagtgtcttgtcagtgaacaggccacatttattatgttgccactgggtgcaacaaattatatccccataggtactgctttgttttgttttcattttctcagtgtatgtttatgtatgtacccatgccattttatgcatcttgggttagtaatataaggaaaatttttaaatgtgatactaaacagttgctcaactaaacctttaacaacctgacttcagaattgacacaacctatgcaacataatctgaatacttagttacttctcttcacaggaggctttatggagactgaagctgcagctcaggagtccctggggttaggcaaactcggaactcaagctgagaaggatcgaagactaaagaaaaagtaggtttggggatttttccctctttttctaacttttatcaattccttattattatttatagggaattaaaaagagagtggttggaaacaaaagaactatattgaagccaatattttccagatactacctaaaacactcagggcttatgtttcctggttataatgagctactgtttaaaagagtataaaaatatttggcctgtagttgaaataagcagtttcttcaacgtaaccatccatagatttgtttcaaaatccttacaagtaatgcaatgctattgatgttcaaaattaaaacctgattggtttgataaaatgagattataccatctagctttgttttctctcatggcaattataagtatctactctttgaaatggagtaaaggagaaacatttctctgactgattgaatataaacttattttagactcagagcagattgttttgcatctgtcaggaaattgatagtgtatcttttcattcatatataatataggacatttaaatgacttgcaaaattggccaattttgagttgcagcagctgttggaaagcaagtagttcccaaaataacattttaaaaatacatagtaacattttcattgacaaaatggcacctttaggacatgttctttaaatgtaaatcaatttctctttattccagaatctattggttgattatttcttttccttcttctcaaatattccttacattgtgtttttggttttcacattttccttctttcctatgaaagaatattcactgctctcatcatcatttggtaacagataggctcttaggattataatatacaggctaatcaattgacttcatattttgctttctcacttgctttgtaaatgtttactaataatagggaagtatatacttacaagttgcagaacaactcactaacctaattgtttattagtttgctagttactaaaaattatgtacatatatcccaattcagtaggaatattgtccagaaaaaaatgactttgagaacataattatttctaccatacaatcaaatgctcagccataatcaataatatatatttattctttagttactgatcactcaaaaatatatttaaatattatcataatctttttcaaatgtcttcgttttgtttagtcctaccaattaatgatatactctatttcgtgactatttattgagaaaaacattcttctaaaaaatactttcctttgttaagatttttaaatgttggcagttgatttccagactaaaaatatataaatgatcaaaacccagcctgactaatggactcagtttatttcccttgaaagttaattctcatttctcccagacaaatacttgacaaagaatggcaatctgaacagctttcacaattgcatataagtctgatattgaggcagtgcattgcatacttcattagttgttgatggagccaactgaaatatctttttaaatagctactaaagttaaacatttcaattatacagtgatttaaaataacatatttaaagtttagctatcattaaccttatacactattgggttgatttgataataattttatagactcgtttctcaactactaagtaccctcacagtcagaaaaaaatactaattcttcccttaaatatgttaccatgcttgactttgggttttattttgcaacatgtattggcaaaatgtaactgtaagatgtgttatgtagaatacttgcttttaatattaagaagaatattaagaacattctataaggcaaaaatggctaacatttcttagtacgattatttcccatggattaatggtatttaggttcaaatggatttaacaaggcaagtcagagttaattaatgaaagcacaaaagtatttcccttattattgattatcccatagcaatagccctgtgagcataaacatgcaatcagtgttcaaaggacttatatgaataattgttaacacctattcggaatttgcatgccactgtggcttgatttctggattaccagagagtaagttgtcttcatataatgagttttattagagatagacaatttacttttaaattacatggtttcaaattttatttctattgaattttacattgttaattattaatattattaaatgttgacagcctattcttggatttttccaagtgtttaaaatttcatttaaacaattccaattttctttctttttaaagaaaccgtatcctctttcagtgcactttaatgagttacactcttttctgggttccgatttcatgtttgctagtcttctatcaggatgaaaaataattttaagtaaattttatttaaaaataaataaaaacaataaatgaagcaacatttttcataatgttgagcactacagatcgtacgtacacagttgcaacctgtgctatcctatcagttgtttctaaattctatccattggactggcaaaatggtgtttccaagacttagtacttaacagagctatgctcactatcccataattcatagcagagattcattagtctttgtgaggatagccagaactagacaatatcttattttcaaatttgctaggatagcagctatttagaattgacagtctgtaactttaaatttaattgggagaaatctctagaggagttaattatggtacattttttaaaaagccatatgggggagttactttcagagagcagcatttaagacattccaaatttttgcaaagttcagaaatttgtaacttggcagtcctaaacaaaggtttaatttgaggcacacttaccatccagtaaatttaacacacataggttacaacaacttacaagatttgttttcctactttaatcctactttttctttgttttctgatccaggcattagttttgcttatatttctctctattgtcttattatgagaaataggaaatcaacaatattgaatctgctaaaccacccactagtcatgaaaatcttgtcttgtccatctttaccttcctgataattattaaacagttgctgttgttgtttcatcagagtaacacgtaacctcggcctaaagtcaatctattgttgctctgcctagtttgcctttactatgcctcatctttgctgtacttttctttaaagcatcaattccataaatttctccagcaggtttatgtagagtatagttaacctataataattgtgtcaaactaaaactcagcttgtaattctttgaatgcttcacagtaattttattggttttcccttttaaaatttgagcagtttctctgtaggctcctgacatttaaggggtgagtcacttattctcaatatttagtttaagtattaatattataattcttcatagtttattcaatgcggacttcatctggggatgccatgactctctgagatcttatccatcactctctgttggatttctttgaactccaggcacctcttcttatttaacaaaaatatcttctcttttactattacgtttagaacaaccagacctgaaaatttcactctttttcttttatacctttcgccctcatatttaagaacgtatttcccattcttagctttccagcctatgttttaacctaaaagcttcgaagttcaggatagccgattaaagccaaccacacaggccagtaatggtgactcatgcctgtaatccgagcacttggggaggctgaggtgggagaactgctcaagcctaggcatttgagacccagcctgggcagcagagtgagaccctgtttttacaaaaaataaaaatacattagacagacatgatggcatgtgcatgtagcctagctactcctaaggctgagacaggaggattgcttgagcctatgaattcggggttacagtgagctacaattacactgtatggaatgatagatggtcccttcagatttaaaacctacatgggcctgccccccaaaattcctgtgtttctgaataaggttcaactcaccaaattgtacttagagactatatttgagtattttagggcacaataaatagaaactctcttctttgcctaagttcagaatttatttgttgactaacaaaatagtcaattagaaatcaaactgtcagccatatttccagtaaagctggtagagcatggcttaggtaaatagtggggaaaaaaaaagcataactggaagctccaaatagttaaatctacctgacacagaaagatttggttagtcacagactttcaagttgcacaggtataagccccccataatattaaaaataacatttatggtattataatttgataaatttgttactttagaatcaagaactatgagcttacaagggaattaataaaatttaatgtcatcaacattcttgcttaagcaagttttgaatcatcagtgttaattatatttttattatatatctcattaaatttcttacttttctcccctggaatatatttagttgtcagtttcacatgtcagcatctctagaaatgtgatgatagggcaagtggcaaattccttaagtcattagagacctgaaaatatgtgtcacacctaacatcagttgataattgcctgaaacatataactattggttaaaaataatttgtcctcagacctttgaagttatggctcttcttgcttctagttatggctaatgatcaattgattgccattcttttgtatataacatgtaggatttctttttcctctctctctctctctctgttttatttatttatttttgctttatctttggtgttcagaaatgccgtaagtaggtgtctattcaaatgttttgtttcatttttctaccttattctttcaaactgaagacttgttatgctggactatctgacaactgttactctagaggactcacatttctacactcaattttcattccaagaaccttagtcttatagaaacttctgggattaaagatgaggatgtctgtttcaacagtaattcacctctctaattctcaagaccatcctgaataggcagtgaacatattaaaattgatagaatatccattgaattgttatttatctccagcaatataaatgatgaaatatttagcttaattctttatctgctaatgttttctcttgcctcgtaacattatataatttttttagtaaagcatatatccatgctgaaatcttctctattttgtaacttaagttgaaagatatcatacgaatgttaatatactaatttatcattttcaatctttagttacaataaagataatatattattatatgttagacttttctatgtattctgaatggttaacactgctaaaggaaaatagatttcatatgtgaacaaatttttcaatatcattaaaatgaaattaacaccccgactcagctatcagcagcatcctctctcgagaagcagtttatccttggagcaaagcagtcacacttaattactaccaataaatctttatgttagaatatcacagacataaaagttaagctctatagatttacttaatttattcccatcacaatcctgagggtctccttcagtgtgtaatctttaatgtgttttgagactgcacttttaatctttggcatttggcaggttcagagtgtacatatctgtaagcaaaataaatgatatggaaaatatttatatgtgaaggtatcacagaaactccacaatattctttcatttaatacatattcgttaagtgcctatatgccaaattaaacttttaaatgaactgtattccagaacttaatttataagatgtgttagaagctctgagtacattttcccatctgagtattctatatacacagaaagtaaaagtctgtgcttcccccacaaaaatttgttttgtaggcatgcagtaggaactgtctctgggtagataaagcaaaaagaaggattcacttgcatgatattagattatctcacagattacagaaacaacagagccaggatatctcacagattacagaaacaatagagccaagatattcccaaaactttgacaataagagatcatgagagattttcccagtcttgtcacaaacacatatattctccttcatcccattccaaaaatgaagtccttagatgaaatccttttatggcctagtttggaacagatatttgtgcttggatcagtttgtttattttagtcgagggtttatttagtacagacacaattactgcaggaaaattcctcggcaactaattcaatgaatataataatatacaacattttagaacctaaaaccaatgctttcaaaatttctctggaaaaatatgtcccagtttcctacttggaactccagaagcctgtcttctctgttttcactaaaatagagctgctgttgctttgccatgtgatcatgtatagccctacctaccttcaaccaaggacaattataagaattccctgaacgtaaataataataatatcccaaggataagggtcagaatgcactgaaatttgttagtaaaaagaaagctaaggaaaaccaaagtgttctcttttagatatatttagatatatttgatctatttagaggaaggaaaacagcacaaaaggaatagagttgctgttttgagccagcagttcaatgttaatatattaacaaagtgagtagaacagaagccctgtgctggctccataatttctgccaggagaaacatttttgatctggaaagagtaaaataaaaattagtatatgaaaaattaaaatcaagatagttacatataatagaagataatgtcattttctaaataaattcttatttatcttaattgatgtaaatcctggattaatattaatagaacatgaaaatgataatttttcattcttttgctcagtatgtcccaagaaatgttttaaattactgatatttgaattaggtagttctgttcttcaaagagcttgtagagagatggacatgaaaactaattattgcatttaagtatttcagggttcatgttcactttttaaatctttgtggagaatgagaaaagtgccgaaaactcaaaggcaccctaatgttcttatttacaagacattctcccagctaaagacaaataaccaaaggggcttcacaaatgaattgatgatgactaagtgaaacagaaggtggcataacccagcactttcacacatgatttaaataagaacatcagatttgtcaaagtgtgaagctagaaggcatagctcagtttttagataaagaatatacttaaggatgatttttacagaggcatccaaatctgacaagatgaaattttatagaggaatttttataatactgcagccagctttaggactatacttactgatttcttctatataggggaacatatataatttacctgtagctcctaagaaaaaactttctacaaggtaggcaaatgagcaatgcctgacaaataatttaatgtttttcaatatccgtaatagcagtaacagggtcaaaattcgatgcatttaccagattgtagctgggtattgtgttcatttctgggaaagttacttaaagtggattaaaaccagcatatgttcagaggaacatgaccatactagtgagatgacacaaagccatgtcctcaaagactggtagaaataggaatatgtggtatatacagaacaaagatatagatgctgccaacagaatgaacaaccaaacgtgttctttatggccttgtgataagaccttaggccagaagtcaggggttagtacagataaattgagctgactgtaggagaattattagcaatcacagaggtaggaagaaagaattgaccactttgaaagggaattgttcaccataattatgtctaatattgacctgacaggcatatgtacatagtaggattattgcatcgaggattcaacttttggctgagagtttgaactacctgctttttaaattgtccctgccctgagattctgtgatcctctgtaaaattcagaagagaactgaacagaggagaatctttgaatttttaacatatagatgctggcatattgtaagtatttaaaatacatttctcaaataattgaatgtataaacagaagctggataaggaaagaactctaggataaagaagaaaacctgagaaaatgtaataggagttagggcagtgatttctacccaggtgaccaaacctgaaacctgggtttcttctttgcttctgctcttccttgtcctaattcttcctctacacacgtccatgtactattaccaaatgtagtcaattgcattttttaaaaaaaaatctctcaaatctgttgattttcttctttccagctcaagccatcatactacaatagtctttctgcttctagtcttgccttcctataatccgttagtcacgcttaagctaaacagacctatctaaatcttattttttagctgcctaaaacccctcaatcactccctaacaaccctaggattaatttcaaatggctttatgtagtccataaatccctacattatctgctccctgtgtatctcaccagctttatctctctgcttcccatcttgcacttcatggtcttgatatacctaatatctatttgttttgttcctgattactcttacctccttgtgtgcatatattctgcttcatttttttcctcatcctttgcatgctaatgacattatctattttatatgtaatatgtacataataatcacattgattagttgtaatgtgctaggcaatgcactgttctatgcattttacatgtgttatctctaatatttttcacaaagcctttaatgtaaaaactgctattttcttttatgcatcaagaaatatagctttccaggcactgtgttatacaaaaatgtagatctccagagcccagttttccttggaattatttagtatctaagaatagggctgtgatttaaagaatatgtagtccaatctcaactgcacttagaatatcctatataacttttaatgttaatggtctatatagggagtgaatgaagaattccccagtctctttatactctggaaagggtagcatatttttttcctctagagaataattagtttcttatctgcccctaccctatccttaaaaatgagcaacaaatgtattcaaaccagtcatgcttttaaagagtggggatggggaggatttcaaaacacgagatgtagctgttttataaaattgactttttctgatataattagccacacataatgttccaatgtttgatataagatataataatgtgaatgttccctaataaataaaccatgtaaggaatttaaatgtgtgcttgaatcaatctaaattattcattccagtaaaacttacaagagagtgtctaatagcaagaataattatggctttttaaataaaaaaatcaaattaaagtatatttaaatataatgctgacatcttaatctagaattttccacatctgttcctgttaatataaaatctcatataagctttgtatagtattttttataagatctttggagatttagtttcttcccatagttatttcaaatgagccattcatgaagtaaatgtatctgtctccacacttctaagaagggcagtaattacgtatagtctctctcttgccggggttttacagacaaaaaattcaatacaaaaagacttcatacatatatatgtgtgtgtgtgtgtattaagtatattttcgtagacacacacacaaacataaaattaaatatctttggttcagattctccataattgaaattttaatttgaggcttaactgtattaggtttgctaggcagatgattaacaaaattcttagagcaataaagatttcttaaactcctttaagtagtctcaaatattttagttatttgaagtcaatattaacttaaagaaaagttatatttaatgtgatgaggaaccacatttaaacttctgaaccatttctttcatttgtaagaatcactagaaacatgcttaaatatttatctttaaaggccccatcatctgtctttaagtaggaattttaagcagttcttgatgtcaccctcgtatgctctgatatccacatagatcacccattcaaaaactaaccttttgattttacaactttattgcttccattgttgttcattaccccaagtcagacactcttcatggtcctattctgaatcttgtcatcaccacaaatcatgcttctttcaaacttaccaattcaagcatctcatttcttgctaatcacagtcttcccacctttgatcttgctttatgaactttttcttctatcatctttatttaacctctatccttttccagtgcattatcacctttctgttttcccctctctcctggtttagcttagatcacgtccataatttcaacaccctcaaaatttgttaaatttcttcactccactttcatttggtcacatctacatataacaaccacacccaatgatgaattttctttctccatgtgtacattttggcacatctgtgctgttggagaaaattacagcagagaaattagaaatagtttcattgtgaaattcagcattacctagtaatcccaagagttttctttcattagtgttgttctactctctgcaactcttgttagaaacctccactctcctcaaacttgaatcttctgctgatgagtttacattctagcttagagagacagagagacagagagagaaaccatccaagtgccctgaattgcttgatgccaaatatacactaacacttgccccatctgtcttattgtagaaaactaggctattcttttactcagatcatccctttccattttcttagtcattttgtgcggaattctcccttgctttcaacttctgctcctgtctttttttttcccccatcagcatttaaacattctcaactttcacctattaaaaaaaatatttatttattttacttttccatttcagttaccagccattaactactcaatttgatgttaataactaatttaaaaatatgtctgaatcaccaacttgaactttacaaagcaagagtcaattatattccaaatataaaactcatttaatgaattgtttcttatttgaagttttcaatccagaattgactagtttataacagaagaaggttcattcaattgtaggagatctggaagatcaaggtgaggaaactgaaaagttgaaggctctcattttgaaatataagacatatgtttgctggtcatttcttcttctcctgactgaatatatgctgatgttggcaaggaaaacataatgtcaataattggatctgatctcattcattagatggtaacataacctatttttttatgttaattaaaacttacttgccaattactcacaatggtctttcactgaagaatatttattcttgacagaatctttcttactattaacatagccttgacacttctgacatggagagaaaaataatgaggctatatgctactataaataaatatgtgtagaaaagaatgtatcaatatttacaataagaaaaattaatcagaaaaaacttctctgcaaatatatattacctcctatatgaagtttataatatattagcacaaaatatgggtcatttataactatagatttttgtcttttgcagaacacatttgtttgaaagtcatgaggtgaaattcttaacattctaaagtgatatagctgcttgaaatagttcttaactttatttactatggaagagaagaaagctcataaaaactatgagaaatcagataatttatacgaattgataacaaaaatattagaaatttgtgcaatgctttttgagcagtatcttttaaatttgtgttttctgtttattttcatattttatcttatattttatattttaaggtatttatactgtgtaagttttctattttaaaaaatgatcaaggaacatctaataaatattaggtttcactacgtgcaaatttaatcaacttgttttatagggaagtgattcctagatagctagtaggctcagaaagattatgttgtccatggtgataactagtcccaaatgcttttggcaattttcctggaaagctcagaaattgcctattttttcagagctcatcgtagagttcacaggtatgttgacaagaaaaccattttaaaatctaaaaactatctccttttggtcttaatttcatttctgtggggtgtatgatgtgaaaaatatgataaatttcttgggacagtgtagtgccagtgtttatgaacatttctgcttttgtttatgtgaaaatctaaggagtttcccacagatgctgtggagttaaggccaaaaatatgcatttttttcaaagtgccgatttaataaaaagtacacggtttctctgaatgaatgccttgagaggaggcatgtgcagggtgttccattgcacatcaatcttttctttataataattgtgcgataaaaaagaagatgctctaacttgcctaatttctgacataggaatttctgctttctattttgttatattgaacatgttttatgagttgtagtaacaattttattttttaataattaggctattatgcttgtactatatttttaaaacaatactctcatgaatttttgttgaattatttaacttccatattttctcaatgcctctactacatccagggagcaagtgggttcttcaaaagctatatgtgtatcaatgtcgttttagtgatgatttctggtaatattggtgaaccaatataatttatggatgtttccccaaaaacaacatttataaacacctattcaaataattaaatatttctaccactgaaagagccacaatagacacaaacttgatgtttattttgccagtcaaatagagaaggaagtaatatggccaccgaagaagaggaatagaacatttttacactttcttatgttctgattactagccatatatgtttaccaaaatagtaattattattacagcattggttggaataataacattatggatctggaatggactttacacatttctattgcgagggattgtgttgaggaaattgaagatcagaatctgctaataattttgaccaaactgtgtatgagaaatagaatctagattttcagatcctcaaactaggaaggacattcttcacttcaagttgctgcccattctaatgtctgctgttcttttttcttgggccttagcagtaggcttataaagctatataaaaatctaagtgccaattaataagttattgtttctactggtaaaatagcatggaagtggcctgaggtaaagaatgtcctttaccaagatttcttgatttcctcctgggatgtactcgaggctgggaaaatgtggtcatgcatgtttcagagtggctcatactcaagacatagacttattggtcaactattagaactaccctcagcctgactatgcttttcgacgcagtgagtatgtgtgtcatgatgaaatacaaaatggcaccatgtctttctcatacctgagctttctcacatcttaaataatgctcttgttttattccatggttttctttggattgaactgtatccattaacatttgtgtgcttttcttttccatccgtccttctccatctcatgaaaagcacatctgggtaagttgaatcacaatggctgctgaacatgtttattttcagcgccatctttttttttcttttttcagagtattactcttttgagttgtaacacaagctgcactgcctctgacctgaaatgaaaatcatgaagcatatttatttccacacagtaaaaggaatcattggttcagagaaatgttcacattttaattaattatgtaagcttttgggcacttgtatttcttcagttttattatacacatgtcaaaagacattctagactccttccctctagttttcaagtaattccctaaagggtcaatgtggcaagcagccaggctcaagtcatactttgagaccactcaggtactattgattgtgctgcctgtctgaattgcctccacctttctttctttctttctttcttttttttttttttttttttgagacagagtcttgctatgttgcccaggctggagtgcagtggcgcgatctcggctcactgcaagctccgcctcccaggttcatgccattctcctgcctcagcctcccgagtagctgggactacaggcacccaccaccacgcctggctaattttttgtatttttggtagagacggggtttcaccgtgttagtcaggatggtctcgatctcctgacctcatgatccacccgcctcggcctcccaaagtgctgggactacaggcgtgagccaccacgccgggccgcctctacctttcttaatgttccacctgtgttatgttcaagagacaaacttattcatcaatgaatagaacggcacatatctgaaaagggttaaatgctgttcttccctggagagcttttacatatagagagccaagaataatccttggttttggttgaatgtgtgttgttcccattgtttcctgtactactggttgatttctaaagctttaaaaacctgaattactcagataatggcttcaaattttaaatccttttctttgagctaaaattagagtatttatctattcctaacagaaatttgacttcaaagtaaaaaagtaaaataaaatatgcataatatttacattggtgtagactactgcatttgtaacatggtgagctcattaaaacactttggactgagaagaaggtattgcttttaaatttaaagcagtgttattttttatcaataaaatgactgcaatgagatacaattatccaggaaactattaaacatattactagttggctatataaatattttgtatgccagtacaaattcttgtactttgtaatattactttattaactagtaaggtttatattatttttaatataattttaagttacagttgccattgccaaaatgacttggtgatgtattatttgcttcagttaggatgttttacaatattgaggaattaagaaaagctctagtaaggtgttcttaaaaatgcaaggcaggttttgtttagagtactcgtcaaccatgttggccaaatgaatattgtaagctctttttgaaaataacaaatattatagacattgagttttaaaacacagttttcatgtcatcatataaattgtcttctgttttctaatgatttttaatttttcagaggaaaataatttcaagaaataaaacttaattcccctgagtccttattgaattaaatattgaaaaacaatgaatgaatgatgcattcttattaatggactgtaagaaactgatataatggacttcattctacaattcggtttcttattgtcttacacatgctcctcgaacttaaacattttaggaccttaacaccatttccctagtacaattactaaaagaaagctttggataatataatatcagggaagatagtacaacatagtgaagatgacataggaagatgtgaggagcaaacaacactgaattaggaatcagaagatagagtttaaattccatcttccccacttacttgctacatggccctgagtgactgacatattctttgtacttactaatattattatctacttgtctgtaccttcagaagcatacaaactatacacttccaaactgggtaaaagagggcttaaaattagatgaaacactagagcaatctaatctaagtggtattcatataacctgaaaaattacaatattctccagtaggtccccaattactattaggaagtgactggaaagtacagactatggtgtcttgcaaaagtgaaattgtttaatggggaggaatataagcccctctcattttcaataacagcataaataattgtatgattcaatcatatttgtgtgtatgtgtgtgtgtgtcaggggggtatttatacctttttaatggctttgaaaatatttaaattcaaaatacagtaaggaaggagattacataactcgcaactcaattcccaaatacatttctttcctgagactatgccctatatttcagagaagcttgaaggtaaacggtttaaatatgaatgaattttagttccaatgtaatgaaattatttgaaatctaaacagcctagcatgttttactggaatctgaataaaacactacttaaatatgtcatggattttcatacattttcaccaaatgtgaaaatatgcaataataggatacacaggcacacacgcttgcacttgcacatacacaaaatcacagtatgctttgctttcaaatcaagtcaaatttaatgttgaatttgaaactcttaattttatgaagctaaatatgtatagttaggtaatcaatcttctgaagcaactgattggaatttgtaacatatttctgtttagaataattatgttaactaagatatacatgttcagcttgcagatgttaaaaaaaataattgagttggcaccatactttgcatttgctgaccagaatttcaactagcttctcaaatatgtagttttagtttttacagacttaatcaagtatggattcctgaataataagtccattctttggttgaaatttgaggaggttacatcctatttaccctcttgaaagctgaattttagtgaaacaatatacattttacaattaataatagtgtgaagtctgtgtacatttcctgctactattatgtaaggaagatttattttctgtgatgcaaaattaagtatattgcattgtcacattatttgacttatattttattcttcattcttatcaagccacatatgtatttcttctggttttatcagtaagtacttcttatgtgccatagtaaatcagtagctctgaaggtaaatttttcacccagagaattattttgtatggttattacaaaatcaattgaaatgaaatgaatggcaacaaattcaacttttctatctcattcatttaaactaggctaacttttctctggccaagatgtacaacctgatattactagggaataacaagaaaagaaaagccacagttcgtttgttcttttataatgctgaggattgaaatgtgtgacaataagaaggtaaagaccttatgtattaaccaggaagtcaaataaatgtatgccacttctaaaaacaaatgaaccataggaaaagaaagaaaagtaggggaccattattttattttacacttacaataaggaaggtgctattatcctcatttttcagttatgaaaaatttcagaaatgttaattggctaagagatggcatggaggttaagagagctgactctgtggacaggttattggggttcaaattctgattctgcacctcgacggttccatgactccaactggcctctgttcttcggtgttctcatctgcaaatgtgtgtcaatatgtatcttattggattattatgaaaattaaatgaattaatacacataaaaacacttaggatagtgcttcataggtagtaagtgataaatgcacattagttactgttttgtgtgatccaaagcctaatttgtctgcatccagaacctttgctctttcaaaccactatatttcatcttataagaatatgaactggttcagatgaacaggagagcgcattagatgtatctcaattatagcacttactgtattaaattgtaatgcaatttatttaattatatttagattacattttaaattttaagtgaaagtataataagtacaagtataatagatacaagttatggtatttgcatagaagagagagttaattctgcctgggagaggacttagaatcttaatagaaaaaataaagcatgagttctgtctgaaggataagttaaagttgttatgatggtgatgtgaagaaggatgctcttggcagaagaaaagggcatatagcaagacatggaggggtaaaatcgaatgaggtatttgggtaatagcaaatatttgtgttagttgagcagaaaaagccagggagacagccagattgtgaagcgtctttgtgtaagatatttggcctttattttgaggacagtcagggaggcttttaagcaggggagtcttacaaaaagatttgtgtttaggaaggtctcagtggaggttggaagggacaagttaccaaatgagagatagagagattctaggagcccatcaccatcatcatcaattgatgagggcttaaacaaaagctttggcagtattcagttagtctagaaaatgtctttctgaatgttagatataacattgtaatcttttctgcagccaacctgggtaactgtgatgcagaattcttatttctttttgagatgcaatgaacagttggaagttataaaaatatagaatactttaaaaatgccctataatcaaggatcctaggtgattgtcaacattgtgagttttttggattacaatttagcagtcattcaaaagatgttcttgactagaacatccagagaaagatgcatgatacggttgaagaacaaactcttatttccaggattttactgtcttgggttggagatgaggctgcgggcacatggtggtaaccagtgatctctatgagtgagattgacactacaggcttccagattttaaaggagaagaggataattgtagattgggctgatcacaaaatatttcatataaaagggaagccaggagttaagtaaacacaaggttgttgatagttgaaaaagtagcgatcaacttaccagctctgggaagtggtatttgcaaaggtggaattggtaatgcacaaactgtgaaagtacttttcaattctggttagaaggaaaggtaattagataattaaatcaagattaaaccaggaatctctttgtaatgaagattaaaaataatcttttagacatttgaggaaagactgaaggggctttagaggacagtgctatgattatttaaagtaaaacctggccaggcacagtggctcatgtcagtaatgccagcactttgggaagctgacgtgagcagatcacttgaggccaggagttcgagaccaccctggctaacatggtgaaaccccatctctactaaaaatacaaaaatttagccaggcatggtggcacgtgcctataatcacagctactcaggaggctgaagcaggacaatcgcttgaacctggaaggcagaggttgcagtgagccgagatcaggcccctgcactgcagcctggaagacagagtaaaactctgccaaaaaaaaaaaaaaaaaaacaacgaaacaaacaaacaaacaaacaaaaaacagtaagaaagaagctcacatttattgaccattgccttttgtgtgagttacttttgtaatcatattacacatattttcttacaaaacctttgtaaaaaccctattagatgggttatcagcttcatgttccacatgaggaaactgaatcacagcaaaatacagtgacttgttatggatgtgcagcccaaaaggacaggcaaaggaatcaagctcaagcaatttgattttgggagccactttctcacccactctgccataaagtttatcttccaggcagattttttttttctttaatgtcagtgtaagaagcctggagagaaggaccaattaaaggctgagaaaaaaactgtggtagcagtgacaatagaaagtaaaggaagatacattagaaagtatgaaggggaaaatgacaggcatcaaatagaaggtgaatgaaatggccatcatgagtgacagaggggacagtgctgtatggtatttggacagtcataccacaaattggcatcccagaatagcatgctaaagtgagaggtctgtgaataaagtctcttttcactgacagagataaaccatccacagtaggaagaatgaggaggagacatactgttccctatggtctgtgacttttttgagtaactaatgaatttcatttttcagaattgcaaatataaacactaacaaattcaagttttaccattccaatatagttgccaataggatagctatttatggaaaggattgtctaataagtaattttaaatagttgagacatggctcatgcctgcaggagattatagtgtagcggaaataaggctgtgtacatacggtgaacggcctaccagagtcttgcacatgatatgagtggcatcactcaagggatagagaaaatttgaatggtatgaattgaggaaaggccattccaaatggagagaaagtcagtagaacagaagaggtaaagtgcaaagaatggtgagtatccattgtagctagagagaatagatacagtaggtaaatctggaaatgcaatttaggggcagatcaagaatgaccttaaaggccattcttccaatagtaaattaaaagccattatagaaattggagttatatagtaagctaataaatatgtttactgagttatatagtaagctaataaatgtttactttaaggaggttaatctgatggtagcacacacaatgaattgctttgggaaaataagaaaaaattggagaacggaaattagttatctattgaatacatattggctgctaggtgcttttgtaagtattatcttatttagttcttataaattgagatcaatttataatcatcttcaaatatgggaaaattaagtctcaaagagattaagtacatagccaaaaaacacatagctggtaagaagttaatttgccatgcattcattcattcagttatgatttattgaatgtatgctgtgtgcctgaatccctattccaataacctctcaccatttctgctgccacagctcaggacaaagcaaccattatcttctgcttgaaaattgaaacaaccttctaacttgtatccttagatcacaactctggcctgactcaagtccgtgctatcctcaacagccagaaatgcctttataatgtacaaattattttatgttcttgtgcttaaaccctctgatggcttcttactatgtttagaataaactcctcttcagctcccaaagcccaacatgttcttgcttttctcttgtctacgtctccaatttcatcttcctccaccaccaactcccgtgtccttcaattcactccagtcacactggcccttcttggcttttatcagttgctcaaacatttaattccactcctttaataggaattttatactatgtttctgcttaaaacattcccaccatacccctactccctgccacttttcaacgtacatgtttctactcaaatgttgcctcgttatagacatctatgttcccagaacactataagcattgcctactttactgccttagtctattttacctcctgtagaacacatatcaatggctcaacttattttgtttatgtatgtgtatatgtgtttatacaaatcttccttcctcactggaatgtatggtctttgaggtcagagattcagttggctttattctttgcttgctgcaaaacttggcatatagtaggtctatacaaatcagatgactgaccccctaatcaactcagacacagagcgtacaaagtctctgctgtcaagcccatggagtcaggggtcacaacttgtgaaccaacaaattcaatgaaacataaaagatactatagagaaaattgcttagtactatggggcctatgtatgaaagtggtagataatgcctccagggcaagagaaggatggatatagaaaggaagcatttttgttgaatcatgaaaatcaagacaaagtatgtggggagataaggcagggaggcatgtgatggcatgcaaatgcaagagatgggagccagagactctactcgtataccaattagaccacaacaacaatcgctaaggagaaacttaaaacctaagaatgaaaatccaggcatttccatctggatttagtcattcaaccagagttgcacccgcctggttaattagtctgcattaaaagttggaaatctgtagcttggccaatgcttctaatttatatacattttctagaacctattggtcttttatctagaaatttttgagtctcgtcatttcttgactgcacaccctttgtttgctcctgtcttcagttcaggcatagcaagtgcagacttccctctgcacatttagatacggacttgcaaattattcacagacctgagtgctcaccacatgttgggcctcctaaaatatcactttctagtcacagtaacttattgatatcaataataggagaacctgaggcctatggaagatactaacagcattctttattgaagagtgtttcttgaaaatgcacaatgattcagaagttgtactgtctcaaaataactgtttcttgcaattagtacttttcttgtttgtgttttgacacaagtgataacacctccatgcctgacacttcctctaaaaggaagtacagctgatgccctctaaaatctattctgaatcttaaacctgaaatgtatgccccgaaatttagtgatgtacgggtgatcctttgggaaaagatggtcaaatatttgattgactgaaattatttttaaaaacacactaaaattattcttcaggccaacagggaaagagagtaattttcatagttaaatttgtactggggtaagtgatcacattctttttctggatgaactgtcacttgacctttaaaaaaagttgaattctggctacaaagaaaatccattccagactaaatccctttacatacattgacaggttgaacggagaacagcagtatatccaaaagacttctttgtgccaaatcagtttgtcatttaggatttcttatacagttcagatcactatttttctgacagtaactccaaaacttgatgagaataagcatgcccttatgtaattagtgctacccttaataatctattagcatatcatcatgtattaaattcagttatttccaagtattatagcattgcccacattgctttatttttctagcattgcttgtctctcaaaccaacatgcctagatatatgccttttataaattttgtatggtgccgattattttataattaaaaataataatgcaaggcaatattgctttgtaaatttcaatgctgttcttttttaaataattgttacttctctcaaaaggaaaagcacatctggagttaccatcatgtagcacacagtcctggtgtaaaacctagccatccctcccatctgatctgtttttccacagtctcaagtatgtcagccctaagacagatgctagagattttgccctaactgttggaaaccaaaggatttgagctcccttatctcattttcttagactgctattactaaagtcatcctgttattagagtttgtgatttaaacaaaacaaaaaccaagaaaataaaactttttcagtggccagattgctcaataatttcccaaacaattgtgttatcaatacttctgttcatagaacagaactatttgagcacattgggttgcctcttaaccaaattctcaccaggaatcccaaatagatcagactcttgggatcagctagaatcagtactattgtgagaaagtgggaaataaaagctcaagaggaggtaagatgcaagaaaaaaatttgttctttaaaatacaaaatgttgtacatggttataaggtaaaatagaaaaagctatttggactacaaaaacaaaacattataggacacaatttactgaaacaagaagcacctaaatataaacactgattggcattttgtttaacatttacacgtatttatttagcacctcttctgtgcctgatcttgttctagacttcaaattcatctctgaacagagcatatgaaaacacagatcctccctgagcttacattttattggcagatgacagaatgaggagtaaataatatactatgttagaagggcaataccttggagaaaaataaagcaaacaatggggataagaaattccttattggagttttcagggagtaagggaggagacattcagagaacaggtgacatttgagtaaagatttaaagtagctgagagagttagccatgtagagatagaggggaagagcattccaggtgagctgccaagatcctgagacagaaaagaggtctgggttgtttcccaagaacagcaaggaggccagtgttgctgactgagatgggagtttagtcagagagatggcgcgggtacgatagattgtagcagctgttttggcttttatttccagtgagacaggaagtgattggagagttatgaacagaaaagttacatgatcagactcaacaggatcactctggcctttctagtgggatttttattagggaactagtcagaagtttcaaaatgaaagcgttctaatatttaaaaatagcttttgtacaactcatagaatacacttctgaaaatgttacgtgctccttaggttattagtgcatatttacttgcttttttactatgtgaagcaaaaactaattgtaaatgtaaatttatttcttcccttttaatgtcacaaacctatgacataactagaagtgtcgctttccctattggatgtaacattaaaactcttacaacatgcattaactctgtgaaggcctaccctaaattttcttccacgtatttcatgttaagttccatacctccccattagtgcttctcctgcttggaatgccatccccacctctttcctacctgcccttcgaagccagctccattgccacaatgccttcacaacaccttcaatggctattaaccccttttctaaaatgacatacttcacaaggtacatcaccaagttttcacgttagcagctgtttgtgtaatgtattgtattatattgtattgtattgtattttcagacagtttcatgtgtttgttttgtccatctaacaggatatcctgggaaattagacccatatctattttccacaccaaacacaagtctcagtccacaacaggtgttcaataagtacctaataggttatttgtttttgatccttcaatccatttctatatatatatatctgtcacagtgaggctaagctatttgaaactggttttcactaaaggaatgtcactgggagacctgagggaatggaggatgatagagcaagccaggtgaagaagtgcctctacttttttagattcagagcacgagtatcgctgttccctttcccaggtgctgaatagcttacatgcagaacttaacacttctatcccctcaaatgaaacagcagttgatttatgtctcttcagccactataacttaaatttgtattttgcaccttttttaatgaatttttggttgcatctattacaaacacagaaaactctgtgttgaaaggcattttattcattatatatcttaatgtattaatatagtctaccacagtaactaattgattaatagtagaaaataatcaaattatccatttgggagttcataaatgattttcatgaaatattcctaagcataaaacatacgcattcaaaataaagcaattattataccatgtttttatcatctatgtgtaagatcaaggcatactaaagtaaagagaatgtattttccaatatattcctggccaagtatatatcaatttgaatttcagtgaaagcacatagctactatcttaacaatgagtgatctcaaattggctttgtaagtggatgtcaattctaaaaatcagtaagagggtcagtgaaattatagatgcatttttcagagttcttttgcatcttttgttatcaaaacaaccatttgttgttattaagatattttaatttcattaaaacagtagtgattatagataaaagcaagtgtaccattgaatttgataccttacattgctttcgagtgttagaaatcaatttaccttggagttttctccaagtgagatgtagttttatagtctagacaaataactaactcctaagatagatccctggacccacagggcatactaaaatcaaccacatcactagaatgtgactaaaaggaccaaatttatcttctgcctctctatataagcattttctttgccatggagatagtaaggcaaagagggcagggcagatggtggaagccacatttagatcccataatgcatacttgaatatgaacatttgggccattttctcattaaagggataagatatttgctggtaatataattccacttctaattccattagcacttaatgttctaattttcatgaataaatgttggggaaaattacttttctatgtcaatgcttcattcgtaataaaatcaatggatgatgtgtgtgtgttactcaaaggaataaggaattctgttattctatattgtatcataaaaaatcttgtaaaggatgattggttattttaaaatattatcattaaaaataatcacagccatatttttccatatacctgcctaataatctttgctatatacttcaggcatgaacttcttgaagaagctcggagaaagggattaccttttgcccagtgggatgggccaactgtggtcgcatggctagaggtaagagaatgaaactaggaggcccttgaatcaatcactactaagttgataatttttttgagacaggtaacggcaagtttctgaaatcacagcatccccttagtctggaattgctcataagggactatttgcttactagggaataaatttatgattttatgctgacacttttttgtgatcgtagtagaagaaatcatgcagtgggataaaaggaagtgtctctaaatcacacccttttcatttctagagcaagagaagaaacaaaattttattgttgcaagagaacatccattcccatccattaggccagggcccttcctcattagcaggttacagagaagaccctctccatattcaacacttctgtaatccaaggtagtaagatcacctagatgtacagagagacattcctttgcctgtaatttagttcctgaacctagttctctaaagcctatggaccagctaggtttagacacttgggattaaacagaagacttacaccttattcccttctgtgtccaaactgaatgctacaataaaagaagaactattttcagcatttcctgtacaacatagtgttctggaaaaataagggaatatctgaacagggtaggaggcagcagaaactgactttgacattgacggaactacatatttgactacgaagggctgtttcatgtcacttaacagtactgttcactgccccttctattcagttctctatgtgagctgctagtagctgctaggatatgcctgtgtcagggcaaagaagaatccaggctttccttgcctgccagaggtaattatacatgttgttttaaatggtcttggattataaaattatccgtcttcattttattatagccagagctaagtaaataaataataaagaaacattaaagcccattttagttttaaaaatagacttagatagatctagaaacacgctttgtattttttcttgcactgaatgaaaaatgcctgtattttgcttttactttattctttcacatcagacagggaaatttagcatattagccatcagatattagcgatcagctgcttctttcaaccgtgtctttaaaattactatatttaaaaaatcaatcacaagacaaaatgcttaagaaatcacacctcagaaatgatagcagttctttgttcagtttttgctccgataaaatgagttgcagtttgacagagagttcgctgctattttggcaagcgacgaacaaatccttcagataaaaagaaaaaagaaacagatttactgacattaaggtgataggagatgacagacagtgaagtttgtgctaattaaacctattctgagtacacagaaattgcctatgattcctaatgcaacttaaattataaaatggaataaacaagatgaatgagctgagtgatccaatgaatgaaactttaacttcatctcctttcgttcctccttgagtgcacagcctgttaagaattttgtgtaggcgagaattccatgcttcacatgccatttatccgcatcaaagactctttaaggtctaattatggatgacattggtaacaatgtattggcaggcatttgggtgatgttaactagtgtggaaatccaaatatcttagaagacaaaggtaaaaaaatcattagggtccaaagaagacatatttagatgtttagttattttgaacagtttgagtttataaactaaatagtcaagtactatcttctgtcatatataatgtacctgtcaaggtcaattatttgtgcctaacctgctggaagaaagcataatctgtacagtcacacattgtacttagatcttccccttcttttctcttatctctatcacaacccagtccacactgactcaaagagtttcgttgttggcattttttttttcaaaagagacaaatagtcttttaatattgtagaatttttcaactaaaaggatgtttatactggttagctattgctgtttacaaattacccccaaatttggcatttatgatctcatgacttctatgggtcaggagtctgggaatagctttgtgatggcctctgctcagagtctctcacagggctgcaatcaaggtatcagccagggcagcagtcatctcaaggctagacttggggagaatccacttccatgctcattcatatggtcagggtcatgattcagtttcctgctggctgttggccagaaacattagttccttgtcatatgggactctccacagggctcctgagatctgacttactccagagtgagagctcagagggaaagagacagcgggaggggactagcaggaatgaaaccacagtcattttattgcctaaactggaaagtgacatcccatcacttttatcatcagctatttattagaaataaatcactgggccaatcctacccccaaaagaaggagattatagaagggaacggatatcaggaggtagagagaaataatcaagcttgattccttcattttacaaatgaggaaaatatggctgaggtttagatgggttacatgactcaccaatgactggaaaggaattagggctcaggtcttctgatttgtggtccagagctcttggcactgtattttgctgatttatagtttttcttctttgtctcactttttctcactctcacaattctctcctttgttcaatctgtttatttcaacaaatagaaaaaaaaatcagtcaatcttttggacattcaaaaacaaatatgtaagctgctaattttttgttgtgttttctacttcttactcataactaatgatggagggaaaatgggagaatattcctgttttaagtgatgttattcaggtgctgaaatataatgcccgtgattggcattcacccagtgcttgagatgtgcacgagacctgtgctgtgtaaatagcactgctggtttaattgtctttcaagagtctcacagcaaagttgaaaaatcaaaatatctaatttcttttcttttttgagacagagtttcactttgttgcctaggctggattgcagtggcacagtctcagctcactgcaacctctgcctcccgggtttaagcaattctcgtgcctcagcctcccccgtagctggaattacaggcatctgccaccacgcctggctgatttttttgtttgtttgttttagttttagtagagacagagtttcaccatgttgcccaggctggtcttgaactcctaagctcaggcaatccagtcatctcggcctcccaaagtgctaggattacaggcgtgagccaccgcgcctggcctcattttttgttgttgttttcttttgtttcgttttgaggcagagtctcattctgtccccagcctggagtctaaaggcctgatctcagctcactgcaacctctgctgctcagtttcaagtgattctcctgcctcagcctcccgagtagctggagttataggcactcgccatcatgctcagctaatttttgtatttttagtattatgatgtttcaccaagttggccaggctggtctcgaactcctgacctcatgtgatccttccacctcggcctcccaaagtgctgagattacaggcatgagccactgtgcccagtcttaaaatctctaatttctgatgcattattaattttgttgctttctttagtttttcaatgatttgagttttaacttctttcttagcacatcatttcactctctaaaaggcattttcatatatagcatctaattaagttcacacatctttcacatggtgtaggaaggtaggtggaaatgtggcttagctacactgcatgctttgatcgaaatcacatggctggatgtggcacagctgtctcgttctgtgacagaatttctcttcactcagaattccaaagaagcattataaattgaagccactcattaagcaaacattaattgagtcccttatcaaatgtggcttgtagccgttctggtccctacatacaaaggggaacttggtgccatgcagccattacttttaccactagtaatatgaattagttaaaatagagtctctggagctagcatgtctcaatttcaaatcttgtttctatccctgcctccctggtgtttttaaatacatcatttaatttctctgtgcatctatctcctctagggaaaataatgataacattttatctcgtggggtgaggtcatgtatgtaagatacataaaataattcctagcatatgagacactaaaatgataactattattataatttgttagtgtattttttcctatctaacagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactgtgagtcagtttctgctcctccccttcctcagtgctaggcaaatagccgtgtgtctaagtctacagagcaaaattgtgacagcacacatttcaatgtcagcttgaattattctcaagagattaagcttgctctttattaaccttgctgctacttttaataggttttcaaatgaggaactatgattcatatcagacgtgaaagctagcatagcagacttttgagctagcatctgaagtttagatttttctcccaagcgacaagaccctgagcttactcttttttcaattccttccttccttcgttcctttgttcctccctcccttcctccctcccttccttccttctttccttccttccttccttccttccttccttccttccttccttccttcctacctaccttccttccttccttcccttcttccttccttcctttctctttccctcaggtaatttctcagaagataagatataagcattagtgattactaaagatgcaaggcttaagtgactacattttttagttttaatattttttatttttatagattcagggggtacatgtgaaagttcgttacatgggtatattatgtaatggagattttggggcttccagtgtgcccatcacccaaatagtgaacgttgtacccaatgggtaatttttcaaacctcatccctaccaacctcttcccttttggagtctccaatgtctgttatttccttctacctgtccacatgtacccattgtttagctctcacttacaagtgaggacatgttgtatttgatttttttttgtttccaagttatttcacttgggataatggtctccagttccatttatgttgctacaaaagacattagtttattcttttttatgactgcatagtattccatggtgtgtatatacattttatttatccaatcatccactgatggacacttagattcattccatgattttgctattatgattaatgttgtgataaagacatgagtgcaggaattattttgatataacaattgcttttcctttgggtaggtactaagtagcgagattacttagttgaatgctcattctatttttagttctttgagaaatctccatactgtcttccatagaggttgtattaatttacattcccaccaacagtgtataagtgttcccttttctctgtgcccttgccgacatcttttttttttcttaactttttagtaatagccattctgactgaggtgggatggtatctcacttggttttaattgcatatatctgatgattagtgatattgagcttttttatatgtttgttggacacttgtatgtgttcttttgtaactcactatttcttaagaagtttctgtaattatgaaattatgtgagtttgatgttttacagataccaaatggaatatctggaatatctttttctttcaaagtctgtttgtttttcagttataaattcctagtcatctcataattttttacctatcctaatcctagaaaagaacaaaatgtgacaaaaaaggcatgcatgacgacaaattcccaaaaactcccaaatagtatttaattatttgtttattccattcctaaattatatattttgtttataaagtatattatttctgataattactagatttcccaaatctcatatcttatatagcataataaaatatgggagaatgagataaattttagcaataggtaaaatattaaaaagtcttattactttattgcagttttcaggcagaaaagtaacaagtataacttttttatacatgatcttaaacagttgtgaatagtttgtttcatttctatttacacattttccttcccagtatactagattctaatgccagaaataaaaggtcaaatttaaaaggcttatataattcttacataactccattttaagttcttcctaaatgacatgtaggaaaaatatataatttttaaaattcttacctatattatttttaaatagacacaaatgtttttcactatacctggattatgactcaagctaaaagacaatttagaatacaatagccccttgaataagataggagttaagggtgctgaccccccacacacagtcaaaaaatcagctagaatttttggctctcccaagacttaactactaagagcctactgttgactggaagccttactgataacacaaatagttgataagcatgtattatgtgttttatatgtacacatatatgctccattcgtacaataaagtaagctagagaaaagaaaatattattaagaaaatcatagggaagagaaattatatttactattcattatgtggaagtagttcatcataaatgcctttatcctcgtcgtctttatgttgaaagtacgctgaggaggaggaaggggagagattggtcatgttgtctcaggagtggcagtggcagaagaaagtctgtgtataagtggaatgatgcagttcaaacctgtgttgttcaagagccacctgtatatttaaaataagaaactgagaagaccattaaaatagttattgtaaatttaatttaagtctgatgaagagtttgctgagtaatttccagctgagagagaagcatcataaatagtttatatccacattttcctcccaagagcaaatgcaaacaaaattattaaacattatgaatcttgcaaaaataaatttgaagtcccaacttccagatgaaaaatatgatacattttattatttttatttaccagtgtaattcatttcttaatgaacaatagggaattttaaaaccatttttctaaaactatttaaccaacctgaaggaatttaaattataccatattaattaacattcaattgtttaaagaatggggagaagtaaagaaagctttatgatctagcctcagttcacctcgaaggctttatttcccaggtcaggaactactttcagtttttcaaacatctttccttttggtcagttatgagcttttgtagttggtcttccctttgcccaaaactttcatcctacttcaaagtcatcatattttctccaattcattattcatttatcgattcctttacatatttcctctgaaaagcttttgctgagcccccaaagcctgggtttggtttccttcctgagttaccactccatgtacttataaacaacattttacagttcttcttttcttcatttatctcacactagacgaaataaagatagcatcaggtttccatcaaccccaagccttagcaatagtgcctggcaaattttagatattatgtaaatattcaccttaaaataatcattgtatagatcactctacccacatatttcatatactctgctgaagtataagaaacgtgtggccttgagatcagaaagggaaactctactaaggaaaataagcatgttgactggtagatttagtacaggattatatagattaactccaaaatgtgcaatagaagtgaagtgtgatggagcttcaagaaaggagaaatcactacaagctggataaggcttcaaacaaaaatgaacatttgaaacataaaaaatatattgtttatagcatttaagttttatatgtttattgaactaatacatgatcctgtataacatttgtaaaatacagaaaaatacaaagatgacaacaaaataatttaaaaacattaaaaaatactgattttagagataatcaatgttaattttttcactattgaaaacatttgatgaagatcttgtcattcttttttcattatctttttatataaatggattatttcacataatatattaatttgtacttttttgtaaatttagtaatgtagtgtaagcattttcttcattttattaaatatgcaattgcaacatcacttttagttattgaatatgtcctttgtagaaatgtgataagttatttaatcaaattcctagtattggacattttctttgttttgtgtaacacaatttgttgttgtgtgtaaaatatgtgcttgtaattatgttgttgcataaactgtggttatttccattgctatatttgtgtatacggaatgcatattcttaatacttttaaactttaattgttaaattgtgttgtgttgctattttttctccctttgtcaacattggttatctccttgcttaatttacattttaaaaatcactactaaatgtgcaaatttttatattcttattaatctggtatttatattaattttctattcataaccttcccaacttatctttattattataggaatatatatctttttactaatgtgtaatagctctgtattcacggaatatatgtacctcttgccagatactgatgcaaattctatgagacaagttaagttgtgtctctaggctttaaaagtatctactaaatgtttcctcttccttctactcactctacatggtagcatttactcatttctaatatatttccaatacaatttgcattgcaaatgaaaattccacataaatcactattaatgaatccactacataaagtcataacctaacattatgtattagaattcacacttacaaaacacaaaggcagatttttttttttttaacaaagttattctatcatgtcttcaagaacactacagtttgtttagattatacaagttattttgcacactgaggtttggacttgggttcctcagccaggtatttcgtgtttattaactgaagttctgaggagaaaaagacaaggtacctgggcttcggggcttttttatttttaacttttatttatttatttattctactactttatttgattcagcctcctttcctgcctagatataatgggctggaccatcaaaaaggaaaatttaaatgtcacatatatgattaccttgagccagccctaaatttccagctttctgtttcttttctccaagctactattactacagaaagtctcttacctagtaggatagagatggagataccagttaattgaaatttggttgaagaaggatgtaacaaaaataagtgcattctttgaatactttatctcaggtaaaaattacagaaatgctaaagaattgcaaatttagatggagcacctaaaactatttttgtgtatgtttccaatgtctggagttccacattatccttttagataatcttatctggaaacatgtttaatttctctagttggtgtttctttttaaagtgacgacttcaagataactcaaaaagccatttgaatgaggaatccttctggacatttacaatgccttccccagactttgacaaaattgtattttattgatagtgtgtttcattcaagatttgcctatctctggtttttccaactaattcaacttagtgtttatataggagccaaatttgttttatattttgctttatgtaacatttatttaagttgatgaattaaacattttaaaagcaagtgcagtggaaataaataagttttaaacaaagtgatttttgataaccatataattcaacaagattaaacataaatgtaaggtgtaagataggcattagtcagctcagtgtaatacagagacctacagagtatttcttgaattaaagatttgcttgaatggagactacctaacagaatatctaatataattacagtagtagccaacatcagcagaatgctcactgtcagggactgttctaagcgctttacatgtaatagcccatttgactctcacaactacagctatgagaaaggtacttttattatagctgtttcacaaatgggcaaaactaatgtaaagaagtaaactgactcacctaaggtcatactcctatgtgggttttctcctaacaagcacattctcctgcttctgcttcctgcactctatcagttttccttctttttatagcattcttttagtctgtttgattcctcttttcattattacttacctcataagccccaacctttattgaaaagagggtgtggtataattgcctttataaaccttaacctttattgaaaagagagtgaggtgtaaatatcattcttattataatgagaaggatttatcttataatgagagacaaaaattcagataagggagaaatgtggatccaggccatttgaatgtgaaaagtaatttcaagttactactttgtaattccattacaaagtaaaaaacactttaaatgacctaggtagtaacaaaagttactttaactaggtaagatttaggattattctgaggtctggctgctttacttatactgtatctctgacagcaagactactcattattttcacctgattaattttcacaagttatttcttaagttcattgtaatatttatttttctgtcttaactctttccagaatgatttcattaggtaagttctttaattctgatcattttttagaaatttccttctccttctcccttgatactttctcaaagttctattccatgggtactaaggggagacaagcaagataatctcaagcataaaatttaaagaggctctcattgtcagatatcaaccctgaaagtgaatgtttccttaaattatagcctcccaggacctcatgtgcctcatcctagtcccagccctgtataagaacatgttgtatcataatgtaaactttttagtgtttctttctattctggagcatgcacttttagtcccacttaagaagtgcagaacctgaaatttagacaggcttaggaaatgtcctagagtagtcattagtaagtgctactgtataactcaagccccttgattctaatttgataatataattgaaattttataaatttcatgttagactcagatgatattagccacaaaaaaatgactattggtttgcattttctagctcgcacatttttgggggagattgcagcacagactaccaagggcagtgagtagataattttaaggggatctcagagaaccacaaccaagttatacaatatttgtttcttatgcttttccaacctactttttgtactgtatcctcaatcccaaggtactcatatctttatgccctttgattgctcagtttcccaatctagctatcttgtagggatgctttgctctgaaactctcatgctgtaaattactccgtcacaatgtacttagatgcaagttccatcccctaaagtggtggtggagagagagcaatctgattgaataattgacttactacatatgagcttgcctataaaataaacttgttaaaacttcagttaatgtctacttgactaggttgtgtagaaactatttctgtcggctttttacaagactatagggctggcagtggtcttcacaagtaaaactgcatatcaaacagaaacaactaacatacaacttctgaaagtttgccagtcatacttcagaaaattgtcctgggtatatgcttattttgtgaggaatgaaacagataaaaccatagcttccagcatgttccacatcccagaatatggtgacagactggcagacacagacttaaagataatctgtgaaagatactatgcatgtatctattctagtatgagataattaatacaggtagtttcttaaagaagtaatgagatcttcattatttggattacgattcaaagcagaagctacacaaatcagtgtaaaattgattttacactgttctgcaagcttaagccatttaagattggcttaaatgaatttcttctcaggtaatcattgctgaaactcactttgaaccaacagtatacccactcaagaaagcaccacgataactcagtgtaaagggaatgtgacagatgcatgtaaagtactcttcagcacagcactctcctcctaaagtcaataaaaacaatttattccaagtaatgtaatgatttatatactcatatgcaactttctgtttataatgagcatcattgttagaagcagggaatacaaggaagggacttttaaggacataaatgacttttatattctaaatttatttaataggtgtacacagatttatcttatagaaaaaacatcatctgtactctaaattccaaaacagtagaagaaaataaattctatacatatatttgatgtctagcctgtggaatttttatgtgcctcgaatttgcttataattatgaatctttaccacccatttccatttgttacttaagtatatatacaatcaaatatcacttaatgcagatatatgttctgagaaatgagtcatgaaacaatttcttcgttttgagagtaccatagagcatacttacataaacctaaatggtatagactactgcacacctaggctatgtggtataacttattgctccagggtacaaacctgcacagcatgatactaagctgaatactgtaggcaaatgtaacactgtggtaagtatttgtgtatccaaatatgtctaaacatagaaaaggtacagtaaaaatatagtataaaagataaaaaatggtacacgtgaatagggcacttagtgaatacgaaggcctaggacattactatatactactgtagactttataaacactatactttatactacacacaattcataaaaaaacctttttatttcctcagtaataaattagccttagcttatggtaacatttgtaatttataaatctttttttttgttaacttttgactctttttaaaataatacttagcttaaaacacaaatacattgtacagctgaacaaaattaatatctttctttatatccttgtcctataagctttctgctatttcattattttttcccctctttaagctttttcgttacaaactaagacacaaacacaaaaatcactataggcctacacaggatcgggaccatcagtatcactgtctttcatctccatattctgttccactgaaaagtcattggggcagtaacacacatggagctgtcatctcctaggatatcaatgccttcttttgagatgcctcccaaggaacctacttggggctattttacagttaactctttaaaaaacaaaagtagagggagtacactgtaaaataatgattaaaaaatcatggtgtggtaaatacataaaccaataacccagtcattaatgatgattatcaagggttatgggctgcacatagttgcacgtgctatacttttagacgactggcagtgcaataggtttgtttacactagcattaccacaaacatgtgaataatgcattgcactacaatggtataatggctctgatatcactaggtgacaggaacttttcagctccattataatcatatgagaccatttgttgtgcatgcaccccattcttgactacaatgtcggtatgtagtgcatgactgtatatatgtatgtatatacatatataagatttcacttacatcaaattatactcatcaatttatatgtagttacatttgtttttaatacaggaaaagttatggtactaggtgaatggcagaaaaacccaaagtgaattatggtgatgacttgtaatgtttgggtaacaactttgctacaccaattctttaaagattggaccctccccaaaacaagtagcagataatatataggatgtaaatttcattgatgtgcttggaaaaccttgcaatgttcataaagaaatgatggaatttgatggcaagtggtttccaggggccaataccttcaatgatatgcctgatctgtatgttactaagtggactttggtttcgaaactgtacgttattaagtgtatagaactaataccaaggggtgttttatttagaaagcaaatgggactttataatagaatattgcctgctagagaaaaaaaattattttacactatgttcttctctataatggtatcagatactggtggagaattaggaaatatatggattttataatttgacagttattagtgtggctaaaaaatacattttattaaattaaaaatagcatttcacttctttctcagctgcaagaattcagggacacttactatttactgaatcacacacagtaaaaggaatcttttgggaaaagctgatgctggtttccagataagttacgataatgcttcccgctttatattgacaaccattttttttccttcaaaggatatcgagaatcaaaattatgtgaaggaaattttgataataacacaacaaagtgcatgtgccattgttttctgagtaaaaaatcaaaattacattattctacagttcaaatttaatcagttcaccgttattacaaaaattgatctgatagccacataccattgaaatgcaaattttgatgatgctctttttctgattaataattgcagaaatgtcattttaaatctacatccccaagagcttcacagaatgcctctttctagttaatctttttgagtagaagaaacagggagctctgagcaaaccagccatgctgtctctttcatgcacacggtaggggcaagggcactgtggtattgctgtgttgctgttaactcacagaggtgctgcctttcttctttaccactgcttgcctcccatggattcctctgcttccctctgggcctcctcactagccttcaggcaacgtttgggtgactcatgaagaaatggaaaatcttgcagctccagcaaaaacggttagtcttaatggctttgttgaacctgaaggaaagtgactttgctgctctttggatgaggaaactaatctgtttacaatagaccagagtaatagggtgtgtttttatagttacatgcaatgataactaacattttttacagttttcttttactgcactctcttgaaattttttaatgaaatagtgttagattgtggctaatatcataagagcttatagtacacaaacaataaggaagaaagtaataaatagtattcatgttgcaacattggaagtttttgtaacaaatatttagtattggacatattcacaggtaacatgtttctaaaccaaattaaattggtaatagaaaagattagattgaatattcatttttaatatgatcatgtggtttcttgtgctttaccatcttagatacaagcttgaccaaaaaaacccccaaaaaaccaaaaaagtgttatgttaatttggtactgaaaagcacaattttaaagaatttcttggggactctttgtcacttttaaaaataaaatgctataaaaatcattttttcatgtaaagtaacaaagttgggcatatcatatattttatctttatcaacttctttttaatttaatgtcttttcagtgttatccttatttgaaaattgattatctacaagtttgttaaggataaaaacaccaatgtcatgtactaatttcatttttagtttagttttgttgtacttggtttttgtcttgttttgttttgttggctgttgttgaaatcgatttgattatcacaaagctttgttggagggatacagttttttcacttcactaatttactttgtataagatttctctatcatatatacatatatatatttgtcatcagaagtttttattatagcacattacattttaaaaattacactcatttaagaattaaaaaaaggtttgtaatgaccaaatcaaatgttcacaaaattatgaatttaacatttaaattagaattaattgaaaatgatgtagttgctgcctaattgcctttgaactgcaaaattgatcactgtgggtctatgaatctgtgtgtttattctacctgttatacaaaatattttgtataacaattttgcttctgctagaaaaattttactgtattgatttgaaattaatttatatttacctgctttattaatcatttcctgctgctaacacagaaagaatctgaggaaggaagctgggcccaggtaggagattcatatgctttaagacccttaatatcatttagtaggcaatgagaatataaatcaagaaactgtcataagtcataatattgtaaaccttcacttagctcaatattaggctgatgtgtataggtaaatgtagattatgtttaatactttatatgtctttttaagttaccatatttttaaaataagatgattgacgtttcataccttacctcttttaaaagggtacttttctttctttctcaaaagaatgatccaaaacttaaattcctctgaaatcactcctgtatatatttaatcaggaagcattcaagttggatctaaagggggaacaaaaagaaagaaaagacttatttggagttgcacatgccttcagatataatgcaaagtgtatgaagagaggttggaggagcaagtgttggcgttgcagaccacagagtcactagcatttattgagatgtttgtatgagacaggtgtctatacttggaacagacatatacttttgcaaggaagctgtgcattttttctacatttccacattttggatgaccaaaagagaaaatttgtgttatattcaatctgattgaaacctttcaatataagaaaaaatttggtagttacattaggacctgtatttaaacacacagtaggattgtatttgattttgattttgataaaaatttcattgttcttgagaacacacaaaagaagaggagcagttagattttccctagaaatgcatattagaattgagaaattagggcatgataaggaactaaatgggaattctgtaaaaataatagagagtaatagttcttttaaaatattggtttagtggtaatggttgatttgggttttcattttagctgttttgaacagtattggtaagaatagtttgtttgttatattaaagaattaggttatctgtcttagtttttgatcctgtcctgcttcttttagagtctatcttgattaatttctagaaaagactgattctttccaatgattttttggaaagctgacgacctgctttgctaagtaacaacaatgtccataaaaagcttcaaaattctgtctctccaaaacatttattcctttctctgtttactgaggttcccatttcacatcaacatttgccattacaatatagcaatggtagtagtggcattgataagtgggaaatggcaataagtgcattgacaagagggaaatgacagatacaaataaaacaaacctatcaatttaaagacagaatcttaaagctcagagtttgtataataatttctttattaataaaatacatacttggacaaaatgtaattccttttgagaatacaaagtaaatagccaatcattttcaataggcagatgctttaataaatgtatgcagagttccattttataccaaatcgaatcaaatgctatctgaatattatttttgctttgtttccacatatcatagtaattaaatatcagttataataataggtaatattatccaattaccatcttatctgattggttaagaaacttgactgctataaaacaattctagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcggtaggtgttttttcttttttttccccaaagaataattaaaatgaaacaatatattacctatactttagtaaaacaaaaatggacgtctagaagacagaaaatatatgtcatttgaaacatcgtttgtatacatctacttggaaaaatgttttcatccagcaaattgcagggactttctaatttagagctatgtgcatattatgtgcccaaagtttatggaaatatatgtgtacaaaattctcctcatagagcatacatctatttttttgtgagattctttgaaaattccatgttggtaattttatagttatatgtgtttatattagaaaattaggaagaataaacaaattcatagtttcaactctacacaaatatgtggttataaattttataatttaggaacattctagggaaaattttgagaagaaattgttcttctaagacatatttgtgtttttttatttttctatgtctttttatgagtttgcttatttgtatattaatttcagaacaaaaacaatactgtgttagataactgtgaggatgcagttgaacaaaaggcaatgtctttttttcaagttgtttaccatccagcagataaaaaggggtctgttataataccatatcataaatgctatgtttatgttaggtgaagcaatgtcagctggattttggttgtttttttcacataaagttgattgtggtgataagttaataaatataaccatagatgattttggcttgggagactgtatttgcttctctcctgtccaacatttaatcagtggctggagtgaagatggtataaaaattagatatgttgatgacataaaattaggataaatagaggataattggggcttttgcttccaacttatggtgatattttgaattttaatgcagttgttgacactgttgaattaaatgtggtaaagataaatataacagtgttttttaaaaaacccattaaagtgctggatggagaatccataatttaacagaaagttgtgtgaaaaagataaggaatttatccttagcacgaaactctccattttggttaatggcttgacaaggcatgtttagactgtgtttattggctgagacaacaaaagtgctaccatacagtgacataacaaaaagaaattgcatttatttgtgggtatcaaattgttataaggtggtagaagtccagtggtaaagttgaagtaattaaatacatttaaattggatgaaggaagactttaaataagtaagttttcttaggttttaagttcattattatgtgatagaagaattattttttctctgttgagcacctcattttttagttaacacagatgtagatcctaggtgagtgacttctagttaatagaagaaacaactttgtaccactctcagctgccttgtagtgtatacattgtgaggtagtgagtgagctccctgtcacgggaagtttagggcttcatatttcacgtttgcattagatttttggggtccggtttttccgttcttcactagattgacttttaatactgttttattactttagtaaaatgttttctataatgatcaaattaaaaaaaatactcaaatgacttggtttttgtttgttctgggaaatgcccaagcttcatttttaagttatgctaatctccaacttaaagcaagtagtacctgactgtatattgcatcctatggtcttttcggcacagttttccatctgacagacattttcataatattatatgtcctctgtatagtataattttgtattctatatcaaaacttggcagaaactgaccaagaagcattggtttaatctcaagctgcccaatatctgtgatagtgattatatcagtattatctagtatatcactgaattagtttgctagggatgccacagcaaaagaccacagatgggtgtcataaacaacagaattcattttctcacagttccggaggctagaagttcaagatcaaggaatcagcaggtctggtttcttctgaggcctctctcctgggcttgctgatggtcacctcttggtgtcctcaaataatcctttctctgtgaatatatattcctgttgtcaccaagtgtccaaatctctttttaataaggtcaccagtcagtttggattagggcccaccttaatggcctcatttaactcaattacctctttaagggcactatctccaaatgcaatcacattctgaagtactgagaattagcgcttccacacgtaaattttagggaacacaattcaacccacaacacctgcctaatgcaattttctttccatttttctctgattctgaaatatttgactcaacattgtttttattaaaatgcggggcttagaaatgcatctagcaagtaagtgtaatctggccaatgtgtatgtctaaatttgcttatattcctaaacatgtaaagtatcactgataatcaatgatctttactcttgaagtctacagattattttttcctatcacatcttctgcatctttatacataatgtcactaaaccttctcattttctctctcagaacatgcctggtttatcgattttcctttcaagctcatggctgttgtccctattttggcagaactgaaccctgaattgatttctctatcttctctgattacttatttctccatctcctattttgctatgagattacttttccttaaacagaaaactttttttttttttttttggagatggagtctcactctgttgcccagggtggagtgcggtggcacgatctgggctacttcaacctccgcctcccgggctcaagcgattcttctgcctcagcctcccaagtagctgggactacaggcatgtgccaccacagccagctaatttttgtacttttagtagagacggggtttcaccatattgaccaagctggtctcgaactcctgaccacgtgatccacccacctcagcctcccaaagtgctgtgattacaggcgtgagccaccatgcctggccaaacagaaaactttattgtcacctcttcctcctccgaaaattgtccaataattctgtatcaattatatgtatttcatacttaaacacaatttaaggctttccttaatatgcccttttctccatgtataattgtattcctccttacttcctagcatgggttttcagccctggaatgtgtgtctcgctaaccacacctttaaatttccatctgcaatcttttgttcatgatgctccattttcctgagtcaacctgtctctgctacttgatactttaaggatcaatcaattttctgctcattccacatatccttttcattcagtttcaatatctgctgactggttcttcttacatacttctgtatcatttagagttatgagctactcattttagtatttggtcttctattacctcacttacttatgttttgtgttatttttctcatcagcttaagaagagagtatccatttcttataaattccttactgtctccataatggggactttaaattcttttcaagtgaataaaatattaatttgcctgcacctaatgtaggaatagctaaatgaaagacaaagacacatagatgaacaatataatccatgatgattttaaaactgttttttcttattttgaaaactttttttctattacttcgaaacattttgtgcttagaataattataaatgtatttccctccaatactgaaggatttggctgcaaatgtaatttattaacttgttgccctaagaagcagtgcatagtgttgactatggctaatcacaaaactttctccacctgctaaggtagactcactgtgtttttttttttttaataaaaaaaaaagaacaagtttacaatatggaattatgtgcttaaagaggttgaattatgacagaaaagaactagaaagaagacgggaagcaagccaacatgaaataaaaggtaatatatctttctttcatatgaaatgcctttattctggggtttttagctttcacttttactaacctaaaatgttatatgtgttacaatggtcagtaagtagcataagtatttggctagaattgttactgttttttttccattcttttctaattaaaatacagaaacaggtatctccatattatagggtgaatatcccatttggggagtaatcttgagtttttgaattgagatttatttatgtgaacctattaattatacattctgcttatactaaagatgtctccatgtagatatttttgtcagacttttaatggaacattctcagtatgattcagagaaacatggtatatcatttttatggcagttcatctttggtttatatcattttaattttattccagtgccccagcaattttatttttgtaacactgtatagttaaagaaattatatggtgattttatgcaggaatgatataaggattttcccctataaaccaaactagttcattaataattttagctggtaatattatcaggaacagtgtaaattgctgcagctgttatgtgcagaaaaatgttttatttgaataacaagaaaagacactccatattgcaggtttgttagaaaaaatactatatttaaaaataaatcatctaaatgttgagaagtaccttaatatacccgacaaaggataatttcaaaagagaagtaccttaatatgcccaagaaagaataatttcaaaagagaagtaccttaatatacccgagaaagaataatttcaaagaggaatatgttagattctattcttagagaccgttctatttttattattgttgttgttgaaggaaaaaaatacatgattggaaaaagatataggtaaaggtatttttttgttttaaatttaaagggttcaagtgcggttttcttacatggatatatttgtggtggtgaagtctgggttttagtgtacccatcccctgaatgatgtacattgtacccattaagtaatttctcatctttcgccaccctcccagcctcccacccttctgagactccaatgactatcactgcatactctgtgttcacctggacacattatttattgcccacttgtaagtgaaagcatgaggtatttgactttgtttctgaattgtttcacttaagataatacgtgggcttttttttgctaaaaataatcaatccacttttgttgtttaaagaagaaaaaggccaggtgctgtggctcacgcctgtaatcgcagcactttgggaggccgaggcgggcggatcacgaggtcaggagatcaagaccatcctggctaacatggtgaaaccctgtttctactaaaaatacaaaaaattagccgggcgtggtggcaggcgcctgtagtcccagctactcgggaggctgaggcaggagaatggcgtgaaccctggaggcagagcttgcagtgagccgagattgccccactgcactgcactccagcctgggtgacagagcaagactccgtctcaagaaaaaaaaaaaaaaagaagaaaatattaaggaaaatataaccaaagcttttaaggaaaattttggatattaaaatacttattagttgtatttacatttcctattatccaagagttgatatgtgcaagcattacatcaaatgtaatgggtgtttctacattacattaatggttcaagggtaggcatgaatctctgttttcatcttcacttcttttaaggcttaatttagataagaaagtagtatatattacattctccaatattaacgtttagtgctgttttattcttaagattttttttaggtttctataatttacatttttgataaacaatgtcagaaattacttttatctttgtcaggtcttggaaagtacattagttctaatggaacgggcttgaatgcatgtgaaagtgattggttaaaaatagttttctacgtacgtctcatcggagagtagacagactcacaatggatttcttgtaacacttcatttgatgcattacttcgaagcacgaaagtgcttttccattatcaaaattgagttgtttgacttcactttatttgggggccccaggaaactgcaggttgttttcagtgcattgctgttcagttgaattgaaatttgggaattaatggaccaaagatggaccccagaaggaagtttgcatttgaccacacaatgaatgtcttagcacacaggtagattttacccatgggataccactttgtagtttcctttctgaagtatttttatccaattagattttattatgcctcagctcaccacgtgaaatgtttcacatatagatagatctaaaggagaggaattacccagttggccctatacccaatgttatattagtatctggcaattgctgattagagtgtagctctgaggaaaaaaaaactgccatgattcattatgatcacacacaactctatctgataaatagctgtgaatgagatcataaatagcttgtttcctatgactgatctggtgacatttacaggaataattctcaacagtgactaggggtctcttattatctgaagtgtgaattaaccctgaccttaatgaatagttttctgaagtgaagagaccatgtgaatatcaagaacctactaacatttaatttgttgctaagaagcagtcaacactgatttctagccatttattgtttaggtcaagaagatttctacacagttttaaagtcagtgcatacattgcttggaaacagatttatggaaagagatctaactttaaaaatgaaaaaaaaaagaagtattttgttctgaggaggaaacgtttgaattaatgctttatttgtctttacctcataaacagatcagtttaaatatttgatcactcttaactacaggtgtgacgatggaatttttgatgggcacatatttgcagaaatatcacgaccacataatatgtcttagactatcaaaatataaacctaagtctagaaaaaaaccaaatactccctatttacaaatccaactagtgcaaagaaaactggatttattttttattattgagagcattgtcacgttcatttttaaaaaacggtgtgtttaataaaattaagtggagaactgttgctgccacccacaagcacttgcctagcttttgggattcaagtgtagggtaaccagttgttagaatgaatcagtaactatcagcagcagctgattatatagccaaaatgtgatgctaaccaactcacatcccattttctgaggtctgaaaacctcaatggaataggctaaggaaaactcggaggaaaagctacacttcagaactgactcagagagacaattaacatgtataatataaaatttccttatatagtaaagaatattaaggaaatcctttgctttgctgcagaccggtttgggggggggcggggagaaagaggcaaaactctgaggggaggacaataaatgtccttcttcgggcagaaattcattctgctttgaatggagcagctaataataataagactgtgggatgtgggcattcctctcatattccttattatctaaatccaaagaaagatctaggacctttcttttgaaatgagatcattctatccacaaaaggagttaagtagagagatgtgaggctgatacatgttcagcttccagattcatatacaaatgttttgctagtactgtggattggcacagacagaaaggacaccaactaatttgaagaacttctacttctgatagattggagcatattaagtcagaccaatcttccactaagaagaaatagaaaggatagataaatcaataaatggtaataaagagctatttgaaaacagtagaaaccaattaagagggacaagacttgagaggttatgatcttggaaaaaagaaaaatgtaaggaaatagtaaaactgtcattctcttctgtttttcctctatctaacagagaagcagggaacggagtggggtggtggtggggattggaatttagaggtgccaaaactgccgggccttcaggagcaaagaatgtgtaaaacatagtaataataaaataagtaagactgaccatttatacaatactcctctagagacatttgtggacttccaagaaggatggaattataatctaaaaattgaacagaaagctgaagccaaagggtaataaatctagaaagagaactgttgtaatctcatgataatacagtaaaaaaaatcaaaggtcataaccaccaaatatgctttaatttgaggtctctgataaaacacaccgtaggactagggtaaacttaaacagatcaggctatttattatgtctattaatgttaaaaataaattttattatgtatatttgaggtttagaacatattacagaacacatataggtagtaaaatggttactatagtgaaggagattcctaagctttattttgaaatgttaaaattgaaatctagcattgatttatctcaatctttaattggaattaagttgatctgcccttattataacttcagaaaaacataaaagtccttttaagaagaagttgacattcagagcctctgcaatttttcaatcatattatgtgagagccaataaaagaaaaattcagacatgtcagataatggccaaaatgaggaaaaccacgatgataaaatcagaaaaaagaaacatatccatagttgaccctgacagtgtttattaaaaaatatgtaaggaatataagtgagaaaatggagaatttaatatagttggaatcaatatgtttaacaaataatcaaatggaaatttgaagaagtgaaaactataaagacttaaattgagaacacaataggtggtttaacagtagaagagagtttagtgaaataaaagatcacttgaaaacatctagcccacatatgacaagaaacaaaaaggacgaatgatataaaacatcactagagacatattggacatggtgaggtaagagacaataagaaagaagcaatatttgaaaagatactggtggagacataaaaagaaaataattgaaatgataaaccacagactcaaggttctcgatggaccccaagtgagattaaaaataaaagcggaaataaaaacacatctaaacacattacaatagagctactgaaaaccatgatttcccacaccccaaaatcttagaatctgccagagtaaactccacaataatttcaatggcgcaacataatataactgatattgctcaactaaataatgctagaggaaaatggaattattaccttaaaatgctgaatcaaactaacttactttgaagtatgtccatcaatagtaaagagagaattaataaactttcagacaaacaaaatctgagagactatttcaccagaaaaaaaacaaatagaaaagaaatattagaataagtgattcaggcagatggaaatgatcataaagataataaaaaaatgcacacatgatggaggagaactgaaaaatgtatgggtaaatgtcataataatagtaaaaataatatctgcaggacttaaattttacatagaattaaaatacataactataatgcaaaaggaagggaataagtgaaattaaattatttgaaagtctttgcattatctagaaaataataaaaggaataatttatagtagactctaataagaacacatattataagctttaagtgtcactactaaaataataatataaagtgtaaatataaaaagctaatagagggccgggcatggtggctcatgcctataatctcagcactttggcagaccaaggcaggtggatcacctgaggtcaggagatgagaccagcctgactaacatggaaaaccccatctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctaatggagtggtagaataaaataagaaaacaataaatggcaagaaagagagaaaaagaacaaagaacagataggacaaatagatggtagaattcagcacaaatatcaaagtaataatattaaatgggcaagaactaactacttcaatttaaggacagattaaaaaacaatgatatgctgtatacaatggacacactttcaatataagaacatagaaaacttattagtaaatgaggtatacatgcaaatattaaccaaagctactgtgattcttctaatatcagaatataaactttaaggcaggaaacatactagaaataagttggctattttcaaataatagaaggaaagatatagcaaattagtatacatctaatatgtagatttaaaatatggaaagtaaaaactgacaaaccttaaaagtagcagacgttttcagttcataatgggtgttactgattaaaactacaatgagacaccccatgtattagtttgtcggggctgctgtatcaaagtaccacagattgtgtgtcttaaacaacagaaatgtgttgtctcacacttttacacactagaagttccagaccaaggtgttagcagagtcagttgctactgaaaagaatctgctattcgcttcgccccctgacttctggtgatttgctggcaatttttgatgttctttggcgggtaggaacatcgccacgatccctgccttcatagtcacataatgctctccatgtgtgcatgtctatttccaaattttgccattcaagaatgataacagtctcattgaatttgggcccactctattgactcattttaattgatcatttctataaagacctgatatccaagtaaggttacattcttaggtactggaagttagggcttctacaagaattttggggaacacaattcaacccataataccacacctaccataatgactaaaaaaagcaagacaaaacaagaacaaaaatgagaaatacaaagcattggtaaagatgaagatgttcagacattaataatgcaaggttaaattgtgagagtggaatttgcttagcaatatctgctaacaagtaaacacataacaattctattccttgttatttattctactgcaacatgtaaatatacaaaacaaaatccatgtataacaatattcaaagcagcactatttattgtttttttatttcaataggtttttggggaacaggtggtgttaggttacatgaacaagttctttagtggtgatttttctgacattttggtccactcatcaaccaagcagtgtaccctgtacccgatgtgttgttttttatcccttgccatcccccaccctttccccctcaaaggaacactattcttaataacccaaagtggaatctactcacatgtccatctacagtagaatggacacattgcagcataatcatgcaatgggatgctagatagcaatgatcatgaacacgccactgctatttgctaaagcgtagataaattccatattgaatgaaaggcagacaaaaaagtacatattgggtgattttatgtatgaaaagctaaaaaaaataaatcgggcaaggcgattctgtaatgaaagaagtcagaatattggttactgttaggtgagaatggtgcctgagaagttgcatgaggggacctctgtgggtctgtgctatcactgtattgcttcaaagttatacacaagaacatctaagttggttataaatggataaaataagataaataaggattttcaaagactcatcaaaataattatttagaacatgcttttcaaaggcttattgaaacaggtatttaaaacagttaaagttgaagaatatttcctgaaagatttttatactttgtctgaaagagctaggcacttcattagaaagaaaaaaaatggacaggaaaacttacttttactttaatagtaattatagtttcctttccctttctatgggtagtaaaaatgttttaatttttttctcatatccccttaagtttcttaaaattctttcttttctatggacaattttagtccttcggactattttactcattttatatagcattctgtcaacttttaatgggaagatattgaagaaaataaatgataaaacataatttgatgtttttatctaaaaaaaaagaaacggcatttttctctgaaagttttatttttagaaaataaaaatcaaagaaattttttcctcaatagaatactactttcaatagagtggaaacaatttttgacatttgactgagtgcttgaattttgcattagcatgtgattgggaaaaatgcattgaaatataatactaaggtaagtatccatctgttgatgccttatattattttaccgttctgttcttatatattacttcaggtgaaaaaaaatcttctagtctatatgccaatgtttaggtagtggttaacaaacacttctgatgaaagacagtattacaatctcgtctgctgtttactgaagaggtgtgtatcaagacacaaataagaaatgtctccctctgatggtaaaaatattgaacttcagacagacacctagttctctagtatgaaaacaagaaacacagacatcgtgttctacgcgactgaagtgctgtcattttagctataacaaacactctgaaaaataacaacttttttaaatagagactcgaaaagattaattattaaaacagtaactacacacaaatgaagggagccagatggattagagtgtggatgaatcagcataaatgtgacctggccagatacccatggctcatttcagccagtggttctactatgaaaaataatgcgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaaagaaaaataatgcatcctaaaatgatgcatctcttttcctagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaagtcactttctgctgtagtctcaatgtgttctggtttatataatgataaactaaacttttagaaaaaaattggctgtgtattcatgattgttaatgaaagttaactcaatgtttgaaatatgtcactggggttttaatttcaggctagtggatttctagccaaaaaaaaaaaaaaaaaatcatacaattaaacaagaaagggatttcgaagttatgtggcccagtctcccacctgaatgccagattccactaaatgaaatccctgacagatggccatcagtctctgcctctctgagaggcagtcatttctatttacatgtatgaattatacagactcttagcattggatatgtcagtgattcccaaaactggataataatttgaatcagtatagttccttatgaataaaaaataaaacctccaacccacatcatagtcctaagacatcagttgtcaagagatagggcataggaatctttattatcaaaactttcctcaaatgataatcattggccaggtttgagaactacctacatagattcaataaaaatttggcagtctcgtttcactttttattttgtttttacatatttcagagattaaacaaaatactcaattgaaatatagtaacgaagtgaggccaaagcttcttgacctcagatgtttatgcaagactgtctctctactgttcacagaaaaaaaaaaaaaagccctgtttttttttgtagttaaaatttacaatggctaataacagacatggagggctaaaaacttcaaaacccataaataaagtatggtttataatacattatcagataaatataagctacttgatttttaaaataaaatgtgatttcggtgatggtaactgtaatttgacgtcaacaggcaaggcagattcttgaaagagaatacaataacctcttggccctgggaactgaaaggcgactggatgaagtaagtccacctgttattcaaaagagatctgagagagtaaaagaaaaatgatagaacatctttgtttttaaggaatagtgcttggaaattaatcaaatgactgttctatggttagaatcaataattttctccaggtttgttgttaaatattcaatcttattacttaattttggaaagagctatattaattcataaatattatcatttcagcaggtagagatactaaacagtaatttacaaaacatttttatgagtcgtgactgcaaaatgttgggcaacattattttaaaaaattagaaaaaagttaaaacactaatgttgataaattcagctttttaataaagagtgcgtgtatttcttaaatatcagtatatcttgccaggaaattttagaaaattaaaatgaggataaaacttgcttcaataaatggaaagctttttattattttatatattgatactgagttttccttcaaaacagattaataacattttaacagtcacagaatttgaaagctatattgaatataagaatcgctatataatatgtgcatattaagttatttggaaaataataaacatgtaagtagcctcccgagatgaatgaatacaagggatatcagcaaatgctgtggactgtagacattttaatagtctttctgagtttttctacagggtctttctggaagaagtgggaaggaaacctgagcatgaaatagaaaataaagagatgcataattctgtgttgcaaagtacaggtgttccttactacaaagacaagctgattaaaattattttgtgaagacctcagcaaattcaaatatggaccaatcattctatattcaaataggcaggacagataatcttggtattataaaatccactctgtcctttatggtggggattatagagagataagttctacagtcttgaactcagctaacttctgataaattcatgctcttattcaatcagcataatgattaatatttttaaaagcctcgtcttataagttgcatgacagtcttttaaatccttactagaaattattgattcaaaaaggtagtcttataaactcatacatcttaaaatacaattattcttacttaaaagttgcaaaaatttctaataaaaaattattgaagagttgtcatattgctacattctcttaggagctgtccaggtgtggggtagcttcttaatagtaatgaactagaagaaaagtctattgagccaattaaacgagatgcgactcgttgtctttaaactatgctgctgctttttcttatttttaaaagcacaaaatagaattttgtcatttaaaccctctagtctcttttgttcaattttattttattttttagtgtgagcaaaaatagccaacttacttagaacagtagtggacttatttctgaggttttgctgatcacattcagattccactgaaataatctgagaggtgtcaacaagcttatacagactttgaccccaattaaaagaattaaccctatctcatgaaaagttttccccatgatgttgttgtttatagttctatcaactttctgcagtaacaatatgttgaaagaacagaagtcaggaatcataattcaaacgcttaactctaaaaactggcaattttttttttttttttttttttttttgacagagtttcgctcttgttgcccaggctggagtgcaatggtgtgatctcggctcaccacaacctccgtctcctgggttccagcgattctcccacctgagcctcccaagtagctgggattacaggcatgtgccaccacacccatctaattttgtattttttagtagagacagggtttctccatgttggtcaggctggtctggaactcctgacctcaggtgatccgcccacctcagcctcccaaaatgctgggattacaggcgtgagccaccacgcccagccaaaactggcttatttttaagcccctagctacgacactgtaaggagttgtgtagctctacagtgtaacatagtgttttataaaactgaagactatttatgcttaatgcaaaaacttctccaagaatcaagaagtcgtagaggctgcaactgtgaaattctgtttcttttctacatttacacacatttggagatctagggcaatgaaaaacacagcagttgggaacagtagcggacatctcttaatgtgcaaaatggctaccacactgaaacaaaatgtagattttaatgatgataaggattgaaacagtggatatatgttattatataaaaatgattttatttttccctgattgactttaaatgtcccttaattaatatagcagtctacaaagcctaccttatagaattattcactataacatagcacaaattactatgttgagtgaatatagacttattattccaaatgccagaatgaaatcaaatgagatattaggatacacaacatatacttggctatacctatctatggcatagatagtccttccctagataagaaacagtgagatgagaagacaagacctatgtggaatgattcatattttccttggaattagacacagaatattcattgactgctgaattatatattgctacttgccaatttggaggaaaataattatgtctgtaaaagtactttatgtatacaaagagaaggaagagattattttattaaggcataacaaaatcagcaaccagaattaaaatgtaattgctatgctacattctaaaatgtggattcaccctaggatctgtccaagtagagacactagcctatgtggggtatgatgttgcttcctgatagtaatgaactagagaaaaagtctactgggccaattaaatgggatgtgactctctgcctctgtgtatattaaaatacacattattaaaatgtaaccagggtaatattatgctttcggtggtacccaaagaccacatgtacttattgaaaggatggtgtccaggctacacagatttttcaacaaattgcaagttaattctgtgtcacctaaaacttcacaaatcacatatttagagtttcttgtacagatattataataggctacagtgtctcatattagccatgccatctcaaatatagatttccccaaaataaatacctacattgtatttgtgtacatagaagtcatttcattcaagtgtgtgagttaaatgtagtctactcaacaactgattcaattaagtatatcatctctttccataaaacccgtcggcataaagtggaacaatgtatatacaatatttattttggaaaacattggttgcttattttaggctttcaaggatatttactgtatagatgtcagaccttaaatttgaaattgtatgaaaagttttatttaaaaatttatatatcaaatctcctatagtcttgttttggaatcatagaactaactatcttgataaagcgtgattccatacgtatacttgacagactaaatgtaaataatctatgttacatgtttctaagcacagagctttaagcacatggactagtttacttgttttcataacatcaccttataactgtactggcagagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatggtacagtagttttgcattgctgcttatcaagcaaaaagcttgtttagccaaagctagtataattctctgaccttgctttttggaattattttcttgagttggtttgctctgcttgaaatttactttgctctcatcacaaaccagactcctttttacactgctattgcatgaactcatggcactttattcacattttcaaaataatttataacatcccaaaaagaacaatttggttaatgtccacctctaggaggaacaataaacatcggcaggatttgtgtttctttagtcttctattcccaaaattaacaatttgtttaagttagaggttggacttggactaaagatccatagtaaatggaaattaactccactgtctccctacatgtttaaatactgcgagttttatatgtcatcttagaaattcactcatcaaatatttttccctctagccaaagcagaagcccttaaataaacaagccatgaacatgagaagagaattaaagaaacacaaaacacagtaatttcccaattactatttccttctgtggacattagacttaagctatctaatttacaaaagaaaagtcattccagaggagagacaactttgaaatagtagtcacaaaattatttctgtttgggaggcattaaagaaaaatagtcccatgctatttgttaagataatcacctagcatcattatttcttgtcaaggtcacagttattataactcaaatttagttccaacataaactgtgatcttgatctacatttcttacaacttgttaatacggtggaacatgtcagcgaaattcatgaggaatttaacatcattacaattagtgtagaagttcttcaatacttggaaaggaaaaaaaatccactataatgagttctctaagagcaatctccatatcaaaatcagaagcaccctcgggagctgctcttgttaccgattttatctaaggaagaatacataacaactcaaaagctcaggtcatttacattgggataaattttcattaggaacttgatctagagaagaggaatgtgagtggcttatatctgagagaaagaaggtctactaatatgttcggaatccctgtatgcagggaaaataaatctttctcatctgaaatcttgtactgaatcatccaagtccctctaaagcccttttctccatttgcagttgcttcatcaagactgcagaggttagacaactccactgttcgcacatactcatgttgaccagccactcaaaggaggcagcactgacctgctgtgagtagtttccctttggctgacaaaaaaaaaaagacaaaaaaatggaacctacatagactaataaatatacactatactctttggtatgccctagcagtacagaaatgagataacccttttgaattgcttcaggggaaaaagaaatcttcatattgtaacacttagtctagcatttcctatcaccatctgtctcctgtggtttaaggtctgcctgttggaggcctatcactgtattattacacatcaatgggttgccactacactgttttctactttttagtaccatttcctgttgagtaacttagcattttattgataataattcagcactttaaaaaatcctatctttttaagtgtatattttatataaggaagccaaggtagcggatagggatttaagcaagttcaccgagtcaaatagcaacagacaggaaaatgatttagagatggtttcatattaaaaaatagaaacttgccgaggcaggtggatcacttcaggtcaggagttagagaccagcctggccaacatggtgaaacctcatctctactaaaaacacaaaaagtagccaggcatggtgttgcactcccataatcccatctacttgggaggctgaggcaagagagtcacttgaacctgggaggcagaagttgcagtgagcgatggtgccactgcactcaagcttgggtgacagagcatgactccgtcttaaaataaatcaataaataaatagtagaaactgtgaaaaattcaaacctttattacattgtttcttatcaatctgatttacacttgctaaaaacaaatataaattttaagtatttaagacatataggaacaaaataaaattactttaagaatggagaataggaccagcacaaaaccttcctatgtaaccataaataccaagcatttgattttaaggaaataccaattaaagctactttaaaatccatataaaaatgaggttttattgaaaaacagtcttaatagtaaaactgtggtttcttagatttataaatgtcaaatgttcataattttttttcaacctaaaactatgctttaccaaaatatttaaccactttcgatgaatcaatattttagaaaaatactttttaagagcgatatttagaacaaaatgtgtgcacagggttaagagaaaacagttatagacagaggaacaactcaccttgtgctgttttcattgccttgaactaaaagtgccacacaatttattgttggtcttttgggcttaagatgggagcagatatgctgccttatttggatcactatttgaagctgataaaatgaaaagcatcccgataagagatttaatttcagaatgtacaacccttacattaaaattttaattatggtatataatttggcacctaattagacatgatttaaagtatataataatttggctaaataagaggtctcccaaaatactgtttatattagattctacacatagcattataatttcttcaggaaatgaacacttcactaatttacaaatgactatttaatatgttcaatagtgcttgcttcttagctcttaagtgatgggtagagttactctatttgcaatctgttttttgtgcatgacattctagttcatatttcctagtttttaccattaattgggataacagtattcatttacaataattcaatctaggacaaccattttttgtttgggtgaaacaacaacacttttgatattaaaataatccagagcatactacttgctgtttcttttgtgtcagtaatagcaattgtgagctttttctaagtacattatggctgaaaacaatcagcaatgccatactactgacacaaacgtttacaataggtgacttattatcgttatgtttttgtaacaaataaaggtattttttaagaactctaaaatatatgaactagaatataaatctacattatgaaataggtcaattcaacccaatttattaattagcaagttgtaaatttttcagaaggcatgctaacattttgcataactacctttgtttacattactgccatactttccacaaagttgagcaaattctattatttgttaagctcccctgcaccaaattggagaaaagcaaatgttaattacatacggctgttggctacatcctagatgatttccttctcatgatcttctaggacaggagtaagcaggctgcgtggaggtacaccacagaggagtagaatgagatttcccagtctgggacttttcagtgaactaatgctatccattgtatattttagatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctgggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattccagttctctgtttaagctttgttttctagtcacataaggctcgacaatttacttaaactatcaggaaatgtgttctttgggtgacccaaatatttagcttcaaaattgagtctgccacaagagggagatctaaacttgcttatgggagtgatcttaaaatttttttctaaaaatgtggcctgagtaggaacaatgagaagtagctttctaagctcatctaaacatgggcatcttgattcatagaaatgaaatagaatataggaactacgacattataatgccataactagatttgtatctactattatataacactcaatcactaaaatcaatttctttcttttaaagatcaagttagaaagattaatcatctataatagacactaacatatagtgatgcaaaagatccaggtatttccctcaaaaaagaagcataaaatatgttttaatttataagaaagataacttctactagattctaaaatccatttaatggattaagctcagagtctcaacacgttacttttgatcatcaacattataaattttcacatttttaatgttcaggacctttcaaatacaattttatataaacaaaactggtttttaaatgtaggataggtctcatttaaatatgtttaatatattttcacaagcaaagtaattcaatgaattggaaaatactataact

SEQ ID NO: 13878 - DNA, 14745 bp, Human
agcgcaggcatataactccacttgttatcacagctatgtagccataacatgggaaggccatcccttggctctaagccactattgtctgtaaaaggtataattgccctgttgacatcgtgcaggcgtgctgacacccagagagagagagagagagccagagttgaccctcttggagactgacagtggggagccaggacacagctcggcttgctcatgcccagagagaggaagagttaagctgctgaccccgaaggcaagggagagtcggccatgcagctgtgtgggggagccgccagactaagcacctgagacagggcagacagtgtagagagctagtgtaagaaagctgttgatgagagctgctgctgagtaaaatcatcttttacctgcctacggtcccctgagtgttctttctgctcatccacccactccccttggacctcagcatgggctagaacctgaccccaagcatgacatttggctcagtcgtgaacctgacattgtggtagcctccacgtagtctctgcttcttgcccttgcccctgccatctactctccacttagcagccagagtgatcctttcaaaatgaaatcaaactgcttccttgcttcatttcaaaatgctcccaccaccctcactgctccaccctggtctgaaccacaacctcctggggcctggatatagcaatacctccctaaatggttttccctcttccatcttctttccccttagcacagaagtgaaagtgcttcttttcaaatcacaaatcagatcatgtcactctgctcagaaccttccagtggcttcccgtctgactcagcacacccatatgactcaacacacaaggagatcatctccttccagttacactgagcatttttattggttgctgactgtactcataatgctctctccttatatccacacggttcactccctcacttcctttaagcataaatcaaatcccttatcttggtattgacaagacaaggacagactcctccaaagtgagcagggaggtcatgaccaccctagcttaaattttaccaatccatacagcctcatcctacttccctgttttattttttcctcttagcatttatcatcttctaataaattaaataacttagatatagccaggcgtgggggatcatgcctgtaatcccagcactttgggaggttgaggtgggcagatcacctgaggtcaggagttcgaaaccaacctggccaatgtggtgaaaccttgtctctactaaaagtacaaaaattagctgggcgtggtggtgtgtgcctgtagtcccagctactcaggaggctgaagcaggagaatcgctcgaacccgggaggcagaagttgcagtaagctgagatggtgccattgcactccagcctgggaaacagagtgagactccgtctcaaaaaaataaattaattaattatttttttaaaataacttagatatagccgggtgtggtggcatgcgcctgtaatcccagctactggggaggctgaggcaggagaatcacttgaacctgggaggaggaggttgcagtgagcagagatcgtgccactgcactccagcctgcgtgacagagcgagattctgtctccaaataaataaataaataaacttagataaaatttttcaagtgcctacctcgtctgccccaaacacaaataaactagaatataaattccatgaggaaagagatttttattggttttgttcacagctgttttcctagcacctagaacagtgtctggcacatagtggacattcaaaacacatttgttaaatgaaaggattcatcctaaagttaaggatggttaagtaaatcggatggaagatgatgaaaaattaagcaattagaaaaaaactgtccttgtgtaatgtgtcaacatggaaacaggacataatgtaaacatcagaatcccttgctgtgattctggtttttgtggctctggttacattgtttttttgtgtgttttttttttttttttgctttcccgtttcttaaacattggcgttcccaagtttctccttggtcctcctgtcatttttatctactctcgtagcttcaaataccatctagtttatagtttatttagcatgttgtccaagccaccgtcttgggcccagggctctacctgtagcttttcatccacacttctcaggttgcttcttacacagcgccatagtagttaaaatacggtctggggatagtcgtctcttcatcagtctccccctataaaatggaggactcatagtataagttgcctagaacatattagtaaggactcaataaatgtttgagtaggatgagctgggtggctcatgcctgtagtccctgcactttgggaagccgaggcgggtggatggcttgagcccaggagtttgagaccagcctgggcaacatggcgaaactccatctctataaaaaatacaaaaaaactagctggactcccagctgcttggtggctgaggtggaaggatcgcctgagccctggaggtggaagctgcagtgagccgagaatcgcaccactgcactccagcctgggcgacagagtgagatcctgtctcaataaataaataaataatcagttgagtgcatactgtgtgcccaactacctttaagaactttacatatgatcccggcagccctaaaaggtaagcatatctatctccattacacagattaactaatgaggaaaagctatgtttataatgaacagtgaccaaaaagtatgcaaacgttaaatgaggtgttaaagtggtgggattgtaggtggtttctttttttctttcaaaaatttgtttagtattgtagttaggctgtttgtgtgtatgcatgtgtatgtgtgtatgagtgcgtttgtgtgtgaccaaaacagtaactggcaaacgtaacaacaggaaattgtagggcagggtctgggaaaaggggaggaacccaaggtactgacaagcccagaccggactcccccgaagtgagcaggcagcaaaggctgagagtgccagctgcctgggcactgacggaccccacccacggaaacgatgccttatgaggaagctaacccgggccacttaccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgtgagtaacgcagctgtgcccagggcgggcgggggcgggctgcagcccagcgggagaggaaagcggaagcctggagtccgaggacaaggaggatcctccaggtcggaggagcggaaagtcctagcacaggaggactgtggcgagccctgcatccgagggaccttggtggcagtgatcctccagtgatctgtcaatccaggttttacatcgctaaacgcagagcttgggctttgttgccaagtggtgttttgattcttgcccactcctcacccatctcctcatgctttccccccaactgggttcttggagatgcttcgttagggactggcggctcagattcatccttaagtcaggctgcctaggctgctcactcagcctagagcgaaggctgtaccaggtgaaggatcccaagcagtggaccaaaaatgtgaagctcttttgcataagggggcttgaggaagctcaacagctgaaagcacaacctggaattcccctagtaagcagacgcccacatatttaaattggggttgggggagtgaatacacgtagctgagaattaatgtacaggtaaacgtcgaaaatattcagtagctaaattatgctcttctcggatggtgcagaaccacataaaccttcatatttattcgtaacgaatggctttgttgagatatgacattctttttcctttgcgtttacttgttttgtcagatgagacctatatgagtatcactaaaatactttatctgaagtcaaatgaaaaacagaaactcaacatgaaacgtgttcttattgaacactgcagtacttttacaaagtcattttgatgaactggacaggatggcaactttttaaatgttcatccacttcaaatcccttcctcttccctgtaaggtttattacactgtactcacaattggtgtgactcaccagcagaaggaaactggatatgactgggagttgtgcttagtttcctcattcaacagagatttatggagcacttgctatatggaaagcactggccttgggtctggaaggatacaaaaaaatgaagatcagtttcctgctttacattctagttgagataagaatggaacataaataactactgtagaataaatgttgtcttattcatggtgagtgccagtaaaaccttgaacttccaagagctaggcctcctatgttccagatgctgtgtcacacagtttacaatgttcccacttaaccttcgcaacaacctctaaagaagataattgccattcccattttacagctaataaaacaggaactgagaaattacaagtggaaggaaataagatctgtatacaagtacagatgtgaagagtggcttccaggtctttgttcttctctgtcaattcattgatgttatctgtcttcaggatttcattttacgcctatatcagaaataaataaccttgaggaaaccatggatgggtttcaaaaggtctatgaaagaaactatgtgcatgcttttttcttagaggtttttttcatgatattttcaaaatgtcttctgatcttagagagttttaaaattatccacatatttggacttttctctccactctaggtccttatttccaaatgtctactggaaatctacttttatatcctacagattgctcaccttgtcaaatattgaacttttactatccttttcccaaagttgcttactgttgctgctgtattgcctttcttgatgaatggtgtgctaccaccctttgtcttgggacctcccacttctttagtgtctccccctcctcctatctagttatttgcctcattgtgttagttggatttagtacagtttaataaatatggattacatgctactgtgaggctgatactgtggttggttctaacagttcaaaaattaaaaatgaaaacacaatcctaacttgaaaagagctcaatttcttgagggggattgttttaaatcacaaaataagtgcagtgagttttgcattcaactgaaacattaactacttggtgccctagtaagtgcaggatatacagtgttggctaaaacatacctcgtagctgcctgcttcaaacagagacgttagtttaaaacaaataaataaattttgttttcattattgcaattactatgaaggaatcaaacagtgccaagacaataataggggaaatcgacttgagataggatggtcaggagaggttatatttaaactgattcctgaaagatttgacagaactgagggaagagcattctgggcagaatagaatttgtcaaggacctaaaataggcaagaccctggtgacttggggaaatcggaggaaggcagagggtaatctgaagtgaagttaggaaggtgggctagagccattttcatgaagagccttttagtaaagtatctggggtttttttccccccaagtatagtagggacttgttgaagaattgtatagtttaaagatccctctgcctgtttcatggactgaggagaacaagaataagaacagggaagccagtgagcaggctcttggaatctatagagatgaatgaggatggtgatttggatcagggtgaaggcagtggagatgaatggagcagaattccagatgcagtttttgaaatagaaatgatatgacctggtgatggattgaacatgggagttgaggaagaggatgtaattagattagtacatggaaatgtcagatcagcaattacatctgcaaagtcaaagatcagaagagagatctgagctagaaatgtaagtgtggaattgaatgattttacctagaaagctgtgagctagaagagaaaaatggtgtaaaaccctttaaagagaagaattttaaaaagtgaattgttagcttgaaagtagggtaacaacaacaacaagaaaatgattgaaaagttgtatccacagggatgggaagaaaaccaggagagtgtggtattcatgtaacaattttcttgtttcagggagggagtagtcaactgtgtttatgcagctgaaaaatgaaatgaagactgaaaatatttggcaataagggggtcattggtgacttcgagaagaatactggggcaggatggaaatgtctgggaatgaattgggaaatgaggtgaaagaagtggagtcctggtgtatagaaagatgaagtgtatacacaaggtgctacaaggacagaggacggggtgcctaactcattctggggagttaggtaaacctttccaaagaagatgaccactgacctaaatcttaaaggacgaataggggctttagggtctgataaaagcagacaaaaaatacgtaaggaaatgtagagagacagatagttttaggtagagcataaattttcaggacaaaggtagtgatagattaagctggagaggtaggtaggagccatattatcaatgaaccttgtcttccataattagttattattgagtacttactgtgtacagagactatgcgtggccttcatatatagtattcccatttagtcctccttgatgtcctgtgagttaagtttttaatccttattttatcaataacatacctgaagcttggagtggtgaagtaacttggcccagctctcacaagggtgagtactagattcaagatttgcactgaggttgatccaactttagagccatgcccttaacttttctactcttctgccacgtaaaggaactttatcctttaagacagggcagaacattgtttttaattttttttctaaattaacaaaatttcaatattagaatttgctgggcacagtggcccacacctataatcccaacaactcaggaggataaggtgggaggatcacttaaggccaggagttcaagaccagcctaggtaatgtagcaaagatcccttctctacaaaaaaaaaaaaaaaaaattaaaaattagccgggcatggtggctcacacctgtagtcctagctactcaagaggctaagatggggatcacttgagtctagggattccaggctgcagtgagctatgatcaagccactgcactccagcctaggtgacagagtgagatccttaaaaaaaatttagtaaaattcatataatactccagatttccattttctcctgaaggagaaatgttgaggagggggaaggaagtagtaagtgcagctaggtttctattgttaatagtccatgccagatatgataaggaccaggtcctggacatagttatttgctcactctgtgcttttcctgtatttgacctataatcttttttttctgggcccgatcacattgttttataattattacctgtgatatgtattcccagctagaccatgagccctttgcatgtaggattcaaatcttgttcatctttgtatactcagtgctcagcactcggcatattaggaatttagatttgtaaaatacttgtcatgtgaataaacaagtaaatgtggaacttcgtagaccaagaaccacaggaacccttcacctagcctactttcctgccattacctttgtcattattactaacatatattgatcacttactatgtaccaagcgcttttctaagcactttgcatatctttattcctcatataacagtcagctgaggaaacaagcacagaggagttaattacttgcccaagatcatatatctagtaaatagaggagctaaaatacagtcaccggtaccaaattattaatgccatttattgagatcaacatggattttctactaattaagctcttaggcacttctcaaatctaggtttgcttttttgtggtgtcctttttctttatttctttcatttttcgaacactccctattccccacacatctttccatctcccttccaccaagactgattcactgagttagagtgtagtctttccagctgaccccaaagacagatacattatgggctctttcagtttagggttttgttttttgtctttaacagtttaaggaaatggagtaattaataacaaacatgagaaagttacagactgtgagacctctcactaagttattggtcctgactaattctgcattccttgccaactgatagctaaaatgtacagtagtgtttgccctcatctttactcccgaagatggccctcaacagacctccctgtttccaaggacccaggccctctagattcagctggtccctcttcacaacagcctggtcttggtttttaggtttgaaggtgagatcaaagcagtgaggaatgtctaggacctacttgtgtctacttggactttcatcttaattagcatgcattttagaaggcctgagcctcctgactttagaacattgtctcacaccagctaagactgccaactaatagtcacgtatgtgattttcttagatgttaaaaataacattgaaccatattttatgtcttttaggccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggtaagatatcttaattatctaagagctaatttaaatgtaataatgcttttaaaaaatgcagagcaggccaggtgcctgcactttaggaggccaaggcaggaggattgcttgaggtcaggagttttgagaccagcctgggcaacatagcgagactttgtctctacaaaaaattaaaaaattagccaggcatgatggtgcatacctgtgtttccagctactcaggaggctgaggtgggaggatcacttaagcctgggacattgaggctatagtgagccatgattgtgctactgcactccagtctgggcaacagagcaagaccctgtctcagaaaagcaaaacaaaaacagaaatgatcattttgctttcaaaaagtttaaacttcaaaattatattcaatttgcacttattttaccttatttgacactattacattgaaaaagtggaatatctctcaatatcctgtatttgtattcatttaataccatttatagaaaactattatgaaatccctgcatacataaggatttgtttctaaagtcagtagaatgtaaagttaatctattcaagagtaagctctgaaaatactgtacatcacacataaagaacagtatttaggcaaagtattgtaaaagtccaactctgctagtttttcttatgatcaccagttgatcacaagatgaagtaattggcatatgtttataggaatcacgttgcataaaatattcatgactttaaactagtctggcaagatgtgaaagcatggaaacagattaagagaatagcagattcacctgtcccatttcactctcactccagaatatacactcactgattggaatattgtgtggaattgcctacacaatttaaatccccaaccccctcctgcctctgttcctcactgtctctctccagagcacataaatgtgcatgtgatgttctacagctcttctaggcattagggatacagaaaagaataatttagggctctgcccttaaggaactcatagtctataagtgtccccttgctgggacacattacaagttttcccttttgagccatatctaagaaagtagtttgtatagcatggaatagacatgctgactgtactgtgaggttgaaaaactagtggaagaagtgacatgtaagtgccctttatagactatgcaggttttgcctaaaaattgtcaactcagggtttctgtgcctgtaggttgaatatttgctaagcctaacagaagggtaaattgtgtttgtgtttattctttcaatcctctggataatggttaactataccctttggatatcataaaattctttgatggtatctaagttgttttctgctgtagcaatacctgagactgggtaacttttaaagaaaagaaatgtattcatttcttacagttctggaggctggttaagtccaagaccatggcgccagcatctggcaagggtcatgcatggtggaagggcagaagatggaagagcaagggagggcaagagtgtgaaagagaagaaaaaggagtcgaactcccaaaataactaacccattcccgtgataatggcattagtccagggcagagccctcatgaccctgttgcctcccaaaggcctcagctcctaacactgctgcagtggcaaccaagtttccaacatgtgaacttttggcggatacattcgtaccacagctaatgggaacaaccactgtcatttgagtaaactgtgaggttgagaaacaggacattatctattgaattgtagttctcactttcccacaaagtagtcctggaatgttggacatgacttaactgtcctgtgccttttttttctctttttttttttttttttttgagacggagtcttgctcttgtcacccaggctggagtgcaatggcatgatctcagctcactgcaacctctgcctcccaggttcaagcgattctcctacttcagcctcctgagtagctgcgattgcaggcacctgccaccacgcctggctaatttctgtatttttagtagagatggggtttcgccatgttggccaggctgatctcaaactcctgacctcatgatctgcccacttcggcctcccaaagtgctgggattacaggcgtgagccaccatgccccgcccttttttctcgtctttaataataagagactatcctaggtgacctctaaaattccttttagttctaatatcctattattcaagaattagccattgtcattgatcaacagatagaattttagcatctgccgtttacatttttttattagctaatattttttgtaccagaatactaaagaatatttattgtgaaagctatttcttattttataaaaaattttaggtggttaagtttatatgtacactgtaccttaaatgagaattacagcatgtcgtttaacttccacgagactattttgttatatagaaaatgcaaataatagtatacttcatggttgttgagaaaagcaaattagatttgaaatagattatgacggaaattacaagttgctatttaaattttgattgtggggtaactagcttgtaatctttaacaagtcacaagatggacagtgactccatttttttagttactttttcatttacatctgaataattttattgtaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttacgctctcactgtttgtttttatttaaattacaattttatctgtttcctgacattgtctcctatatatttctattattaattgcaaaaacatagaaatggaaattttgctatcaacaataaaatttttttaaagtagtgagtgctattttggagttccaaattttcagtaggaagtatctaaaactttttttaatacgtgccattatctatagaaaacattacttcaggttgtgagattgagttgcatttctggatggactgatgaatttatccgacatgaagaagattggcatattagctttaaaaatttttaaagattggattttttttagtataagcactttctaaggattatagagaaatgtttcacctccaatgcatagcaaaaatagtggtgttagaaagaaaataggttacatttaaggaaggtgctttaaaaagcagaagcagactttaaaattaaatttgtggacacctttttaaaaattgaatcaaagattataatttagatatacaataacacctatatatagataagttttaacactgagttttctttcagactgttttctaactacatagacaataaaattaagctttgcataaagctaggtttgtgggtttttgacttctacaaagtcattttttttccttttagccctgaaaactagccattgccaaaagtgtgtaatttaggatgacttgacaggatgcaatttgttaactaagttcattaatgcagcagtgaaaaagttacttttcagggataccatattatcataatacaaaaacacgttagttcatttttatgtatatgtatatatttttaatactttatttttggagcagttgtaggtttacaaaaaagcagaaaatacagagtgtttccaaatacccccttctccctcagtttcccatactatcttgcactgatgtggcacattggttataattgagtcaatgttttgttttgtttggggttttgttttttgttttttgttttgtttgtttgttttttgagacagagtctcgctctgtcacccaggctggagtgcagtggcgcgatctcagctcactgcaagctccgcctcccaggttcatgccgttctcctgcctcagccttccgagtagctgggactacaggcgcccaccaccgtgcccggctaattttttgtatttttagtggagacggggtttcactgtgttagccaggatggtctcaatctcctgacctagtgatct

SEQ ID NO: 13879 - DNA, 42620 bp, Human
ttgggattgggaaagaaaaaagaaatcatgctccccggttcccacctagatttgagttcctaaaatcctgcctctcgcacccctttttctttctaaggaagctagtatctcccaccttctcaagaaaacagtgagtgctccattacatttaaatcccatccccagatgaaggaagcagtcattatcttctaagttctcagccccatgaaaaccaccatgaaaataccaatccccgtattttcaagaatagttgtcagcaaagtgttgccgcaggagaatactgtctgaaggcagggaacctaaggcagattcacactgatttcctagaactaaatcaaatggaaaaccccggccgggcgcggtggctcacgcctgtaatcccagcactttgggaggccaaggcgggcggatgacgaggtcaggagatcaagaccatcctggctaacagggtgaaaccccgtctctactaaaaatacaaaaacaaaattagccgggcgtggtggcaggctcctgtagtcccagctactcgggaggctgaggcaggagaatggcgtgaacctggcaggcggagcttgcagtgagcccagatcgcgccactgcactccagcctgggcgacagagcaagactccgtctcaaaaaaaaaaaaaaaaaaggaaaaccccaactttccacacctaagtaacaaaagaaccagacgttactccctttgcaaccccctccccactacacaaccacacacacacacacacacacacacacacacacactttagccgtgtggcagatgtgaaattgaaagtatctctgattcgttgctttctgcaaccaatcagacgcttgcataggagtgtaactttgtaacttcactttagcctctgattggttgctttccacaaccaatcagactgattgtggagccactacttcatttacatagggtgtacaccatgtaaccaatgggaaacctctagagggtatttaaacccccgaaaattctgcaaaaggactcttgagctggtattaccttttcgttttcaataaatctctgcctttattccttcattctttccttagtttgtgcgttgtgtccagttctttgttcaaaacgccaagaacgtgaatactctccaccggtaactgttattgttgttagtaatagtggtattacaattttgacgttagtttggctaattaataaatctagggatattttgcaatatctagatgttctcgcaagttttctatatgtagctatcagccaacgttacaaaggccgtgaaaaaaaaatgatcagagcatggcccatatcgtcgtgcctcttgtgtacacattggtttcacgtagttttgtttcatcttctgccaattctaaaagggtatgcaaggcaagataccataacctatataaacttacatgacctgtataaaggacgtgcctaagaagacaacatgctagctgatgacagatcctgaacagacacctgttctggatgacctaagtgagtttctccttttatttcaaatttcttagaaagaatcacccttggggcacgtaagaactggctcaaatgggagtgcctgacgcggggtggggggctgggggcggggtaggtggtggccgtgagaaggtagccgtgagaaggtgggagaggaaggggtggttaaactattagggatgcaggctttggcaccactacgaagccagggttttctttgtgttttaactgtcagattgagagtagctctgttgtagcccctttgcagggttcccatgagacttttcctaggtagttacgttgactcgcttagcaacatagcaaattacagaaacggagtaagaacgtaagaaatcgcaaagcacgtgacgtatgggatctcactgttcttggcccttctcccgacccgtagccctgctctgctacgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccggttagtatgtcccgccgagcccggcgagctgaggggcgggcgcgagcgccgccggcttttaggcggcctccgggcagcctcgtagggctgagcgcctaggggtatgggagagaagcggcgggactggccgacgggccgggacaaaggcacttccagacggcaggactgtcagggtgtcgcaggggttaccgagctgttgacgttattgccctggagtcttatgtagatatcaccctatgtgggtcctggtgggctactgtgtccccagtccttgccctcgtatcttttcccaatatttcaatctccctttattttctcttcttcccaccctccctcctctcctcccccgcgccccccccccccgcttgtttttttcatctacggcccaaacaacccgagggtccgtaatttctccttttcaaaggaacgggaaacagttagtttcaggttcctatcgatctgacagctaggaagttgggaacgtcagcattggtaagccagatggaacctggttggttaccatcacagcgggcctcggaagtggaagctagagccatcggaagagttgattagttccctgctaaaggatttgtttacaaatatcgttgcctgtgtacttctgaagaaaatcttgccaaagaaaattagttatatgtgctgggaggtcgctttttagtatatatttaagaatgcagtgtactcatatctacaggaaatgcatgcagtaccctcagaaacagcctttaatcttgtgacctgaaaaatgcttgcagaccctaattatgtctctcattaccactgtgaggtagatattagtatttttgcataagtgtaaactgagtcatgccaatgttgacttttccaagagtcgtgttagagtgtagagtctaagacaacctgtttcctgttatccacacctggcctttggttaactaatcctgtgttgaaagtatcaaattaattctacagcttctggaactctggcactatttttctgaccctgctatcatctgtggaattggttaatttcacagtgaaagccatttttacaaaatagccttttctggtaactgccaagacttacattttatgattagaaaaggaatttggggtgggaggcagctttagctaatatactgtttgaacagaactcataaagccagtgacactcttgtttactgattctgattcttggattggatgctcagtcattctatctgggtgttgttctgtcgggtaaggcctccttgtaggtaaatggaaaacttgggctccccagatcactcaaatacgacttaaaattctaccatggctttttttttttttttaattctatcatggctttttaagtctgaaatttttttctagatatgtgcaatttatgtatcatagcagttattgctcaagtttttctatcagtgacaacaaagaaagttaaatgcagtattttttattttatggaacaggcctgggctgaagtgtaggtggcacgatcatggctcactgcagccatgacctccccagttcaagtgatcctcccacctcagccttctgagtagctgggaccataggtacacaccacgtgcctggctaatttttttatttttaaattttattaatttttatttttgtggagacaaggcctagttacattgcccaggctggtcctgaactcctgggtccaagcagtcctccggctttggcctaccaaagtgctgtggtaacaggcatgagccactgcgcccagcctaaatataatatttctaccttttgcatgtttttccctcaggaaggtgtattgtcactaggccatgaaactggctggtgtcctcacagaggagtacaaatgttctgagttcaaatgtaagctccgccacttattagttccatgacttcaggcaaatcattctctgagcataattttttaaatgtgaaatagtgcctttcttgcaggattgttgtggagattgacaataataaatgtataacacaagtaatacagtccatgcccaataaatgatagctataaaatggggtttgggattatctggtacttgagtagtctcgaatcgttttaatgtcagtggtggtggtttctctattcctccctattgtttctctctgttaccaccttcaccaccccatttgtatggttcctcttctgtattgtgggtaatttgattaagtttactaatttagcatacttttattttgataggtaacacatacaaatggtccaaaagcaaaattgcaatagactaaaaccatgaaaagtagtcttcctcctttcctagctcccagccatctaagtctccctggatcagccataattactagtctcttggtgttttcctagtgtttatgctttaacaaatgtataggaatagttctaacctctcttcccccacgaaagtgacctaatttaaactccattcactaccttgcttttacctttttttaatgaagttagcacattttaaaagtgggcagctcagttacaaagtgagcacatacatatagctcctacccaggtaaggaaatcagataccactagcactagctaagacactagcaaagtctctgtcctcagtcattccccctcctttgagaaaaccacatcctgatttctaactccatcaattcatttggcctgctttaaagttgtcataaatggcatatgtattctgctgtctagattctgttagtattttgaggttcatccatgttatggtgtatggttagttcatacttttcagctttgtataggttttctaccttattcttcactcttcatatctttgagatgtttctgtatcattacacaaactatagttttctatctactttttaatactgcagagatattagttcttagcacgtgttgcacatggcctcctcttttactaatttgtaattactgttactctgctaacattttcctttatttcaacatggtttttcataatttatatcaactgtttaattttatttgtcataatttattaaaatactttccttagaggaatttatggaataaacacaaatatgaagtaatactcatccccccgtgttcccaatgagaagattcaagacatattctagttaagctgactagataagtttaggggggaatatggattattttatcagttttcccgtagatatcaccttctgagttgagagttaacattctgaattgtatttgctagcatgagaaactttaccccaaaccacaaatactatttacatactataagaacagttgattttgtcttttacgtgtatctgatgtccataacctaaccatttattgtatttcagatggtttttaaaagggccttatttgcagtgataccaagaatttatgattgtgaggtcataccccctgaaataatgatcaaatctttgttgcttttacagctgattctgtcagatcatttaagattaatgtgtcaaaaaaagatgaatgtgtcttctgcaaactgctttgttgttcaaaataaattgagctaattattaatatcacagataacaagtagcttttgaaacaatttcttgaatgataaattcaataactcaattctggactaaaggaaatcatcaagtcttaagttcagcagagcaacttctaccatccctcatttctatacttactgggttcagtgtactatttaaatctgttactaaagtagttaacaagtagaaaaatacagagagaaattgttctctgactagagaaataagtggcaaagagcacaaactggatggtaatgtaaatgctgcaggttattacggtaactagtcattactatactaatcaacatttctaaaagtcttactggcatacatattgagagaagaaacaattattttctatttatgttttgaaagccttccacaataaaataagaattccagtggaaactacttgccagttactagctggaatttaaaataacctaactgggatgtttactttgaaaatctagcttatatgtgttacagttgtatgtatgaaaaaacgttcacaatctttgtcttccccatcccccatcccagaagattaatttgatacatgttggttgggaagatgtaaaaatacaacttttttcttttagtttggatgctcttccaagagtcacatgtccaaaccatccagatgcgattttagtggaggactacagagccggtgatatgatctgtcctgaatgtggcttggttgtaggtgagttgttattatggttttaatttaaattactgttcaggaggccaagcatggtggctcacgcctgtaattccagcacttcgggaggccaaggtgggaggatcacctgaggtcaggagttcgagaccagcctgaccaacatgaagaaaccccatctctactgaaaatacaaaaactagccgggcgtagtggtgggcacctgtaatcccaactgcccaggaggctgaggtaggagaatggcttgaacccaggaggcggaggttgcagtgagccgagatcgtgccactgcactctagcccgagcaacagagcaagactccgtctcaaaaaaaaaataataataataataatgtttagggtccttcacttttgcatagtttccaaactatcatttaatgaacacatttttgactttcttccccaacaaataatttattgcaaaaaaacaattaggaaacagaaacgagtaaacttattcagagatatattttattgtatatccaaatgtatatttttataatgtggggtgggagctaatccagaagaaacgaaaaggccccagtaatttcataagtccttagtctgaaatatttggtagaggactggagagatgggctgacactcatgcatattaaataatgaatacatgtaatcaaacttttgtggcttttttatacattgggaagtagataaacatgatttttgagtcccacttaaagccttttagtcaaaaagaagatttattataacttttatacagtcatctattgatgaatatcttgtataaaattattgccaaaaataacacttaaagtttcaccttgttcctacttgcacactaatctagatatgcagcagaactttagactacagatagtctgttcaaaaattattcttgtggtggagttgtagcatctgagaataggggtaatatttagcagtttgaattacttaagaatgaaaattctagaaggattgtgggcagtataacagaagcattagtagtggcatactgtggacttgacttacttggtccaagaaggctgcttgcctcagacctatagtgggagttttaaagtatagagttgctaataggaattgagaatcatttgcaaccgtattctgctgagtaatgaatattaatagctaatatgtttactatatactaggcactattctaaatgatttacatattcactcagtttatcctcacaacaaacctgtgaggtgagtactaccattatcttcattttacagataaggaaactgacgtttaggtagtctagaagactggctccattgtctgcgtgggaggcagatttctatcttgtattgcctttcataataataaaattttaatctggggtcgtcaaagtacaacctatatatggcctatttgttaattctggcttttacatttttaaatggttaaaaaaaatcaaaaataatattttaggacatgtgaaaatacaaatttcagtatctataaagtttttcttcgtttgttttttgagacggagttttgctcttgttgcccaggctggagtgcaatggcgtgatctcggttcaccacaacctccgcctcccgggttcaagtgattctcctgcctcagcctcccaagtagctgggattacaggcatgtgccaccatgcccagctaattttgtattttttttagtagagacggtgtttctccacattggtcaggctggtctcgaactcctgacctcaggtgatacgatcgccttggcctcccaaagtgctgggattacaggcgtgagccactgcgcctggccaaagttttttttttgatacagagtttcgctcttgttgcccttttgttgcccaggctggagtgccgtggtgcgatcccagctcactgcaacctctgccttccagtttcaagtgattctcctgcctcagcctcccgaatagctgggattacaggggcccactactacacctggctaactttttgtatttttagtagagacagggtttcagcatgttggccaggctggtcttgaactcctgacctcaggtgatccaccagcctcagcctcccaaagtgctgggattacaggtgtaagccaccatacctggcctggtatctataaagttttaatggaatatagcaacactcacttgtttacatagtgtatatgactcttttcacattacaacagcagagcttagtagcttcaacagaaaccacatgtgcagctctcatcactttttttctgctgctcagcatactaattgcagtgatgcagttataacagcaacatgttgatcgccacatatgttgccatactgcactattttatttatttgtttttattaccattacatatccatcacaccaaaacaagaaaagttaactttgaatgtcatgcttttaaggcatggtggagtatggattattttgtcactgaattagatggcaaaacattgtgtttattacacaatgatactgtagctgtgttaaaagaatacagtaagcgtggacattaccatactgagcactcatcagaatatttctaactcaggaaaacaatggtcagaaaataatgtaaaatagaatatcttaacacaacagaattttttcacaaaaataaaagaatgaaactgaggctgcaactaaagtttctaagtggcttatttcttggccaagcaaggaaagccatttaccaatgataggttaattcatatttgattgcaacagctgaagaaatgtatgcagagaaaataaatttatttaagactgttagcatctcaccaagaacagttgcttgaagagttgaggacagtggagcaacatcagtagtcaattaaaagttaaggcaaattagctcaggtatatttttccttggctcttgatgactagatcaatgttattgctgctttgcagttgtttattcaagaagtcagtgttgggcgaggtgcagcggcttacgcctgtaatcccagcactttcggaggctgaggcggatggatcatgagttcaggagttcaaaaccagcctggccaagatggtgaaactccatctctactaaaaatacaaaaattagccgggcgtggtggtgggcatctgtaatcccagcttactcgggaggctgaggcagagaattgtttgaacctgggaggcggagtttgcagtgagccgagattgcaccactgcactccagcctaagtgacagagtgagactctgtctcaaaaaaaaaaaaaaaaaaaaagtcagtgctgagcttgacagaagaactagctccagtgagtagtctacatggaacagctataggagaaaatagcttcaaagcagttgcaaaagtgttaattcagtataacctgaggtggaatctgctaagatttattataactgataagggtaaaaatatgtggagcagaagacttagtgggacagatttgccaagattgaaaacgtaaggtgtttaaaaagcctattacattattcatcagcagtactttgttagagaagactttaatctaccttgtgttatttaaccagtaattgtgaacaatgaacttcattcactcttgtgcacgtaactatcaatatcagttctgtgactttttttttgagacagagtctcactctgtttctcaggctggagtgcagtggtgcgatcatgactcacttcagcctcaactcctgggctcaagcaggaccctggctaattttttttttttggtacagatagggtctcacagcgttgcccagactagtcttgaaccctggcctcaagtgatctttttgccttgatctcccaaagtgctgggattataggtgtgagctatcatgctcagccagttttgtgacattttgttagaaatagaagctgaatatttctaacaaaatactgttagggtgacttgtcttaatgacacactaatctggtgacttagcagtagcaaagttttgttgtgatttttctgaactcggggccaagagtaagatttttctgaatcagtactgccttcggctactgctgttgaacactggatggttttgaaaattagcttttgctgcaaacttgctaatatgtcttaatgaattcatcatagagttacaaggcaaaatactgcttttctgtgaaacataaagtgcagtaaagtcaatttcacaagttaacatttgaatcataagtaatgtcaaattgcttttatatactttatatacttccagtggtgtcagaagttaaaataggatgttcattaccacatagatttgcagcagatatattttccaggctcaagctatattttcagcagtgtttttcagacttgaatgcaaatgcaaaggaaattttcatatttcaaaatttgttttcactgtacagttaagggggttccatctaaccttcagttggtagtgactaatctgcagtgtaacagtatgttaaaaggccattatcaggagaagaatgtaatacaattctatgaatgccttccaagcaataaatatgctcaattaaaatcatacacttgtggattaatatcggtatttggcattacttgtctatgcgaaaagaaagtgaaatacataaaatcttgttaacacaacatcattgacacatgaacatttgtcattgattttgatagagaacattaactttgaactccaattaagtgaaatgtgatccccaaaagagaattttattttcctcattagtagacatgtaagtacctacttaatatcctgaattttgcctcttgacccacaaaacctaaaatacttactatgtcaccctttacagaaaatgtttgcttaacccttcagttaaatgagagccttccagttcttccacagtgttaagatcaaactgataatgtgtacgagtgagacagacatacatgagattgaagataatttcagcttcttagctctcctaacctctgtagcgttttttttttttttttttttttttttggagtgagagtctccctctgtcccccaggctggagtgcagtggcacgatctccgctcactgcagcctctgcctccggggttcaagcgattcttgtacttcagcctactgagtacctgggattacaggcatgcaccaccacacccacctaatttttgtatttttagtagagacagggtttcaccacgttgtccaggctagttttaaactcctggcctcaagtgttccacctgcctcgacctcccagcgttctgagtttacaggcgtgagctatggcacctggcccatttttaaataatgtaaaagtatcccattatattttcagccttcccaccagcctcacttccactttaaccagcaagacagtggagattaatcaactgaaaaaggaagatacaattcacaagacttgtatgctttcttgtgcttggaattcctaatttttgcttgtacttttctgctatatcaaaccaaaggaagttaattttgtttttgcttttattgacttactagtatcaaacaccatgttaaatcttgagatctgaaaaacatatccaataaaacttactttctataatatatgacagtatttctttttgatactgattcttctaacataaaatataaccaacacttattttaaaatatacggtaggctcattcatagatatttgtggttaaatgtgtaatatatcttgtaagcgaagaatccattccattaccaaacaagggcaggtgtagaagagtctaggagcaaagttctgttttgctgagactatcatcaagcaaattaagttggaaatacctaaattgaacatgacactgcatgaatataaatcaatatatgacataaacacctgtatatattaatgtcatatatcaatagtacatttagattgcattaaaatcatatgtcacttgatgagggtatgttctgagaaatgcatcgttaggtgatttcatcatatgaacatcatagatggtacttaataaaacctagatggtatagtctacaacacacctaggctacatagtatagcctattgcttctgggctacaaacctgtacagtggtattgtactgagtactgtaggcagttttaactcagaggtaagtatgtatcttttttttttttttttttttaaatacatacctagcatgtatttattctggcttttggagcttctggccaaactcatattctagtatgtggtgtttttaacatcctgttcaatgtaggctttgtggggcatgtctgaccaattgtaccttcacttactagttcttttttttttttttttttgagacagcatctcgctctgtcacccaggccggagtgcagtggcatgatctcggcttactgtaacctccacctcccaggttcaagtgattctcatgcctcagccactcgagtagctggggttaaaagtatgcactgccactcccagctaatttttgttattttaggaaagacggggtttccccatgttggccgggctggtctcaaactcctagcttcaaagagatacccccagcctcggcctcccaaagtactgggattacaggtgtgagccactgcgccaggccccacttactacatttttgtaggtactcaggtacattaacttatccagtttacctatgaaaagtgggagaaagtatcctttcatcccattgttctgtgagttgtcagggtgcatacagaccctgccatatatgtgaatgtgttcagctctctggagtcagtgcctccagtatttatatatcgaaacatagaaaaggtacaatgaaaagacagtattataatcttaagggaccaccattgtgtatatagtccattctaagccaaaatgttatgcaacatgtgactgtatatgtaattgaatttgcatcagctcgctggtttaaaggcatctgctcttcattgccagctcagttcagcctttacctcttacactaagaaaatggggaagaaatcaaggtgggcaaatattctacaacccactaagggacaacatttgtgacttttttcttatttaaattactgtttttcatgggaatttgaatccagacatcaagtgtttcctaataaattatcttggtatacatgattgattatgcttgccataaaattttttacattgtctgaaactttttagattaaaccatattaattcagtaaacattttcagaattgtttttggacagtcccatttttcttttctttttctttttcttttttatttttttgagatggaggagtcttgctctgtcgcccaggctggagtgcagtggcacaatctctgctcactacaacctccacctcccgggttcaggcaattctcctgcttcagcctccggagtagcagggatttacaggcacatgccaccccgcccggctaatttttttgtatttttagtagagacggggtttcaccatgttgcccaggctggtctcaaactcctgacctcaggtgatccacccgcctcgacctcccaaagtgctgggattacaggtgtgaggcactgcgcccagctggacagtcttatatttaattaacgtttaatttgtgcttgaaaattaggacaacccattgtcactaattcctcttaatagcaaacttaagcatagatacggcccaacttgcataatcagagccatatgtcaccctctcatctgtgttagcaactaagagagcccattactattacttttttttttttttttaagatggaatctcactctgttgcccagtctggagtgcagtggtgctatctcggctcactgcaacctccacctcccaggtacaagcgattctcgtgcctcagcctcctgcctgagtagctgggactacaggcacccaccaccgcacctggctaattttttgtatttttagtagagacggggtttcaccatgtcggctgggctggtatcgaactcctaacctcaggtggtctgcccacctcggcttcccaaagtgctgggattacaggcacgagccaccatacctggccactatcaccttttttaatgaaataattcataataccaaaagtatatttatcttataagcttatatcttatactttataccttttttcctgcctctaataacatttatctcattgtctgtcaaacctccttcttcttgaggcccacccaccaccaatctgaaaacaagaggcaagtgtttatttttcttaaagcaacataatacttcaggaaccaatttttgtttcatttacagttacattacaaactacctcaaaacttagtggcttacaacaaccattttatcttgctcatgattttatgagtcagtaatttgggaaggatttatctgggcagttggcaccggctgggcctgtaagatctgcttctatgataacttcttcacttgcatttctggttcctccgtgctccttgacctccgcacatggatctgtcatcctccagggcttctccatagttgtcttacagtagtcatattttatactacgtggtagttggcttctaagagaaatacctcaagagcaagtgttctgagaaagtggaagctagacatgggtaggtaagggttatgcctagaactggcacaggatcacttcagtattgtattcgtcagagccatgataggacccacctgagttgaagggaatggggaaataggctgtacctaaacttgatactgacgaggtcacattgcagaagaacatgtggatgggagatattgttgccatctttggaaaatacaaattgtcacacatttactgtcctttgataatgcttttccccagtatttaaatagctatgtattatttagtgtctcttaaaacttgtttccaatttttgtagctatagttaatgctattcaacatgtgatagttgtttaattggttctcttttatttgaattacaagatttttatttgaaacatatgaagtgttatgatttggtattagctgcccatttcatcagtgatccttgagatactggtagtgactctaaaacaaccaattttttatttttttatttttgagacagggtctcaccctgttccccaggctggagtgcactgaaatcatctcgactcactgcaacttccacctccctggttcgttcaagcgatcctctcaccttagcctcctgagtagctgggactacaggcacacagcaccacacctggctaatttttgtatttttttgtagagacgaggtttagctgtgttgcccatgctggtcttgaacgtctggccttaagcagtctacccgccttggcctcccaaaatgtccacgcccaacctgggccaattcttaaagttttgttgttcctactgtgaaactgttagttgtctttgcttgtttgtttgttttgtttttgagaccgagtctcgctctgtcgcccaggcaggagtgcagtggctttatcttggctcactgcaacctctgcctcccgggttccagtgattctccttcctcagccttctgagtagtgggattacaggtgaccaccaccatgcccaactaatttttgtatttttagtagagatagggtttcgccatataggccaggctgttctcaaactccttacctcaagtgatacacgtgcctcggcttcccagaatgctgggattacaggcatgagccactgtgtccggccgaaactgtttgttctaacagcactcttttgtgggggttttttcccaaattccaattgtatgattatgtcgttttaaaagttgaacactaggtggcagtattattgtatttagataatcagttcatgaatttgaccttgtacattgcccataaattgatttttataatcagtaaagtattagcttagtaacctgccataattgctattaaaacataaaattggtctatcatgactttataaattatttcacaatgaggagttgtttgaaactagtagtagtatttctagttaaagccacttttttgtgtaccatttaaatctaaattatttgattgtatgtaaaagcaacgtaaggaaaatactggaaaatagcttaggtatatttgaaagagagaaatgagtccatttgacctctcccttctactaaactcattctgcatattgtttataccagcgaatctgaaatatgaatatataaatgggcattaagagtcagctggggaatgtgcttaaaaagattctaggctccattcccagaaattctaatgtaggtcatacattggtaacatattgaggaacacaaatctgtactactttataatttaccacattcttttggattttctgtacgtttagattttttatcttcatattttccatgtcttcacacctacactgcaaactcctttggggcatatattttataattgtgtgtctccattgctcctagtatagctagaagtcagtgtctctagaattgagggttggctttactaattagtaagctgtgtaactatagttacatactttgttcaagcttaatttgtttcatctgtaaaatcttttttcctcacccatgaaagacagatacatctcagaattgctgagtcaaatgaaataatgtataaaatatatagtgtaattttagtataagatttcactgatacatattgtggagatacaagtgcttttttttgagacagggtctcgctctgttgcccaggctagtggcatgattatggctcaccgcaaccttgacctctcaggctcaggtagcctcctgcctcagtttcccaagtagctgtcgccacgggctcaaaccaccaccctcagctaattttttaaaaaattattaatatttgtagagacagcatctccctgtgttgcccaggctgatctcgaactcctgggctcaagcaatcctcctgctccagactccacagtgctagaacaggcatgagcactgtgttcggcttcccccttgtttttttttaaccttgtagaaaaagagggtgattctaagtgtgagatgccacatttcatagcatgtcagttgcaacatatctttgagtgattgctgtgggtctggtatatttaatgctccaattatagtatgttaaagattattgggttaccctctttcagttagcattaacagtgtttcctaaaggaaaaaatcaggtttcatttaatatggccaagttaagtttttaaaataaacgtatttgtattcacttacaagttatttctttggcatcccttgtaagccgttagacacagccttcttgcctaatttacagcttttaatttgggtgcagtttttctcttaaacatcaaaaaattactcattaactgcttgagtagcagactgccctttgagctggtttgtttccattttacagaaggggaaactgagactcagagtgcttaggtaactagctcaagattcccatcttctgagtgacagagccacataaatccaggtctatgggacttaaaaacctttttttaccatatgtctcagttaagcactgtgctggttggtcactgagagtgatagaaagatgagaatgctgtaagcaaaccctggagcaactctttggatagtgtatgaaagagagtagggtaacttaatacagtatccgcggtaaaagctacattacagatcttccgagtatggtgacatcctgaagatagtactgttgaatttcgagtgaagcatagtttttaagaatgagtaaggatttatggagagaaaatgattccaagtaaagagaaaaagaaacctatgccataggatagaagcctaaacagtagtagtgagtgagtggccaaatttattgtggccaaatttaggatacaccttcaaccagtgcatcagctcctcatcttagatgctgctgctcctatcgacctacttgtatttgaggaaaattgaaatgtaataagatatccagggatggagcttacaatgtattttcctcactattttccactatcaccttgaacagttttctttacggtctaaacatcaggggcaaagtaggcttttatgggctggtctgggaaataaactgtgatatgctttgtttctaggagataattcatgttgagttcctactcaatttatggcaacataaactgtgatttagagactggtgatttagagacttgctgtattattaatagtatttctttataaagtatctcttggtcagcattctcttcaaaattgtctaatgcaaaatttcagtaagaatgtatagtgaccctagactaaaaattaggattatttgacatgtcatgagaaggaatggtagaaaggattatatgaccacagaaagtgtggaagctaatgatacatttcatcatcaacattagactgtttacagcatgttgacttaaaatagttttccaaagtaccttggattttttttttttactttaaatgtaaaaatatttgatgtttagagtttgtccacgttgaataataatacgttcagattcttgaacttttagacttaccagcacatttaacaacatacgtagtttgtaaactaaatgagcctgtgaagacaagtaatttgggtttattctgagacttctacttctgaattctctactacaggttgtatgccacagtgattaagattagtttccaggaagacagcagaaagaattgaaattctgggaaattcctcttcatgttcctgtttttaaaaattcctttctgaggagccaggggcttgtgccgtaatcctgataactcaggaggctgaggcgggaggatcacttggggccaggagttcaagaccagcctaggcaatgtagtgagacggtgtctgtaaaaaaaaaaaaaaaaaaaaaaaaatttaattagctgtgtgtggtggcgcaagcctatagtcctagctacttgggggaattagttcccccaagtagctagggagaattgtttgagcccaggagtttgaggctgcagtgatatgattgtgtcactgcactctagcctgggtgacagatcaagaccccacctccaaaaaataaaacaaaattttaaattcctttattaaattgcaataagaaataagaagcaaaaacactcttaagagtctaggtcaggctagaaaatcagaccctcctcagtatttacttcctggctgcttttggtgtgttgcaatttcccctgcacgataagcccttctggttttcacattgcgctatgaaatacctttggttggatttccagttgcttgcatagtaaagaggataaatgtctgtttaatttgtctttgtttgcgattcccttcagaatatgaggcagagtaccctgatttttctggacattctttctcacttctcctctcccccatcctattatttcttacagctgagactgctggttatttgccaacatccatttccccattctttcattagtaagagtccctgagttttacatgggcatgtatgtggctgctcacctagaccctatttcccagtttcccttgtagctaggtacgccatgtggttaagttctgaccagtgggtttgtaagtattagaagagatgtgtacaactctagtttatgtcataagaaaagatgtatccttactttttttccttcccaatggctagaatgcagacatgataaaggaaattaccaacagctgtcccgtgctacaaaatgcaagccatagtaaggataacttatcaaaaagatagaaggagcttgggtcatactagcctaggactgttaagtatggactgttaacatgagaaacttctatcttgtttaagtcactactattttttatttaattatagcaaccctacctgtatgtccttccttaaaaacttctggaatcctggccaggcgtggtggctcacacccataatcccagcaatttgggaggccgaggcaggcagatcacgaggtcaggagtttgagaccagcctgaccaacatgttgaaacctcgtctctactaaaaatacaaaaattagctgggcattagcctggcgtggtggtgcgcgcctgttatcccagctacttagaaggctgagaaaggagaatcacttgaacttgggaggtggaggttgcagtgagtcgagatagtgccactgccctccagcctgggcgacacagcgagactctgtctcaaaaaaaaaaaaaaaaaaaaaaaaacttaatggaatcctgtgggaagtttctcttgtttgggtcatctattagtctgctggggactgtgctaatgcccataaagactgagagtactggtgttagtgatgttggaagattatctggattggattgacaattctttattataggatgaataaacttaaaaatcaatatgaggcttatgaatataaaactgtaataaagagaaacagggatcctatggacttagcagaaaactgtgcccctaatatagtttaattactcagagaaagttacagaaaccaatgtgatcagtgcgctaaagggtctattattgaaatattatggaagatttctattaaatgtcagaaaaaagtaacacagcacaaggagacaaacacaataaaactggtttttaggtggtaattagcagacttaacactctaaaaaactaaatcagtaaagcagagaacaaacctgagatacacccacagtgtgcaagaagacaagatatctgttaagttagtaagacaaggtacccattgtggtactacttgaagatccaggtgaataagataaaagagaataaaactttacattcctagcagaagagctcagggctacaaatcaagaattgtgcatagcactggggattgcatccttttaatatttaaaaaattatattaatagagacttgcaaccaaccagtaaaaaggttactttcttttttttttttttttttttttttttttattgagatggagtttcactcttgttgcccaggctggagtacaatggcatgatctcggcttactgcaatctgcacctcccaggttcaagcagttctcctcctcagcctcccaagtacctggggttgcaggcatgcagcaccacgcccatctaatttcgtatttttagtagagaccgggtttcactatgttggtcaggcttgtctcaaactcttgacctcaggtgatccgcccaccttggcctcccaaagtgctaggattacaggcgtgagccaccgcacccggcctaaaaaggttactttcaaaggacctaaaatcatattgacagattacttctctgtgacaattgctgaaatacaatgaaattatccctaattcttcagtttgtcatttggtacaaaaaggaagccatagaacaatcttctgggctggacgcaattgctcatgcctgtattcccagcactttgggaggctgaggtgggtggactacctgaggtcaggagttcgagaccagcctggccaacgtggtgaaaccctgtctctactaaaaatacaaaaaattagctgggcgtggtggtggatgcctgtaatcccagctactcgggaggctgaattaggagaattgcttgaacctgcaaggcggaggttgccgtgagctgagattaccccattgcattccaccctggccaacaagagtgaaactccatctcaaaaagaataataataaataaaaagagcaatcttttatacgactttatacataaatctccaaaatacagtgccaaattatctttgttaattgtcacttggaacagcactaatgactattcccttaacatttttggttctccttgagggtatatgatgtaattgtatttctcccctttgaagcatgaccacttgactgactttggccagtggcatgtgagtggaaatgttactgtcacttttggtcagaagccattattaagtctgtgtataacttcccacatttcccttcccccatccatggtaactggcaatatctcaggtgataaagatcctgtcaccttgaataaggatggtgtaagaagcttccataaagttatctctttatagacatgtaatgtgaataagaaataaaccttcattttaagccactgagcttttaaaattgttactccagtataacttgatttatcctaacatgtaagtattaaagtataatagctctcaaacaactgtgattagctttttacaacataagaagacaatatgggctgggtgcagtggctcacacctgtaatcccagcactttgggaggccaatgtttgcggataacatgaggccaggagttcgagagcagcctgggcaacataatgaaaccccgtctctactaaaaatacaaaaattagccaggcgtggtggcacacgcctgtagtcccagctactcaggaggccaaggcaggagaatcgcttgaacctaggaggcagaggttgcagtgagccaagattgcgccattgcgctccagcctgggtgactgagcgagactccatctcaaaaaaaaaaaaaaaaaaaaaaagactgtgtaagaaacacagtggtctggtaggaagacagacatttaataaactcaacacttactcctatttaagatacttagagtagaataatgctttaatagactgtttcagttgtatgcataatgttgaaatgtttcagtttaaaatcaagagcactgttttgaaagttttgactagtgctttagatataaaatataaatgaaagttaagcattggaaatggaatatgttttttgccactgatggggttctctagaatagtcaaatttaaaaaattaatagtctattaaaagtgactgaatttaagcatataaaatatagcaattagtagttagaaaatgagatttttaacataaaaaaatctaggtctagtcttaagtgtggcatacatcatactttgaaatctgaaagaagaccttgaggaaagagtattcccttgttgaagaagataagaattgtcctgtgattcccaaaataatatataggtttggtgtcatttaattcaaaatcagtagtatattagtgggaatgagtttttaatttttaatttattgagctgtaattgcttacaataaaacatagtttgaattttgacagtgcacttactggtgtaacccacaccttaatcaagatacaaagaccgtttctctcaccttagaagtcattttggcagcctggcgcggtggctcacgcctgtaatcccagcactttgggaggccaaggcgggtggatcacaaggtcaggagatcgagaccatcctggttaacacagtgaaaccctgtctctactgaaaatacaaaaattagccaggcgtggtggtgggcgcctgtagtcccagctactcgggaggctgaggcaggagaagggcgtgaaccagggaggtggagcttgcagtgagccgagattgtgccactgcactccagcctgggtgacagggcgaaactccatctcaagaaaaaaaaaaaagtcattttggctgggcacagtggcttgtgcctgtaatcccagcacttggggaggccgaggcggacggatcacaaggtcgggaattcgacatgagcctggcaaacctggtgaaaccccgtctactaaaaatacaaaaattagtcagacgtggtggcaggcgcctgtaatcccagctacttggaagctgaggcaggagaattacttgaacctcagaggcagaggttgcagtgagttgaaatcgtgccactgcacactagcctgggcaaaagagtgagactccgtctcgggggaaaaaaaaagaagtcattttatgccacttgccaatcactcccacccagcaatagccactgaactgatttctgttctcatagattattttcccgtttttttcaacttcatgtgaatgaaatcatatagtatgaacttttttgtgactgacatttttggcttgaaataatttcaaaaaatttcaaaaagttttgagatatatttgttgttgcatatatcagtagtttatttactgaagaatattccattgtacacatttttctgttgatgggttgtttctaatgggtaaatacactcactccatccctcagtatctgtgggggactggttccaggacctcccttgcataccaaaatttgcagatgctctagtctctgatacaatatgacgtagtatttgcccatgcacatcctcccatatactttaaatcatcatctttagattacttacgtagtgtaaatgctgtgtaaatagttgtttatattgtgctcagggaataatagcaagaaaaaaatgtctgtacatgttcagtacaggcgtattttttctccaaatgttttcaatctggttggttgaatccgcggatgcagaatacacagatacaggccgggcgcggtggctcacgcctgtaatcccagcactttgggaggcagaggtgggcggatcacgaggtcaggagatcgagaccatcctggttaacacgctgaaaccctgtctgcactaaaaaaagtacaaaaaaattagtcaggcattgtggtgggcgcctgtagtcccagctactcgggaggctgaggcagtagaatggcatgaacccaggaggcggagcttgcagtgagccgagattgagccactgcactctagcctgggcgacagagcgagactccgtctcaaaaaaaaaaaagaatacacagatacagcaggccaactgtacttaagagtggaattgccagattgtaagataggtgccaaagtgactaaaccacttgaaactggtgcaagtgacttttgacaattactctcggtttcttcttgaaaaatagagatggaattcgtattctcttcagaatatggtaagatgtttcagttaatactctttagacaccactctaatatatggattgagagctaatgtgtgaaatacataaatacacatattgggtgcgtttactcttttggatggggaacttgattaaaagtgttaaaggtcacactctaggtggagggaggagtcgtgcatatatattatagtagtgtaagttttctttgatactataaatcttcacatagactacagtgtgtggttaagaaggaaactagtggaaattcatatgtgtctctgtttctagaacactaaaggatatgtgaagttttgtgtatttgctaattggctggctgcttccttttcaaaagttgactatagattatacccaggcatggctgccttgtaccacttagcccttgaaaaagttttgtctcgcagctttcttccagagcaacttttaaaaatactactccatttagattttcttcaaatgaaaattctttatgtgttctaattttttctgaatggacttgccctgtttcttgttactcatgcacttaatctgctggactagttgtagttgcatggtatgctaaatgagttgttttggaaacttcattccttgtgaatgctcttttgagtagttaaatataaaaagagggaatggttcttagcacaaaccacagattcttgaacgagtcatttagatcattcctacgtatgtggaaaaattacatcaccacccagtgttgcgctttctatttatactatactaccttaaaataatccatttaaaaaaaataaaaaatccatcttgtctttataaaaacagtataaagcaggcagcaaatgaatctcatggtaaggtatttcagaaaatgctatgaaatgaagcatcttagctaactaatggtttatctttagatttctagagagacttaaaagatgtgggcataccttcctgccttttcatttatgccattctcttgatacattcatgtatgttaataaaaatattgcaagttattgatgacatttgttgattttttttagcttaaaatttagtaactctgggtttgaaggccacggttatttttgttctatgcatgtttgtgtttttattttgccaaataggaaagttagattgtcttttctgtctttggacataagtgcatgggaacaccatggtatcactttaattggtggatgctattaaagggactaaattctgtctaaaaataccatgctggtgtttatgataaatttaatgaaaagagcttgtcatgaaacaggcacagtatctaaattttaggaaaacgtaggtgcatacatatgaacgaaaaacacagagcatatatgaaaatatagtggtcattgggtattgggaatgcaggtaatttttttctaacgtatcttttagtgagcaaatattttgtaaaaaggaagaaaaattgatctctttagtgtgatctctttgagacatgggcttgttggtgaatagtactcactgcacagtggtttggtaaggtttcagtgcacaatgacaatttatgatacttttaagtatctttttaaaatctgcataattcaaactgcttcctaagtttagtgatgtttattatgaggaagaggaaacagataaatccttgtaatgccatccatctaacgcttttctccttgtttcgggccacctgctcaatgtgtgatgtattaaaattgccttctaacttactgtcctgcttctgccttccttgcgtgttctccttgcatacagggatggcacatgggaactctgcctctaatctcaatccctttgtaatgtggacacatggtagtccaactgataatccgcttttaccttggtgattcagttgtttaaagaaaagtttttctgttgtgcatggtggcccacccctgtaatcccagcacttggggaggccgaggtgagtggatcacttgagcctaggggttcacgactagcctgggcaacatggcaaaaccccatctctacaagaaatacaaaaattagccaggcaggcagtggtggtgcatatctgtagctgctcaggaggctaaggtggaagtattgcttgagccccagaggcaaaagctgcagtaagccaaaattgcaccactgtactcaaacctgggcaacagagtgagaccctgtctgaaaaaaaggaaaagaaaaaagaaaaattttgtcagaggcttcagaaatgaatcattctcttgagcatttgcttactttagacagggtctccctcacctaggctggagtgcagtggtgtaatcatggctccctgcagcctcaacctcctgggctcaggtgatcctcccacctcagcctccctacaggcacatgccaccacgcccagctaatttgtttttgtatttttttgtagagacagggtttcaccatgttgcccaggctggtcttgaactcctgggctcatgtgattttcctgcttaagcctcccaaagtgctaagattacaggtgtgaaccaccatgcccagcctttttttaaatctatcactaagattatatgatcactatactctggttgtttatgagcatttaaattaatttttatataaaaaattaaaaagttagcatagtctaggtggaattccttccgttttctctgttctttgctgtcctcctgatcaaatacttagcggagcacttggaagcttttaaagtcttctatggagattaatttttgtttgtttgtttgttttgttttgttttttttttgagatggagtttcactcttgttaccctcttgttgcgatctcagttcaccacagcctccacctcccaggttcaagcagttctcctgccttagcctcctgagtagctgggattacaggcatgtgccaccacgcccagctattttgtatttttagtagagacagggtttctccatgttggtcaggctgatctcaaattcccaaccaggtgacagcccgcctggacctcgcaaagtgctgggattacaggcatgtgccaccatgaccaactaattttgtatttttagtagagacggggtttctccatcttggtcaggctggtctcaaactcctgacctcaggtgatccgcctgcctcggcctcccaaagtgctgggattacaggcctgagccaccacacccggctggagattaatgttttaaactgatgcgtctcccttatcatccccacaaaaaaggagaaactcagaatatttgctatctttctaattttcatagcagtaaatagtgaatattgagcacttagtactactttttaagcactttacatgcactgtacatgggtattataatagcttagtctttataatctttaaaatatgaggttaaagagaattttagagctgaggtaataaagacatagaaatgaagtaatattccaaggctaagcagcaaagggcagagttcacacccctgactattatattaattgactgctagtaccgtaacttctaattgctacagtaactggtttctgccgtttgtttctttctgtttgctgtgtatacacaaagatgaaatggtctggttccttcctactttcagcttcatcacacttcactgaaaaaggtcatgttttacaattggagtgtagaacaaactctgatgtgcgtttcagttctagctatgtgatcttaggctagttaatcttatttgtaaagtggcaataaaattggtacctacctttataaggctgtgaagattaagtgagaacatttacaaaagggcacagtgagtagtatgtgttaagtattcagtgttaacttttgtctactctgaaggtattgccagacattgagctttctcaccaaaacagtaataataaggtttacttgtgtctgcttttattggacatgatatatttagatgctgcctctttgcttaaagagaaaagtttgcctaccaggctttcttctcacggattctaggcttgaggtttattctgtataaattatttggccaggtatgtttttcatcagattgttactttgaaacagaagcttaggcttattttctgcgaagcatttcccacgcaaacttagtgacattttaatatgaaattatttgcattaataccattctaaaaaatgttttctctttttttcccatgcctattgcaaattttgtgcaaaatctggttcttaatcattattacattggtttacctttgcatcacatatgaatagctgtactttgctacttttgactaatactttttcttccaagagttagaatatcatagcataatgtttcaagaggattattgttagattggcacaatagttaaaggaatgctttaggacaaatgtctgaaatgtgatatttaagcttggtcctagatgtccatgttgagatttcctgggaataaaatggcttagttgggcattggacagtgtagttaagtaaaccctatcttgacaaaatgattcagatatgtgcttatattcttaggtgaccgggttattgatgtgggatctgaatggcgaactttcagcaatgacaaagcaacaaaagatccatctcgagttggagattctcagaatcctcttctgagtgatggagatttgtctaccatgattggcaaggtaataagtccatttggcaggaaataccaattgcagagtgaccatagacctgagagtttgggaactttgcaaaagtatcagtcactgcaccagtggggaatcttgacctgtctaataagatttgccagtaatatcattgtgaatgatggctaacttgtgtgtgtattccatcttaaagtggggaagaccattaaatcaaaattataaagcctttatatcaggccttttttcataaatgacattttctgtacacacaaaaaatgagtgtagtgtggccttcatgagttaatattgatatgttctttgaatatcaagaatgtcttctcagctgggcatcatggctcacacctgtgatcccagcactttgggaggccaaggcaggcggatcacaaggtcaggagttcgggaccagcctggcaaatatggtgaaaccccatctctactacaaaaaaaaaggaaaatagaaaaattagccaggcttggtggcgggcacctgtagtcccagcttactcgcgaggctgaggcagaagaattgcttgaacccaggaggcggaggttgcagtgagccaagatcgcgccactgaactccagcctgggcaacagagtgagactctgtctcaaaaaaaaagaaaagaatgtcttctcttttctctctataccacttaagataaatgggaggttagtgtaacctcttttctgatattagtgaatttatgacttacctaactttacattccttatctgtaaaatgagaataagagtacttatagagtttttgagggtttcatgagaatgtatgtaaagtatttatataacatgtattgtatactgtgtgctcagtcagtggtagctgctatcattgtgtaaggcaatagtatagttttcttggcagcctgattctcactctgttatccgagttggaagtaatagtgacggtattactgagggctaatcaaggaagtatacaccattttataacttcatgtatactattgcatagtctcttttttttttttttccaaaaaagtcttgtttaaaatctgtctggctgggcacagtggctcatgcctgtaatcccagcactttgggaggccgaggtgggtggagatcaggagttcaagaccagcttggccaagatggcgaaaccccgtctctactaaaaatacaaaaagtagctgggcatgatatgatggtgggcacctgtaatcccagctactcaggagcctgaggcaaataattgcttgaaccccgggaggcggaggttgcagtgagctgagatcgcgcgactgcactccagcctgggcaacagagtgacactcttgtccaggcaggtcttgaactcctggtcttcagcagtcctcccgcctcaggcacccaaagtgctgggattacaggcatgagtttaccatgccgaaccctgtatagtctgttttgtttttgagacgttctaacactgtcgctaaggtgggagtgcagcagtagcttgatctcgtctcactgcaacctccacctcccaggctgaagcgatccttccacttcagcctcccaagtaactgggaccacaggtgtgggccacgacacatggctaatttttgtattttttgtagagacaaagtttcgccatgttgcccaggcttgtcccaattcttgggctcaagtgatccacccacctcggcctcccaaggtgctggaattacaggtgtgatccaccatccctgggcaagatagaaatatttttaagctgctagatttatcacataataaatttctatgtgtacttgggcatatttctcaactttctatcttttcctgtcctggtccagttagtcaaatgccatacaacactgttttagtatttagtagcactagttttccctcattgctctttttcagcattttcttcgctagtcttttccatttaaaggttaagtttgtttcattttttaaaaaaatttaggtttgttcacttgcattttttgtacctttggagttgattaaatgattttcctcttcagctctattaatatgatgttttatgttattagattctttaatatatttgtggaacagtctccacttggttgatattactgccttttaataccctgttggattctgtttcctgtggggttttttggttttcttcttttgagacagggtctctttctgtcacccagtctagagtgaagtgatgtaatcatagctaactgcagcctcaaactcccaggcttaggtaaccctcctgcctcagcctcctgagtagctgagaccacaggcgtgtgccatcacactcggcctgttttgttttgttttgtttgagacagagtttcgcgcttgtcacccaggctggagtgcaatggcacgatctctgctcactgcaacctccgcctcccaggttcaagcgattctcctgcctcagcctcccaagcagctgggattgcaggcatgtgccaccacgcctggctaattttgtacttttagtagaggtagggtttctccgtgatcatcaggctggtctcacactcccgacctcaggtgatccgcctgcctcagcctcctaaagtgccaggattacaggcatgggccactgcgcctggcctgttttttaatatttaatattctcactggggttttggtcagattcatttgcaaattgacacagggaaaattggcttcttcataataaatcttgtattcaaaaattcataatgcctttccatttccttaggtatcttatgtgtccttcaggagatgtttgaaagttttcttcatgaacgtctcacatgtttctcaagtttatttcaagatttttgttgttgttttaattgaaaaatttgctttccttgtcttttaagttggttgattgtacttatgaagggtattgatttctatttatcttgaccttgctgctttaatgaattatttatagcagctgttttttagtgattttcttgcatattccaggtgtataaaggtactatctgcaaatagtttatcacatcctttccaattttgtacttccggtttttctcttgcttaatactattggctagtttttccaatcagtgttacaaaatggtagcagtaggaggtacctttgtcttgtgattttggtgataatgctggtaatgtttctccattaatcatagtactttctttgggcagaggagagtggttttctaatgtaaagaagtactcatttgtagcgtcctatgagtttttatcaaagacgaattttgattttgttcatttgcctttttagcgtctttggagatgatcatgatttttcttcttacatctattaatataatgttttacattatttgattctctaatatcttgtggaacaatctctagttggtcatgatatactaccttttaatatgctgttggattctgttttctagtatttaatattttttatcatatttctaagtgaaattagactgtttctttttccattgttttgtcaggtgtttgtatcatatttctatttatacactttaagcttcctattttctatgttcttgaacagttgttagaattacatgttcatttagtatagatgagcaggatgcacaattcagatttctggtctatgtagaatcagatcttgtaagctatattttcatagaaattgtccatttttcatgctttccaaaaaattttttcatagttataaaactgttttatagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgtaagttcttgtctacctcctttaagccattctggcattgactttgcataatttaatgaacacatgaaattttgatattgcagctaattaaatgacgtagagttaaacttagtttctctgctttgaaggatcgaacaaataatttattcaagcaagtatatgaacagaagagcctgaagggaagagctaatgatgctatagcttctgcttgtctctatattgcctgtagacaagaaggggttcctaggacatttaaaggtaagtttttagctttgtttttttgtgtttgtttgtttgtttgtttgagatagggtctcactttgtcgcccaggccagagtgcagtggcgcaatcttgactcactgcaacctctgcctcccaggttcaagctatactcctgcctcagcctcctgagtagctgggattacaggcatgtgccaccacacctggttaacttttgtatttttagtagagacagggtttcgccatgttggccaggctggtctcaaacttctgacctcaggtgatctgcccactttggcctcccaaagtgctagaattaacaggcgtgaggcactgtgcccatcctaaaataacattttctacatcatattaaagaaacagaccaatgtcaggcagctttgacacttagaagctaagtcatctttattgtgactacagtaatccacttgagcatcatttgccaatgcctacttatttcattccttgacagcaaattcatagcatgttcttttaggctgttttcccatgtagactcattttagtccacgtaagcccactatgttcttttctagtgagatcttttgatggactgttgctttgtgggctttcagaaggcctataatcgtaaaccaaagtaggccgtttatacatttggtttacatggaaacagtttccatttctagcactggtctctgtagatgagggagtcaagctttagaaagtatcagtgaaggccaggtatggtgtctcacacctgtaatcccagaactttgggaggccgaggtggttgggtcatgaggccaggagttcaagaccagcctggccaatatggtgaaaccccgtctctactaaaaatacaaaaattagccaggcgtggtggtgcgcgcctgtagtcccagctactcaggaggctgaggcagaagaatcgcttgaaaccgggaggcagaggttgcagtgagccgagatcacgccactacactccagcctgggcgacagagtgagacttcatctcaaaaaaaaaaaaaaaaaagttatcagttaagttttttctcttgaggtgtattgtttgcacttttacacttcagttaagaactggtatttttcatttagtttgcagttacatgtgaatatgtgataatttgttcagtgttgctcactgacttccactaccaaagctcagtttagctgaagactatacttaaccctttattcatccagtgagtatttattttttatgttttcttacgtaaaagtgaagaggtgatggcctttatcatcatcttttttgttgtttttataactaaaacaacttttgttaaatttcttctgaaagtgtgtggtggttgcatctgggaatagcagggtcagatattttatctcattgagctacagcccataatcgcagggatttcatgcacacatgacattgtgttgcctaagaggcatcctttagcttgagtattttctttcaattccttggtaacactgcttacaacagattaatacataaacatcaaagaatttttcatttaaagaaatttagttgtatgaattaatccttagagcagttaatattttgaaagattaagacctaaatttagccaggcacgatggctcacaccggtaatctcagcactttgtgaggccgaggcaggtagatcacgaggtcaggagttcaagaccagcctggccaagatggtgaaaccccatctctactaaaaatacaaaaaattagccgggtgtggtggcaggcgcctgtaatcccaactactcgggtggcaggagaatcgcttgaacccagggggcagaggttgcagtgagccaagatggtgtcactgcactccagtctggacgacagagtgaaatttcatctcaaaaaacaaaaaaactctaaattgaaagagtgaagaacattaggccaggcgcagtggctcatgcctgtaatctcagcactttgggaggccgaggtaggaggatcacctgaggtcaggagttctagacaggcctggccaacatggtgaaaccccatctctactaaaaatacaaaagttagccaggtgtggtggtgcacgcctgtagtcccagctactcgggaggctgaggcaggagaatcacttgagcctaggaggtggaggttgcagtgagctgagatcatgccactacccttagtctgggcgacagagtgagacttcatctcaaaaaaaaaaaaaaaaaaaaaaggtgtgatgaacattaaagttaactgagaaatttgcagttaactctgtgggaagtatcactgagatgattagggtttcatctttaaggtatgattgaatgttttacaattagaatgtatattatgtttataattagaaatggtagattttaagatgaactatatggcttaagtgaattgatttatttaattttttttcttttagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaaggtagggttcgtcatcaggaagtgtggcagtaaactgaaatttgcagcatgtgattgtttttccattttaagtctgaaccgggtaaatagcaagaaacccacatttgaccaggcgcgggggctcacacctataatctcagcactttggaaggccgaggcgggaggatcacctaaggtcaggagttcgagaccagcctgatcaacatggtgaaaccccatctctactaaaaatacaaaaattagctgggtgtggtggtggggcttgtaatcccagctattcaggaggctgaggcaggagaattgcttgaacctgggaggtggaggttacagcgagctgagattgtgccattgcactccagcctgggcaacagagcaagactccatctcaaaaaaaaaaaaaaaacccacgtttaagacatcattcctcaacgtcaaaatgttaagaaaatatgttttgctttttaagcagctcataaaaaaaatgttcagagacataaccctgtgaacaaacctaatttttttcccatttgaattattttagtttgtacatcttttattcttacaagttcttttttctccctgaatatattcctcctgatcattttgaatactcttttcctttccaaacttacctttttaaatcttaggggtcagggaggccatgctttgtttctcactgcttggcatgggattctacagatagacacactgtaaaatacgtgttggccatcagcctttaacattctgtgaaggttggtttttttcccattttgcacagtattttacagtttcttaatacaaattctgaaataagtagatgtaagtaattcagccttctaaagctatgtttaaatttagtgttgtaggaaaactttcaccagaagtattaagtgaatttcttttcctttttttttttttttttttttttttttttttggttttgaaacagtctccctctgttgcgcaggctggaggtacagtggcacaatctcagcttactgcaacctccacctcccggacaagctattctcatgcctcagcttcctgagtaactgggactacagccacgtgccaccacgcccagctaatatttgtatttttagtagagatggggtttcaccatgttgggcaggcttgtctcgaactcctggcctcatgtgattcgcctgcctccacctcccagtgtgctgggattataggcacaagccaccacacatggcccactaactcccttttaaagttagaagtgactactcctttctaagtctttgaggattacagaagttattcatgaacaaatgcatgtaaagaaattcataaactaggtgcggtgaccagcctcctggccaacatggcaaaaccctgtctctactaaaaacacaaaaaaattagtcgggtgtggtggcacatatctgaatcccatttagtagggaggctgaagtaggagaatcacttgaacctaggaggcagaggttgtagtgagctgagatcatgccactgccctccagcctgggttgatggagtgaggctctttttcaaaaaaaagaaaagttggtggcaggtcgcggtggctcacctgtgtaatcccagcactttgggaggccaaggtgagtggattgcttgaggccagcagttcaagaccagcctggccaacatggcaaaaccccatctctactaaaaatacaaaaatcagcccagcatggtggtgcacacctgtagtcccagctactcgggaggctaagagacaagaatctcttgaacttgggaggcagaggttgcggtgagcctagattgcaccactgtactccagtctgggagacaggactgtctcaaaaaaaaaaaaaaaaaacaaaaacagaaagtgaattactggcctcaataactttgtaatactttattcacaacagccttcagcttaggctatatgttgaaaaaagtaataaatgataggaataattagagaaagaaagccaatcattagttatttgaaggagccattatccattccctttggccttcactcacgttttaaggaaattttgagtcttttagtaaaattgagaagttgcagctaggcagtttgtccttgaggtacattcctagttgtaaagtttattctaatgaacaacatgaaaacattaatcttgttgctttctgctttttggctttatatgtaaagtcttcttcaaatgtaaggtctttctcttccctgcacagcaggcagttgacattcaaatagttggcatttattggtatttagatgtagaataatgtaatgcagtgtgagatacggaaatttaaaattagctaattgtacaatgatggcaggcattcacagtgaaaatcactaaaacctcactgatttgaatcaactgaaaaggtagtaaaatgaatttgtattaaaaggtgtttaggccaggcgtggtggctcatgactgtaatcccagcattttgggaggctgaggcaggtggatcaccttaggtgaggagtttgagaccagcctgggcagcatggtgaaaccctgcctctgctaaaaatacaaaaattagctgggcatggtggcaggtgcctcagctactcaggaggctgaggcaggagaattgcttgaaccggggaggcagaggttgtagtgagccgagatcttgccattgcactccagcctgggtgacagagcaagattccatctctaaataaataaataaatgatgcttaaaaatccattttaataaagcattcataatacttaaccaaacattgtagtggcagtcctttagtatttcttttaatgactttgaaaggaaaaaagggacagcgactttaaagggtaaaagtggatctgttaggattctgtacaatgttcgtttgagctcaaaatatttaagtatgtgcttgtatcagtgaaaaacatctccgtatgctataataagtagctgtttgatctctgatgtattaagtagaaaaaaagattgtagaacaatatttatagtatcacattttgtttttaataaggaccccttaacagaagttagctaggggagattttgcatgggagctttcaaacacagaaatataaagtgaatttctttacaagaacatatttgtggagtacttttgtgatcctcagaaagatttataaagaaaaaggaggagtcagttgtaaatacaatacccagtataagatgataacactcctaatactaagacctgaacactattcatatattttatgttagttaaaccctttaaaacattgacaaccctgtaaggtagtaagtactagtaatcatttttattgttgcttgttactgactttagctcccactttttttttgagacagtatttggttaagtattatgaatgctttattaaaatggatttttaaacatcatttattaatttatttagagatggaatcttgctctctcgccaggctggagtgcagtggtgcgatctcggctcactgcaacctcctcctcctgggttcaagcgattctcctgcctcagcctcctgagtagctgggactacaggcgcatgccaccacgcctggctaattttttgtatttttagtagagatggggtttcaccatgttggccaggatggtctcgatctcctgacctggtgatccacccgcctcggcctcccaaagtgctgggattacaggcatgagccactgcgcccggcctagctcccgctttctaccttttagtatgtatttctattatcagtttttagaaatcacttctggttttgtttttaagtttggcactttatactatcatatctcacaaattacaatgcaggtagtggaaaggaggtaggatggaaatgatggttaatgtttcgatttttgtcttttagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtatgtgattttcttagtgagcttattgagcagagaatatgatgctgataaaagcagcagtagaacaacagattttaatttttgggtgttaaaatcttatgttatagaatctgcatatccctggttcttttttcttctttgttaggcttactggtgtactcatagactaaagagcatttcatttatttattatctattattttttgatacagagtcttgctctgttgcctaggctggagtccagtggcacaatctcagctcactgcaacctctgccccacctccagggttcaagcgattctcctgcctcagcctcctgagtagctaggattacaggtgcccactactaggcccagctaattttttttgtatttttagtagagacagggtttcgccatgttggccaggctggtttagaactcctgacctcaagtgatccacctgccttggcctcccacagtgctgggattagaggcgtgagcccccatctggcctaaagagcactttaaatgaagattactgggcctgggattgtccagtagttgtttttaactagcatcctttacgtgattgtgatgtgttagatgttttgcctatgactctttaaggaacaatgatttagggtcatttgacttctactcactataagagaagaccagcaacattttgctctttgatcaggtagtttttacaggggacttgaattcatactagacatcaccactgttcactgctctggaaacaggtgtcacagttctgaaacatctgaaaagaggttagcactagactagaaagacaatctcctgttgtggcctggtgggcagggtcagactggttcatagagggactttcccaagagcagacctccactgccattctgctgaccatggagcagggataagtattggcaccatgaagacaagtggtatttttcccttgaacaaaacataggacactcacccagtattgctcagagctaggggagaacaccggaaaaataatccagtcagggagaacctgtcccacccagcgtgagacctaggaagaaggaagcttcagtctatctcccttctggacggcatctttgatctctagcatcacacatctccacatacggactaaggagcaggggtgctttctagtgttccccaggttctagtgactagccacaaagttccccattcagtgaccactgcagttatcaaaggttatttttgcacttagtaaaggtcagtacctacagattacagaaaattaggaaaatacataagtcacccggaaataacgagtattttggtggcttttttcttttcttttcttttctttttttttttgagacggggtttcactctgtagcccaggcaggagtgcagtgacaggatcttggctcactgcaacctctgcctctcgggttcaagtgattctcctgcctcagcctcccagtacttttttttttttttttttcatttcagcttcttgctgtgcttattttaagagaaagattctcactttgtcagccaagctggagtgcagtggcatgatcatacctcactgtaacctcaaactcggggtgaactgatcctcctcagcttcccaagtagctaaaactacaggttcaggacaccatacccagctaattttttctttttttgtagagacatgtctcagtatgttgctcaggctggtctgaaactcctggcctcaagtaa

SEQ ID NO: 13880 - DNA, 174030 bp, Human
  misc_feature (1)...(174030): n = A,T,C or G
gttcaagtgttgattgaattctcaaagagcgacttaaaaaggataggtgcataagaacaagataaacaatctggctctaatataaacaaggattacattacaccaaaattgttgagagaagattttgtactcagtattttattcagcagaacattttttataacaataaggttgattagagcaagctctgaaaatgcttcaagttagacagtctgattgtttatttcaaggataaaaaaataaagtggtaaaatagggggatacgaagaagtagaaattgaaaccaggacctagcgaagagtatttgacatcattttcctctctaggttgaatctcattcaggatttttccttaccccgtagggttttggctttttaaccatgagtatcttgtttttaggggcttagggccatcctagacccacagcagatttaaagtgctctgatggtgtatttgtctggtgtttcattttaaccaagtaagtagctctctgtaagatctttgtctaccttcttggtagtaccaggaagctacagggagatcacatctggcccttgcagtttagtattagttagcatgtcccctttctgacctctctgctttttggggtgggtctgctcatggaggaggctctgtaggggcagcttctgcctgctttgtttcggcgccttctattttcacaggctgagaagctggagcaagcgcgcagtgctgcaaatgagctgccgagaggcattcagccttgtcacttggcagagtagctgggttcagggtatatttggagcgggggtagggggcacaaaaagggtacatggttttgctttactgtttattcctgctcaaaggagggtgggggcaagtgaaaaagacatgtcttcatcatcgtattacttgatggtgactagaagtgcgggctgtacacagcattctcttccaaatggggattttggaaacagcgttgaggaggactgatatgcaaaagcttatggttgtgctctctgtcagccccaaatatttactgaagctgggagaagaaaaggcagactttctttttttctctcccaaacgtgtgattgtttagaactcaagtgcaacatctggaagtcagatatacagagaacaatttatggagtgtgagagatttgaaatattcagtgtcttttagtgggaactcaactttctggggctgcttttttttttttttttaacccagcacaaagcaggcaattctgagatctcctttgcctctctgaattaaaccctttgtgcctgggtcccataaacaatgtgctttttaaaggggagccccctcccagctccggcctttttctccagcgtgggcagccaatcagctgcgcagagctgcatagctggaccgctttccattctgagtagcaacaacgtactaatttgatgcacacatggatgcctcgcgcactctgcaaattcatcacccgcatcttgcattagtcatctgacggactgccaagtgtttcattttctttccatgtgactttattattaccacctctctcctctcttccaaaaacctcccaaaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggtacagagcgcggggcgggggtcgccaggcgtccaggtgggcgtcgcggggcactggggctgtccgagcccccagcctgcaggaggaagggcgggtaggcaggagggctggaagcagccggtgctggcggcccctgtgctccaggggctgctcccgactcctccccgcacccccgcccgcctgcccgccgggacaggttggaggcgggagagagggaccgaggcagggcgggagcgcagaggctcggtccaggcgcgtgatcgctcccgggaggtcactttctaggcagcccagcctgtgcttgggcggggtggttgcttctccgaggaatcgcgtttcccagccttgtatttcaggacctaactcttcccacccctacgttcctaggcttgcccatgtaattacaattgcatttcacttttccatagcctgtggggacctctaggtagcttataaacagttgacgtgatgccactggtgcgagggagaaaaggctcccctgaagaagggacacccattcctgggggtcaggtggggaccgtgaggtgaatctgccttttggagctgggagcagcaccctagtggcctgacatagttaggacaccttcacaaatgcttgagggttacgcccttatcagtgtggagatgaaggtataggatctggtagttgttactgcctccattttaagatgacggtgatggggggcagtgggtgccattaatgagatagagacccagaaaccattgtgaggagtgtgatgcttctatgccctggagtcttactttgtaagctctttgcagactgaatttaaaatatctactctgctgctaccacttggtctctgttgctgttttaacgtttttgctttagtaattttttcttctttctctgttgttgatctctcagtctctctactgaggagtcctctctgttgttctgcgggcctcacagtttcttttgctctgtgccttggtgtttctgtctggcatgttattttatttctatattgcttctcctaagacctctgaaagcatcacttggcttgtgtatacacttcggttgggcacacgaacatattggcacatacttttctctaacccttttccttactggcaaggtgaaatgatagaactaggaaatctttaagactgacattctgtgactccgagaaattttgggctgttcctcttgttccctgttgttgccagggtctggcagggctttggaagcctcttaaggaactgaagagcccctggccagtactcgttttagaaaggtggacatgcgtgtcttcggagtgtgttcataacactctagttttccaaacgtagtagcaaggttgtttcaaaaagcacatagaatgttgtcaccacaaacttgattgcctcattatttgagacgtagaaagatcagataactgagaatctgtagatttttaaacttcacaaatgagcgcaatattaaatacctttattggacatattctgatactggttacctacatgttttccaaatggagaagactagagtttgttttaatacttccatggtatgctattgaggaaagacaataggctagagctaaaaaaattaataaatttaaaaatcaccaaataagggctctctcaccagccagactgtcacctagggaaaactagaccagaggcagtaaactatgctttagagaaataaccacaattcatccttgacaaggaaaatgcgactccaaattttggtttatcagcatttttaaaagttacctttgacataatggtcagagctcacttactgttatgatgcctggttccgggactttcagccatggaatacatgtatcttaccttggccaaaaagtcctttttcccagtcaggtaagtacctatgtgtggcctagttattctcccattgtctctctcttgcccagatgttcctatgagcagcattttttaccagcctatatttgatactatacattttgttaacttctgttcactgtgcctgattactaatttggcgaaaatagtttgcagaagcccgtggggctgcagaagaagggaggcctgatgagggaagtttttttgagcacgtgctatgtatctcagaccctgtgtcaggagctttacatgtgtcctcattttgtccttaccaaaatccagaaggtaggtggtggtagtcacattttacagatgaggaaactgaggcttataagaagttaagaaacatagccccgtttgcccagctgttaagtgacagagtggagattcggacatggtccatctgtcttcatggactacaccattttgcgtctccatgagatgagatggcagagtagccctggtgtgctgtgtttcagggcctgggtcaggggcagtctcctttacttaagtgttccccaagtgaaaggaagaaatttcattcttgaagaatgagttgatttcatttctgtctttgtgtttagtttttatactcaggtgtttagattgtacatcattcccaccccatgatatcatggggtaggagttagagatgaaatcattcaaatcttacctttggaaatacaggtcaattcccattactgtgaactccaagtctcacatcaaatattccttaaagtatgtgggctgtcagccaaagcttgaaagagcttttgttatacagacatctctgttgtgaaggtatttgttgtgatgggatttgagctgtataatgacattgctctcagaggattacagcccttagccgcttacctagagagagcaacagcccccactttattcatgttgatacctatgcatgccattattattttgcctgtttacatgtaaaataagacctcacatttactttgattcagactttgtcggcagagtacaattatcatgttttcacagggctgatatcagagcctcagaaactagaattactggaggtggtttgggttatgtgagtgaggcttttggagaggccttgattcattgccttacccgtgttgatggtcccaggcaaagagacagtcaggctgttacctaataatcctggtgaattagattttccccctcactttccatttcatcttctgtttagtcgtgagacacaaagacttggtcatacttgtgaaatcatcctttcagggttcgagcctgagatacctatattctcactgtaggggcatgtattgaccaagcaggctgagtaactctggggactctggctcagtaaactctctcccacatgaggactttggaaaagtgtgttttattcagggttcatctgtttggtctgtagatggtgagcaataccacagagagttaagaacatggcttctgaaattggagaaccctaaatttaatttctggctctactgcttctttgctacgggccttgggcatgttacttaatcacatcttaaagtggaggcagtccttgtagtgttgctgtgtgatgaggtgatgtgctctccacagagctaggatacagtaggagctggttatggcagtcatgatgatcatagttgttgttattatctccatcaatgtctccaagaacgtaaactctaaaagggacaagaaggcaggtccacaggtaactctcatacaaaagaacatgagctaagagtaaatgagtaagaaagagatgggcttactggaaccatggaagttgagcgaggaaatgaataagtcgcagcttatgggagatgaaaaagatggcatctttaccaaatcttgaaaacagtcttaggatttcagtaaataatgatggtgaacattacaaatggatggactggcctgcttcaggcatgcaggtgcggaagtgcagggcaatttctgggaactgtgaattctcccacagttcagaggaaatgggaaatacgtgacatgaagtagaggaagggaaggccacaaagcctagagctataggctagagcagctcttagcaagccttccttcccaggctgaaggatttaaaattcctttgttagactctcgagactctaggaatattttagcaacaagaggctcagaggctgatgcagtgtgttgacgtgtgttgaggtcaggatgtcgtctgtcatgggaatggaaggggaggctgagggacagacggacagtggaaggaagaggacttgataactaaattgggctcagtgaagaccaggaggctttggcttaactgggaggattgtgagcacagtcagcagtggtgggaatggaggagaagagcattaagttcagttttgattgagttgagtctgcagtgtcacagaagagtcaagaaggatgcaggccaagaaaaaccatgggatttggtgactgggaggacccaagagtatttcagaagaaggatagaggttgtggggaaaggaaatgcatggatgtatacatggtgctgagtgtagatgtgcctttctagtagtctggcatgaagggagaggaagcttagacatgcagtttgtttgttcagcaaatgataagttgtacagcaaaggagattgtcaaagtgtaaggtagagatgactctgcctcaggtctgtgaaagagtggaaagatacttcatttgagacagaggggcattcaggaaggagtaacaacacaaagtttcagaaataggagacacttcgtacaagcgcctgccctcagacttctcagtaaataggaaatttctgaagtcccaatgaattgaagacttaaaaggaatggaaaaggtttgaaatgactgctttgggaaattgaatggaaagagtggtaaaactgttgaagagcagggagaggccggtcacacttagatcatgtccatctggagtgggccctgatggttgtggactgtttatccctgagtgaggaaagatacagagtcatagagaacccagagttggagatgttcaagaaggcatcgtagaaggccaggaagggtagcagatatgctaggaagttctctcggaggtctgaagtaaggaagccggcaatgctgaaagacagctcctggtccaggaggtggaggaggaggagttgaagggttggcagttgatgttcaatgggagaagttggcagatatggaaagtgtgttcaagcgagaccatacttggaacctagaatcagtagataaattatgtgctttggatcatcgctctcgtaatgtgttagttaatcaaagttacaatcccaaatcatagcactctgagaaagcgtgttctataatgaacactttacatttttctaaacttaaatggttaggtactgtcattctgattttatggaagtgaaaaccgagtgatagattaaaatcacttggcatttgagattagaaggtaggaacagcacctcagtcctaaccaaatgtcttgttgatcacattttactggtctcttttggcaacttctcagctcaaagagaaatagaaaagggaagtggcttttgttgactatcactacgtaccaaaggaaaaaacttccttttttcttgcagtatgttgggaggtcatggcataactgctgtgcaactgcatcgcaacagtactgcaagccagagctttctggatggatcagaaattgtattcatggcttctttgggaagagttattaccttaagtttcacaagagcagcttttgtgtgggttagatgctcttgctgtttcagcctcgtcttggtcaggctgcagtgagggttacactggggctggcccgactgatcttcgaataggatgatgagttgtttctttccatcttaaaggctttacttcagccttcaggaagtcgttagtaaaatcttagtttgtctcaatctctctctagttcagtacaatggaaaagtttcttgagaatcagaccagactgctggggaatgaacaggaagaaggaaacaggaacagaagcataaagacaccaaagactaactttacttatttcagaattggcccgaaggtagccctaaatccagaagtttcttctgtgccatggtagagtgagggtaggccctggggaagaggacttagtactggtacttatcatgaccagctcatgcagagaatgagccttgctttctttatccatgcagtagaaataatacccacttcacaagttgctttacatattcactaaggtaacaaatgtgtgagtgctgctggcatggtctaaagcgggttgatcatcttacaaaccatttgtttcttctttaaaatgttaaaggtttgtaaggaatgcctttggccgctttatggaggactggagtggggagggtcattttcatgtttcatgcctttcctttcttcctaaaaacatgtccgaaagttcacttaagtaatagaagtggacctgggagcccgtttatttaagcaatgttatcttgaaatcaggaattgagaaagaattcaaactgcaggaagatgaacctacactacattttaacgcatgcaagtagggaatgggatttctgtcctacatttcttgaaaagcagggttgctgccctagattttctgggacagccccagttttggtgctgcctcagtggcccacaggaagggcatctcatcctgaattaatgttatgttaacagaaggctctgtgttacttactgtgacatcctttcattgttggctgaccgacgacctatgggacaaacataaaatgcagtcagaatttttagattcatgcaagcggaggatccttgtcacatctttgtgaaaggtggcttcactgcctacatcatacagctatattaaaagatataacaattcattttatgaaatgcaattttaaaatatttttactgatactgactctagccattgtgctgattgagataaagccagggacaaaggttaaataagcctcctttaagttacaggaagaaggaatccctttaaatgccccatactctggtgatgccgagactgtgcccgtcggtcacagtgctgaatttctgtgacttctatcaaagggcagcgtctgccctggcagataatacctatcatgggtacgttttgatccttatatctctggagagaaaaggaggaagaaggggaaggagggagacaaaaaagaccgacagagcgagctaatatcaaagaagaaaagaaattactcctggccgcttttaaccattttgttttcttctcttctgtctggggcattaagacttcagctagtccccagtcgtcttttccccagtagctttgcttttctggaattaaagtagcagaagaataaagaaaacaggcgctggatgaaaggagaacagacttctttggtagaaatgtgacatgaaaagaaaacccagggtttctaggcttctgtttcaatccctccagcacgtattgcaggtagattgaaaaagtgaagtctaggtgatctcacaatttgcatttgccactgagtgcatgtctaggctgcctgtctaggctgcctgtctagaagcctcacttgcctttttatttgcagccagcaagaaagagatagctccccactagagatgtcttaccatcagtcacccagttgtaccactctgggctaccataccgtgggggcattaggcaaccagtcctttggaggggacaagtccagtttcctggccagaaggagaggtgttgtcaacagggtgacgctgttagttactctgaaactcacacacattgcctcagagctgccttagcgtgacctacctgcctttccttgctttcgctccagagaccccagataatcaggcattcgggttgaaaggtttacttgctgcctccttcacactctgcttctaatgaaagtttaaaattaaccatagttaagttgtattttagaagtgttcagaattctagcattaattaaaaaatcatgacataccttttgaagaagtttattatcttgaataattccaaccatggtgaaacgtgaaacaccactagcataattagtactgctttttgtatcttatgttagtagattcttaaaagactgaattttcatccttggacatacagccccagattctaacctcatcataatttcactgattctgaggccatccattctcctgcttcattatctaatattgggtgggccaaaccttttacgagaacagctcacaggcatgccagagcgtacagccatgaataagtacagaataatcattatgatcttcgaaaccattggaacctaagaagggctggaaagataattgaccaaaagggaaaaagtggaaactaggctaaaataagatgatttagcgacagattgacataggtttatatattctgaaaatagaaatgatgacgataatgtgttgggttctgagacagtcgggagaattgaagatgttccgacccatactgagaaattccgtggggaatcagtcagacatgaggttatctgagtgatgtatattaggtataatactaaggaaatttgtagtgaactagagctcttacctatgttaaagaatcaaggtcttcaaatatgtcttcaaatgtttctacatttgccttgatgagtctttgttacagagaaaggaatgcaggaaaaaaaggcatgtgtgagctggtggattatgctgtacaggaatttgtcaaagcctgaatcacatagacaaacacacacacacaaatggcaagcagagaagaaagttttgctgtaaatggaaaaaggggctagttagctacactggggaatgctgtaatggtaaagccaatgggtcagacagtggagatggccttggaaacactgcaggaattggtattttggatcagtattcttttcattctctatgtaagtgacagacatgtttctaatccagtatccacattcaggtattaattcacattggagaaacccataagatacactctggacagtgatcagtttgaagaataaaggaatataatttctctatttctactggaagatcataaataggaattagggagaagaattaaagggctgagagaatatttactcaccacactatttaactgacccaccatctgatcattataaaatatgttgggctttattgcttatgtaggacaaattctgcagctttacccgcatgtgggtcaaaacctgtctctttatagtagtcttccagctttgtctgcatttactaagttcatgaattgctgctattttgttgcctttttagcttttggggaaaaaatccttcccaaactactatagtttaatgggaactgcatcctagtcaagtaaagaaataacgcaaacatcagggagggggaggagcagaggaaacaaggccttactcagaattgctatcaattttaatacctccctactaaacattctgtgtaggggatgccttagtaatctgaattttttagaaaggggtgttttttagagagggatatttatgaaagctagtattaacatgtttaaagtctgcccccccgccccaaatgctaaacgttcccagtgatgcaccagacaccaagtgttacggaacaggtaatccaccacttttcacagaaagctttttagctcctaactaggccactgtacctgatattgggaaacgtttttgaaggatatcaaggagatggaggagttccaagggagagcagcatgaatcgcaaaggtccgggaaggtgagcccacatggaaaggtctaggaggttaacttaaaagacctcagagcattgagtcatgagattgaaaagggggaaaggctgtagcaagacattaaaaggagggattgtgttctcaaaaaaaagagagaatatgattgaagttttgaagacgctaaagtgcagagtgaagctatatatagataagttctttcaattaatgctaaaccctgggatactgctgctgatgtttaaaatgttggaacagcaggcaacatgtagagtttgagccaaacttttacagagacgaggtggtgaacttagagcatgttacaaaagttaaggagatggtggggcagctcacccagcagtccccaggagggggcctccggtcagctctcacataggcttaatgcagagcccttttgtaacaatgagttgaggttagggtacccttcaaagccctgggaccgttttaatgttgaactgaatatagaacagaaacgatgaaaaatgtggtgccggcagctgacacagtgtttaccaaagcaccagtcatgtggcagtagatgcttctgggtgcctactgtgtgcaaggcatcattctcagtgctgagaacataaagatgagcaagccatgttctttgccccagaaggagagaaagaattgtctgtagtaaagagaggagagccacaattacctcgaaatgtaaaaccagtttcgggttagccatgtccgttgcacacatgcatgcatgtgtgttcttgtgcgcgtgtgttttctgtttagcagagaatgcgctagagagcgtgatcatcctgtgctattcatataataaagatgaagtgagagaacattagaggaaccaaggccatgtgatggtacacgtctgacgttttttcctttcggttacatgcccgtatctcctctttcccctttttcccctttgtcttcatttggttcccctccctatagggagtttaggacaagaagaggctaaagtttcactgatgagcctttctgagggttctccattaaatccaaggacagaaaatgtacagtcctcttattagcataacgaagccatcagcattgcatcaagcgggtcctcgtacccttttccttgtaatggtgtttggtgtagggtcctgaggaagagctgccagcccctacctgatggatcaaaatccccttggcaccaaagagtgactgatagtgttaaccatcacaggagacatgtatgtatgtgtgtggaactctgacgtgtattttaaactttgcaatagcccaaagttaatttgtttctttgccatttgttttcgaatgggtgtggcattgcttataaaatgttgaatgtaagttgcctaggacagcgcctggcatatggtggaaactgaataaaggctgctaggtagtgtagactagatggactagaaaacagtacagatgcagatgctttcagatgttctctctgccacagagagacctttctgtgtgctttgttcaaagttgacagtgtgagtaaactaccatcaacaaggcgttacttttgggtaattttttcaatgtttatcccagttccttcatccgcttttacatagcctcttgtactgcaagctacactcagttttgaagatggtgggttagcgttagagtggtgttctgtggccagtggaggaggaagcttgctcactttaatgcagaatgtctaagcatcctgcgctaaccattggcaggaaggttatttcagtgagacgctggttccttctcacccctgcacccttcctggaatcaccactggttgcagaagcctatatagggtggctcatttggacgaagtattgttaaggtggttattagaagactcgcaacttagaaaaggaagtaaacatgttaatactagctttcataaatccccctctctaaaaaacacccctttctaaaaaattcacattactaaggcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaagagaaaattaggttattaaaaggaggatatgaaccaaaatgttggcatgaattaagaaaaatcagtgaagaaatgttgcttaatttgtacacttccctgcagtgctggaaatggacttttcctttgcatttccatgagtcagggagaaaacagaccagcctggtttcacgttccagacagcatgaagtacctcaacagcaaagaaggaaataggggccttagtttttaaatcctctgtaagatagtcaaggcttctccagtagaaagttaggttttgtaataagggaccattttgtcctttctgttcaggattcaacaattgcttgttgatttggggtgaagatgccatgaactcaggagcgggtgaggagggcctttctctgcctcccattcccaaagcattctccctaaccccatggtggaggctgcggagagtgttgtaggcagttgcagtgcccgtcactctctgggtgaagccagtatgtcctggtggtggccttagaagacagcccctgtgaggctcagtaagccgcagcctagattggaacagcgtgactgcctggtaggataaaggagacgacatctgaaaagagggtttcaggtgtttgcaaagaggtcagatccctacacatgaaacgctgcggccacagctgcagccatgctacctgccacatgccctggcctgcgtcagcgttatggagtaggcaacctggttcggcgcaaagaggaaatgcgcgttctgtgcccagtcctcgctcccctttgccaaccgggctgctgagtgtgatgctccctttgtgaagtggacatctgtctaatgggaactggacggtgaccaccagtccgttttacacaggccaccatacagctgccaggtggcgctggctcttagctgttctgcaagtccagcacagggtgtattcagctctagaggtggcaaacacggggcccttccaccaggcccactccctgcaaaggaagtgcttccgagagccaaggctttgctctaatctctgtgaaggaagaaaaagacttggggaaaggtaatgaataaattaaagacacacttttgtaatcgtatattttaggctttcctctctacctaattgtgctctaatctgtacttaggagtatagttttttaagtgggacatgtcaggcttttatgccacagattaaactccaaggcaaataaatgtgtgacagcttaagaggcgaaaagaagagtcttcgtcaaatggcagagtttgattgtttaacctagactaatcagtctttggagggcctgccacatgtcttccagacggctagaatgctcaggagataagagtggggcctatcgctctgtggctttctccccctgcattagccgcagagctgagtgagtctatgaaaacccattggtcgggctgccctagcaacacagaatgctgtgctgacacatactccatcacatgtttgcgatgaaaatgctgtatttttagaacacttcaaagtcaggaaaccgttaaaccacactgcatcctctcttgccctctggccacttcctccacacccccaggaacattgcccccatttcacagaaaaggagcctgagacaaagattaagtgatattttaagcaaagctgataatcccagggaaaattgctgatcaagtcttgaaatccaacacatccttcggagtaatttttaatgctttcgcttcttttacctaagccatgtgtgttccatatgaccttaaatctaagccctaatattgtaaatggagttcagaagacaacttagtctcccattttctttcctggcattcattcaaataaaaataggcacgtaatactgtactgttaaaaaaaaaaaatcaaagctccacgcacactttgaaaatcttttagaatttatgacgcttattttcttaagtatctttatgcaaataaagatcagaagtcctttgagtttacatcgcttgctgaaggactgtatcttgtgtgtctctgaaatttgcgtgcctagctcggtgcctgacatggaatagccattgaaaagtagctgcagattgaacgaatgaagtaaatgctacctctctctgatccaccactaacttacccatttttacagttactattctgtggagcagagacatgcttgtattcattcttaggacatgtgttgagaaccctacgtgccaggcagtgtgccgcatcccaggaatacaaagatgactactggggcatgatggaatggagtgaggaacatgagggtatgtgtgtgcgtgtgcctgtgttggggagagagcctgtgacagtcttcttttctttcccccctgaaggctctgtgatcctataaaggttaagaacaactgcattgtacaaacagggggaaggagggtcagagttgtccagctcgtatagagtgttgccaggtgcatgctgaaaatcaggtcttaaattagcaaagcttacgtggtgtcaggtaacagtcacactcagccctagttctcaaaatagtcctaaaccaaaaaatgttcactcggactcctagccccctagtcttctctgtcagcagccccaaatatataaggctgaggtgtttctaatgtgaggttctgttagcctgttggtgctcctcagtcactgggggccaaagaggaaaacataataaagagagtgaaagactttctaaattgtaaaactccatacccgtctgagccatgatgtctggttctgtgcgtttcctggtttcggtgaatctccatgtcttgcttagcttttttctaccctttggctaccagatcaaatgccactttcccagaaagcggcaacaagagtggaaggtggtgaacctaaaaggcagcatagggtggtggtcgagaacagggccttggagactgcgtgcctctccggatccctcctccaccaccgcttctgtgacctagactaagggttgacttccccacgcctctgcttcctcatctgcaggatgaacagggccgttgagcagattcagtgaggtcgtggaggcagagcagtgacaacagtgtctggactcggtaaaaccgacaccgtactcagtctcctcctgatgaggaaacccaagtccggaaacatgaagggggcccttccaggctgacgctatctcccagtgacagctctgggtatagcctgccatccgagcagatgagcctttcagtgacaggaagatcagttctcggtagtattgacaataagaataataactagtatttctctggagtactcgccatgcgctaggtcctgtactaagggctgactatacattatcttgttaaaatgtgtcctcacaataatcctgtgagattatactacttatggtgcccattttacagagaagaaaactgaaacttagcaaagtaacacatctaagtatgtggcagcatggaatgaatgaatgaatgagtttatttatttatttatttaaagaccaagtcttgctttgttgcccaggctggagtgcaatgacgcgatctcggctcactgcaagttctgcctcccaggttcaagcgattctcctgcctcagcttccctaataactgggactacaggtggctgccagtatgccctgctaatttttgtgtttttagtagaggtggggttttgccatgttggccaggctggtctcaaactcctgacctcaagtgatcagcccgccttggcctcccaaagtgctgggattacaggggtaagccaacattcctggcccagacatggaatttaaacctaaatattttgttggtagcatccccacttttaaccatgacattgtccttgttcggttccagggtttctgtagcgtggagctgggcacatctctctgcctgctgtgcttgtcaaactgacgttacctctctcatttcggaatgaatactcctctcgactgtcagttgtcattgatgtctctgtattcataccagttagcacagtgtgtggtaaccaataggtgcttaatgtttgttcaagtacactgaattattccttcaacattccttggatttcgtgctcccatgcctgagtcttgccatttcctctacctagaggtgtcatttcttcttcccagttctgatggtttctgttgtggcctttcagcatccagtgcatatgccattgcatccataatggctcttcctcctggacaccccagcagagtcatgtctcgctctgctgaaattcctgtgacgctgtatgcccctctcactgtgcacagtactttgtgccattctgcagttgcatacgcatttgtcatctctaactctaagtgtcttgccttggggctgttttagtccattggtatacattataggacctcatcgaacttagtacggtgccttaaaacagtgaagaacatttcctgatggagagaatgcaaagcattcaagataaagggacattattttcccaccagcctgtatcctgccttgttcttctttccttttcatggcacgttgacatggaacaccccgttgcattcctggttttgaatcagctgatgggcactccatggagcatgaaaaaatattgtttcagctgaagcaatggaagtaagagaatcattttagggtgtcactgtagtgtgaaaagctttgacatttaaaataaaataaggaaggagaaaaacagttcactctgtcattggagtctcttgccagcaagggctctgagccctctgagcagcgtgctcacctgaaaccccgccagacttacagatgtttcgtttggctccagtgtgaagaaccacactgcagttctcaggaacaattccattctggcaaggactgatgtaaccggggagcggggcagcaaacagaaatgacttcataggtcctatccctctctactttcctagatcccgtagtgcacactgcccttttcctttgagttttcatccatcactttattcacttagtgccaagacatacgacccttttatgaggctatgaaaactccacttagccaagtgcatgtttggaactctaagacaatgatatactttgcccctagttgtgatcctagagcttccctgaaggtcatgtgtaggtgaatggaactcttccagacttggattttcttcctttgaggacttggattataacatggaggaaaatttatttttggggatcagagaagaatttgagtcaaggataacaaagaggtatgaagagaaaatgagagtggaagttccaaaggctagtgtctctcacctctccctaccaccccatgttttaagctgccccttttaattagacattctgccagcatacagcttgtccaaaaccaaacacattatctgctctttggttggccctgttgtgttaatggaacagtcttccttcttgtcgcccaatctcagaagctcggcattattcctgactgctgcctttcctttccttcacatccaaatcctgtgaacttgagttttttaatgttcctaccgccatttgtgcattcctactgttgtcacccttggtgccacctagaatatcaaagggtcttttcaacagctcaatggagacataattgatatgcggcaaacttcacgtacttaaagtataaaatttgatacatcttaacatatgtatacacctgtgaaaccatcacaacaatcaaaataacaaacacatctctcacccctgaaagcttcctcatgcaccttggcagtcccttctgtcctggctgccccatgcctcaattactgacctactttctgttgtatgtggttaccatttcctagaatgttacataactgcagccatacagcatgtgctttcttggatctggcttcctttgctcagcctgattcatccccgtcactcattgattccttttgattgctgagtaacgtttcatagaatggaggtaccacagctcatcacctctcctcttgatgagcctttgggttgttgtcatttgctgaatattttaaacaaaaagctgctgggaacatccatgtacaagtatttgtaaagacaagtgcttttgtcgctcagctagacaccttaagagtggaatggctgtatcatatagtaggtttatatcgaacttcttaagaaaccgcctgtttgctaaagggattgtaccattttacattcctaccagcaatacctgagagtttcattccctccacattccctccaacacttggtgtaatcactattcctaattttaccccttctaatctgtgtgtagtggtatgtcattatggtcttaattttaatttgcctgatggctaacgatgctgagcatcttttgatatgtttgattcgtgtatatctatcttcaattcagatcttttgctcattttttacttgggttattgccttattgttgagttctgagagttctggatatgctctttgatcaaagtacttcactagatacacgttttgcaaatatttactgctagtttgtttcttgttatctcttaatattttttaaaaagcagtttctaattttggtgaagccttatttataaattccttcttttactgattgtgctttgggttttatatcaaagaaaacctaacccaaggtcataaaggttttttctatattttcttctagaagtgttacaggtttaggctttacattttagtctttgatctattttgagttaatttttatattcagcatgaattatttattgaagttcatctttttgcatgtggatattcaattgttccagcactatttgtcctttctccactgattgcttttgtatatgtgtcaaaaatcagttgtctgtatatgtgtcagtttatttaaagacagtctgacctgctccagtgatcttatttgtctgtctttgcatcagtattacattgcattagttactgcaactttatcacgagtcttgaagtcagatactgttagtcttccaacttcgttcctcattttcaaagttgttttggctagtctagattctttgtatctcctcgtaaattttaggatcatttgggcagtttttacaataaagtcctactacagtttctataggaaatgcattggatctgttcatcaattgggagaaatttgtcatcttagcaatattgagtcttcaaaaccatgaagtggtatatttctccacttctttaggtcttctttgatttctctcacaaatgttttgtggtttgccatgaacaggaccttgcatatccctagtcagatttatccctaggtgttttatattttccgtggtcttctaactaattttattctatttgctatttccaatcatttgtttctagcatatagaaatataattgatttttgtgtattgattatgtatcctacaaccttgctaaactcattctagtagcttttttaaagagtctgttggattttctacgtaaatggtcgtgtcatttgcacataaagacagttctacttcttttccaatctaagtcttgtcttttcttgcctgcttgcactggccaaaacgtccactatggaggtgaatagaaatagtgagagcagacattattatcatgttcttgatattagaggaagactttttctttacactgaaaagcatgatgtaatgtataggtttttcacaaatgccctttatcaaggacattgtcttgtcttcctgttttgctgagaattatcatcaggaatggatattagattttttttaatgtttttttctgagtctgttgagatgatcatatcgggttttttgtctgtttgtaaatatgacaaatcacattgtttttgtgtgttttttttaagacaggatcttgctctgttgcccatgctacagtgaactgacgcagtcacagctcactgcagcctcgaactcctgggctcaagtgatcctcttgtcttagcctcccaaagtgctggaattacaggtgcacgtcaccacacccagctatattgactgatttggatattgagccaaccttgaattgctgggataagtcttacttggtcatgatgatccccccgctgcacccactgcccccaagatggagtttcactcttgtcacccaggctagagttcaatggcacgatctcggctccccgcaacctccgcctcctggattcaagtgattctcctgcctcagcctctagagtagctgggattacagccacgcgccaacatgcttggctaattttgtatttttagtagagagggggtttctccatgttggtcaagctggtctcgaactcctgacctcaggtgatgcgcccgcctcagcctcccaaagtactgggattacaagcatgagccaccacgcctggctggtcataatgattttattggattccatttgctcaaattttgtttagaatttttacatctgtgttcgggaagaatatttttctgtagtttgtttataacttctttggctggttttggtataatggcaatcctgatctcatagaatgaattgggaagtgttctctcctcttcagtttcctggaaaattgtgtataaagttgtattatttctttagttgtttggtagaattcatcacataagttacccagacttcaagttaactatgtaagaaggtttttaactacaaattgaatttctttagtacctataggaataattaggttctatatttttctttgagtgcatttttcctttcagataatatgtccatttaccctacgtggtcaagtttattgtcataaaactgtgtataatcccttaatatccttctaatgtcttcaaaatctacacataaagacagttctacttgtcatgtctcctgatactcctggtactgttaatttgtgcctgcattcttttttccctttgtcttaaagttcccaggtttatttgtctactaaagaactagcctttggttttgttgctttttttttttttttttctatttctttggctttcactttaattgttattgcttccattcttttgcttatttggggtctaacttgcttttatttttctgacttttaagatgaaagctgaggttactgatttgaaatctttttttctccaaatgaaagtatataatggtatataattcctcctaagtaccattttacctacatccacaaattctgatatgctgtagtttcattttcattcagttgaaaatacttcctaatttctcttttgatttcttctttgacctgtgggttattcagaatgtgtcatttagtttctaaatacagattgcgcatccctaatccaaaaatccaaactttgaaatgctctaaaacctgaaatttttttcagtactgacatgatgttcaaaggaaatgttcattggagcattttggatcaggaaagggatgctcaaccagtaagtataatgcaaatattcaaaaatctgaaagcaaaaatccaatacatttacgggcccaggcattttggataaaggatctcaacctgtatttgagaggggtatgggagttttttctgttactgatctctaattaaatgtccttttggtcaagaaatataccttgtatggcttaagaactcttaaattcattgagacttgtttgatgccccataatatgacttatcttggtaaacagtccatgtgcatctcaaaagaacaggtatcctgttgttcttggactgagtgttctacaaaagtgagtttgattgagttgtgttctgcaaatcttcagtatctttactgattttctggatattaatacttgttctatcagttattgagaaaggctattgaaatctcgtgtatttgtgtatttctcctttgagttctatttttgccttatgtattttgaagttctgtttttttgatgaatagatatttagaatttttgtgttctctttgtgaattgactccttggtggttttgaaatgacctttatttctgggattatcctttgatttgaaattattatgatattagtatagccacttcagctttctttgactcctgttaaataatatatatttttacattctctctcttcacgtgtatgtatctgtctatttaaagtgcatttattgtacacagcaggtagtcggatcataatttttttgaatccactcagacaagttctaccttttaattggagtgtttagataattaacatataatgtaattgttgataaagtttggtttaggtctctaatctcactaaggtcgcccccccgccccaacctgttcttcccttttgcctcttcttattacttcaaattactttttcattttaccttctttgttggcttactagttatagctcttttttgttgttttagagtatttgttacacgtctttatcattcaagtgatagtatgcaacttcatgtatagcatgagaatctacttccatttctcccttcgcagactttatgctgttgctgtttttacattttgcttttacatgttaaaatacatccacaataccttgttacaattttgtttaattggccaaatttcttttatagatatttccatcataagaaaactatctcgcctgtttatgctcgtagttaatacttccgtgctccgttcctttgtgtagatccatatttccttctggcatcattttccttctgcctgaaggacttcttttaatatttcttgggcagccaatcatctggtggtaaatcctttcaccttttgtgtgtctttcaccttttgtgttttgccccttttttgaagtatgtatctagatctagatatatatattttttgagactgagtttcgctcttgttgcccaggttggagtgcagtggtgcaatctcagctcaccgcaacctccgcctcctgggttcaagtgattctcctgcctcagcctcccaagtagctgggattacaggcatgtgccaccacacctggctaattttgtatttttagtagagatggggtttctccatgttagtcagggtggtatcgaactcccaacctcaggtgatctgcccacctcggcctcccaaagtggcgggattacaggcgtgagtcaccacgcccagactgaagtatatttttactggctatagatttctaggtggacaggattttccttttctttcagtatgttaaagacattgcttcactgtcttctcacttgtattgtttcagatgtcatccttctccttctgtttttttttcctcagtctgcttttaacattttctctttatgtgactgggtttgagtaatttgattatgatgtgccttggtttggttttctttgtatttcttgtacttggagttcattgagatttttggacatgtgagcttacagttttcatcaaatttggaaaactttcatccctttcttttgtcagatatttttaatgtctgctttctctcaactctccttgtagactcagattacttgtatatttggccatttgaagttgccttacagctcactaatgtgtttttttcttccttttttaaagtctctgtttctctattccattttgaaacacagttcactcatcttttcttcagtgtttaatctgccgttaatcccatccagtgttttcttcatctcagacattgtagtttttaatctctagaagtccgtttcggatctttcttagatcttccaggtctctgcttgtcttgtggaacataccaaatacagcgataaataacttttttgagtccttgtctgctaattctagcatctgtatgattattttctacttctaaagtgaggcctctcctagtcctctacccaagaccgtgaattgtgagtattttcggtctggctggtaaggacaggcactattccaagcctttcatctttttggagggctctttgtctggtagtttcttcactcatgtgcattgatcatcactggatactcaagagggacctctgcagatctctttgactcctgttaaataatatatatttttacattctctctcttcacatatatgtatctttctatttaaagtgcatttattgtacacagcaggtagttggatcttaattttttttgaatccactccgacaagctctaccttttaattggagtgtttagataattaacatataatgtaatcgttgataaaatttggtttaggtctctaatctcactgagggtttttttcccctcacctgttcttcccttttgcctcttcttactactctctctctgcagctcattcctctttgctactctttacggtgaattctaatggccctcgcactctcagctcagggagtatactgggtcctgcctggtgtccagctccctgtgctgtggcctggaaactctttcaggccatgagctgttttcaggcaagaggactgtccatctaggccagaggcagaagtctgcaactcttaattatatttcctgtccctggttcttttctcacagtgccttctatttatccagaggaattccagcaccagcgatggtatgcaaacctttagtggcacacgttgactcagatacagcccagattccttggccatgctttccaggtcttccataaaccattctgttctttctcctctcattcccttcattaccttcatttccattcctacagatttgttaactggaatttctgtacttccatctctttttgttgacagcttctctttgttcaggttctccatttcctgcacatttttaacacatttgcaagttgtaaattatcttctttctgcaaactcctgtaaagatttatgtgcacctctttgattcaagccttcactttctaccttgtgttaacttatttatgcacatgtcttatctcctccaaccacttataaatcccttgaggacaggattcacgtctcatttacatgctcttagaaatttacagtgcgtacacagtaggcaatccatacatgcccattcagtacacatttactggcagtcttgggaatgaacatcaaattaggtattgatgaaattttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttcttttaaaaaaaaaaaaattcacaaagtaggctgtaccctcaaagtgctaaggagagcttctgtcctcgaaaatctccctgaaatactgaaagcatacaaaaaaggagaaagctcaaaactaaattttgactctcagtggctgggttttgtatctcttttctttaaaaaaaaaaaaaaaaaaaaaaaaaaagccattgaaatgattccacttctgagttacctggagcagtcaaattcagaaagacagaaaataggttggtggttggccaggggctggagcaggagggaacagggagtaagagtgtaagggggatggaggtttagtgtggggagatgtgagagttctggagatggacagtggttacagttgcacagcagcatcaatgtatttaatgctgctgaccttcatggacatcctggtcatgtgtacagaaaacttagaagtaaattagggtttaaatccagttccctgaggttgggcaagctgctggtcctctctgaatctgttttcttgtctgtaaatggggcctgatgtattgaaaggcacctggctcagtgcctgtaacaatggacactcatgttcatctagttctgtcccttttcagctttacagagaggcttcctacttagatggttctctctagctatggggcttggagagtaaatgggcaggagtgggagtgtgggaaggggccatgctctgttgatctcagccagttgaagctgatgcctctgtcctggtgtttataaggggctccatcacacatgtacccgtcctctattgtgtgggaggtaccccaggcaatgaaacggagaggtgtctcctggtgttgcagtggggaggagacctctggaccaggacgtgctgtggggcgtcagctaccaaccttgtggtctcgggaaagtgacctatcaagggggcatacaacagggacaccaccttgaaatctgaagtcactgagtagcaggggaggttggagcctggggcaccccatggcctgcccttgggtttcatttaactgtggcctccccaggatgttacacgtcctggcctcctccctgcagaagatgaggcttattcccagtcggcagactggacttcttcataagtgaaaaatagttacataatggttatctcattggtgtttagatttctgaacaaaacgatgatccaaaatctgagtgtggagaaacggatccccagtgaaggaggagggaggggccgtgtgcatgctcatgctgtttatcccaagcctgttttccaccctccctgccctcccatgcagaggccccgccctgtgtccactctacttcttaggaacctggcaaccccagggaattttcctgacaagtcagtgtcattttatgggttattgctgttttcccagaatagccaattagtattgagggagtgtcacctgctcttctccatgttcagccccttcctgagcacactcatcaggtttaaggagccagctgtcccacctgctcagctgtgcacccctacaggctgggatcttgtgagattcatacctactgaggagggtgcttgcgttcagtcatggttgagatggggctcttccagcacagccccaaaatacttcaagaggcgcagaggaaactcggcctcccgagtgagcatccccttgatcccagcaaggctggagggaggcagtgctgtgggtagttagttggaggaaccaagggcatggcctcttttattctagtgacattcaagggcaccagctgttttgactcccaggaagctgtttttcccatgctgagtagtctcatggcactgtgtgccaccacagtgctgcccagccctgccaccctggactgaccgatagaggggagaccacagcgtcagctgctaacatggaaggacttgattgtgcaagagctgggtttcctgggaagtcaggcaccctgctccttcacctccccataacagctgtccccatggcagtctcatgacaataacaagccagccttgctattttggaaagcagtgagggacgtggagatccgatctggacagtattcatctcctgtgtgacctgggtgagttgcccaccctcacagagttcttttcaccgagttcacatgggactcaaatgggatgccatggttttaacccctggcgtgcgttagaatcacctagaggaattgaaacagagaaataccagtgtcccaaccccaccctcaggaatttggatttaattcccctgctgggtcccaggtggcacctgaaggtattgaggtgattctaatgtgcagccgaggttgagaaggaccaagctggacgttgcgagagtgctctggtaaatttcgtttggtgttactctcattacattctccactgactttggcagtgtctgtgaattttcacatttttcatgtaaagatcttcatgactttttttcttaacattgtttccaacaactactgcaggtcatttagcaagaattagtcatggtagttcacagccctgaacccaaacacccccagatcttcagcctcgcgtggggcttccagtgacttcgtggaatgtcatcatagtccttcctttggagagctggattttctcaggcaccgtgaggatctgggccaagcttctccagggctgtcattgcttcctggttggaaaacccctaggtgccaaatgcaagaggagaaagagtgaaattaaccagctcacccatcaatagcagtctcaaaatcatagaactgggagcctgtaagaaatcacacatttctgtgaatgtgtagagaataactccaaagtttcaccgtgacaagtgcagaaattacatttaaatgagtacagaagaaaatttcgccacaaactgtgttagccaaagaaggttctgtacaatgagacgtaactgaattatgggtaagttctgtgttcctgctgatgccctccccactccgtctggggctggggctgtcttgagccagcattcctgttcattccacctgaggactccagtgtgtgggaaggaggaagagacttaaacccacctaggggccgggtgtacagcagaaggatagtacccattgaggggccaatataggtttcgtagtgagaacataataatgcaggtttaaccaaaagaatgtgatctttgaagactgtttgatcttatgcatggtttatggtattttgtaaatggaatagcttttccaagaaattcaaaaaagtgcccatatgacgcttcatgtttatagatttatgaagtattggttctcagtataacctgggaaagaggctggggaggtccggtcatcttcattttctgatgagacaactgagatttagtttaaatagtggtcacattgctaggaatttggtagttcaaggacaagacttacagtgttgaaactctcattttggtgcgtttcatgttttagaatttttcacagtatttttactttttaaaaattttttattttatatatatttttgtgacagagtctcactctgtcgccaggctggagtgtagtggcatgatctcagctcactgcaacctccacctcccaggttcaagcgattctcctgcctcagcctcctgagtagctgggactacaggcacacgccaccacacccagctaatttttgtatttttagtagagacggggtttcaccatcttggccaggatgatctcgatctcttgacctcgtgatccacctgcctcggcttcccaaagtgctgggattacaggtgtgagccaccacacccagcctatttttactttttaaattgagttttcattttgaaatgaaaaatgagaaaattcaaaatttttaaatgaaaacattggtctttgcccagtaacgaacatgtgtacacctttgcattcatacagtcccctagaaccagtaagtcctttccctgcaaagctgtcctgaacattcagggtccacacattgaccactgaagggtaggaggaaaggcaaagcaagctgcacaaagggaagatggcccgtagccttgaaatgcactcttgctagccctccccattttggttattatcagcaaagatcagtgacatgttaatatattcggctattttactgtgaatataatggtaaattttaatagaaattgagttagatagcagtttctgaatctgaaagaaagtgacattgcttgcgaatgctcacagtagcacttaacattgtgaagttcaactcaatttttatttgctgtttcacagaaagcaataatccctcatattttatagtaccatctgggttacaaaaatcccgatgcgtctttgttggacaagccaggatctcaggaaggagtggaggggagcttcatctcagtggcttctgccctgaatttgaatttttaacaggcagcttttaagcatcctgtggcactcatcccatctcagtgtagcagagacagtaatgtctttccctctatggttgagaaggagcttttgaatgcccttttggaagctgtagaaatctatgatactcatcgtcagcattcgaccatgaacttaaactcctatcacacctctaggtgtgataatatttctccttctgttacaacagagtaatgtcacacttggcacttttactgtcctcttgcgagactatcctccaagtgctgtctgagagtgttaactgctatttggctcatttttctgcaccaaggagaacagaaacacagcaggcaccaagaggaggtttagtgtgcagtgggttgttctgaaaggcagtgagtaaaatgaggtattccctgacttctgcttttgctacatgaagtcatgaggtccttgaagccagacttaggtaccgtttctttcatcccttgctagttcctaatcgtagacacaaaccttccacatccatccaggcggatggcagtgcttcttgtagaaagcaatgtcactaaggcagtgtcactaaggaaaacaggacaaggcaacagttgtgttcagagttttgactggcgtctgattggaattagaaggaagattattttgccataacctaggtaccgtgacccaagctcttttggcagaccttgacgtcacaaaccgtacgcttgctggagaagggaaaaggagagttgcagccactaagagagtcaaggctgtggcctgcctggtggtgttttataggaactggctcagggaggctgcatgtcctttgttttctgaggccttgttccacgtggcctcccacttgaggccaggaatattgcagcaatgccgaagagtgggtggacaaatagccttattattaacctaagttggaaacatggctttttgagtgtcttcattcacagatgcagtcacaaaatattaatactctttttttgaacatgacaaaacaaagtattcatttaaacctcctttgtccacgtccatggtaaaagagcacctcaggcaggggagaaaaaaaaaaaaaactggtcccttgagaattactttatcctttgcatttgcatatagtttgaattcataattaggctatttttattggctagcagctgtattatcatataaatccctgaatatgtaatttggagtcatttagaccagtcgtcccacagtaaccctgggaagcacgtgagcagcgtcagcgtctttctcgaggaagaaaatgaagatggggagtaacttgctgcaggcagcttagctcctgctgtggtggattgggtttttacgctaaagaacatagatacctgttcagtaataacttacattggcatagaattcatctattaacaggatgttttgaggccagacgtggtgactcacacctgtaatcccagcactttgggagaccaaggctggaggatcacttaagcccaggagttggcaagaccagcctgggcaatacagcgagacccccagctctgcaaaaaaaataacaaaattagccaggcatgattgttcatgccggtggtcccagctactcaggaggctgaggagggaggacagcatgggcccaggagtttgtggttatactgcactccagcctggcaacagagcaagaccctctctctttaaaaaaaacaaaacaaaacaaaacagaaccgggcgcagtggctcacacctgtaatcccagcactttgggaggccaaggcaggcagatcacgaggtcaggagttcaagaccagccagaccaacatggtgaaaccccgtctctacaaaaaaatacaaaaattagccaggcgtggtggcgcatgcgcttgtaatcccagccgctcatggggctgaggcaggagaatgacttgaacctgggaggcggaggttgcagtgagccgagatcgcaccactgcactccagcctgggcgacagagcgagactctgtctcaaaagaaaaagaaagaaagagagaaagaaagaaaggaaggaaggagaaagaaagaaagaaagaaagaaaagaaagaaagaaagaaagaaagaaagaaagaaaagaaagaaaggaaagaaagaaagaagaaagaaagaagggttcccattgttctcgcattcattgtctgcgttggttgagtctgtaggcagggtagggatgagcatcttccattttcttcattttacacggaaaagaaatctctggttgaacgtggtcagtgacttgcttcagctgggagacttgggactgaagctgccctctgtgactctgcactctgtccgtgataccagggaactggtgaatccaggagcctcccattgtgatgctcactccttctcctgtccattcatatgggtaaaaaaggttttgtggcttaagtagcatccagtttcatctcaagtttcagttcccataaaataaacagatactagggtagcaaatggtcccttattaaatgtcacaggggaaaaagagaacaaaaatcattttctgtactctccagaatacagttgagtgtcccgattgcctcatacctccagtgagaacagcagcagcatttatgggctatctcagtgagccacttttctgttaaacaatccaacacggaagtaacacaggctgtcctttgggctcccccgcctgatccgctgaacagaatctcagttctgtttgacttacacggtcggtggcagagggaggagggagaaactcttccatctttattcccaaatggggatctcattttgggtgcatgtatgcaaaatctgttctgtctcctcatgcttagtgtgctagtatatatttactgctgactgcatttctttatgaggactcttctgtagcgttttgatactgacaattttatgaaggctatttcttgatatttgtttattactcctttaaaaatgtatttttgtggcagcttcaaggcagttgcaagatagtgtatttttcaatagagaagttggattaaaacttacagcaactgtcacctggtaaccagaccccatataactgtgtcaacattaaccagtgatttattgctttaaattggaatcagctgatttgtggttccacggcttttaacgctgcaggattaatctggaacccactggtacacatgaaatagttgtattatctgctgttctaagactgatgaaatgtttaaaaggatagctgtgtaatcagtccattatctcctggtgttccagcttattctgttccgtgtggcagtgtacaatttcaaaaataattattctgctgtccttaatatgggagccgaatgcagtgactgataaaaactgcattcagcaagccctttcccaaattgggtagttctattttgttatcttctgaagggaaaacatgggttgtgatggtcagacctcctaggagtctggaagctttagagcaagccctgggaggcagaacacttaatctgttgccaacatctttttctgtttaatattttgaattttttgtttgtaggtaaacttgtttagactacactttcatgtactcatctgaacataggtagacctcttgaaaataaggatattgatgcttacagttttcttttgttctgaaagcagtcagaacatagccatagttacagaatgtgggttttaaaaagcaatctagaccagtgtccctttcttagcatcctactttgacagccagctattgaaggagacccagaagggcatggtcaagtggtttgcttcagacttgcgttctgtacaaagctcatccaaaggaaaagcgttgtagatttttttgcatagactaggtagtctctagggataattattcttgtttacaaagatgttcgtggcaatctatagactgttagtgatgttttgaggaaaacccaagactcaacatcttgtatataaaggattgcccatgaaatcacagtctgtcttcaaactgtaagtagaacatgagctttccagttaatagggaaaacataaaacaatggattttattgcagggcagtcctggccttgtatagaccaagagtagttgactttccaggtaaccatggataccttaggaggaggggttggtaggacctgagaggaggatggcatacaattgtatgactgttctctagtggcgagagattgtcaaggaagaaatgaacagttttattagaacccaagaccatgatctctgggaccaacatctttaattggagacttgttagaagccattcagttaagaagacagtatgagatgcatcaccttgtttctgcgatgttatcttctactccccgattcggttgctggttatctcttaggcctgcttttcccccctcttgaacatggagctaataactttcaaacaaatcttgagccctctaggcagacactctgttgttccttgagcccgggccatccttgctattgctacctgaccacaagtgctggaagtagatgtcacacctgcgagcagagaaggcccgcaggttgggtatggtctgtgtagagcctgaatcagaagggtctgggctggaaaggaagatggtcagatgttgccctctgccaccaccccttcccccaagtgtgccttctcttgaaaaatgtggtaaattccatgaaattcatttctagtcacagttaagagcaggccctccagactccactcagcttgtctgttatgaggaaaaagccatcaatattttaaaagctgctgagaggcaagaagttagcctcgatggctggaaattaagaattttttttattctatgcaaaatctgtccattgcttctctaaagcagcagcagggctgagggaaagcttagcctagaacagggatgtgatgaagactaataagataaaaccagtcagagtgtttaagctagaggtaacctggaagtgtcctaattggatggcctgaatttctcacccgggagttttccagagcagttaacacccagatatgccccggcattgatgtcacaaaactgggtcgtggcagggtgctccagagagtagatttcagggcagatcttccagggacagattttgttgacacgccttctggatttctagttgtggttgagaatgtatgatgtgaaaattcacccaaactttccagagttcaacttaatgagaagagaagaggtttaggggagtgtattaactctttgggcccactagaggagttttacaaatagttttcaagaaccagttcgcccacatgattttcagtctgcctacgaatttgttaggggttgcattcatatttataggtaggtatctcacattcagcctcacctttgcctccattccgtctattaatttttctttgttcccgtaccaaaatgctaaaagcctaagagcatgttcttacagcaaagatatgaattcccaaccaagggagatgaagaagtgaattggttaaatgtactgaataccagttctctgtcttttcatagcacatccctttgatatttcttatactctgcagaatgtgggcatgtgcttattttcatgaatacctggaaagcattttaaatgatggcagtgctacctgggtaccaagaggacttaaatgccacttgctggctcatgacttacccaggaacatggtgcagggtctccctcttttccttgcccagtgggcacagatctctgcaagacatttccaggtcagacttctgtgcccctctgcataggcctgcctgtcatttgatgctgctggtaggttggagaagcagtccaaggggatggagataagcctcagctactgggtcagcgttttgaaacctgctagcaaaaggaagggagaaaagattgagaaaaagaagacagaaattaacttctgtgtcattgtgggctgagtcgcaccgtacaagttgttttccctctgagcaaatgaaatttgagaattgttcatcagtgaggatgaaatgtcagatattcttgtcgggaagtatattcctctctcaaacgggtcagttttaccaagtggtttgctcaaaaaggtgttctcatcaagaaagtgtaaatgtgggtttcagtgcttcaatggctttgtctacctgacttctctacagcagttcaccaacttctaattttctgaaacgaaattctaaaacatactcactttgatcctgctagtacatttttcttgtagctgtgttgggtagtcccctgaagtgtgaggcagagatagcactgacatgggcagaattgttactgtttcacctgtattttccttgtgtgtgttttttaatctgtaggtattaggataggtttaactgtcagtattttcgcagacccaaaaatatattaggacttttaaacacagaacccttatggatattggtgggtggctttcctccatgtggtgatgcagggatccaggcttctccatcttgtcactctaccatctctttggtttttgtgtgtgtgtgtgttttgttactttttttgtcacctgtgtccattcaaaaggagaggaaagaaagtatggaggactcatatctgctctgttaaaagctctggctcttaagcagcacaggtcacttccacttgtatttctttaggaagcctttagtcacgtggcaaggggcaaatgtggtttcaccatgagctctgttccagtgttggccctgaggaaggagaggatggacttcagcagacactggtagtccctgcaacagctgtcctttgctgtgttgtttcccaggcttcctggaggataagaatcccagggaacactgccctatagatgaccaggcctttcgcctggaaagcctgagctgaggggcatggcttggctccaagaatccatgtttttgccaatgttccaggcaattatcatcttcaggaacatttgggaaatgctattgtaagaggtgattagattgtagaaaggtatttggtaccttcgttgcagttttctgctgagaatcctgtgttgtaaggaatggtggtggactcggtggtgaaacgttaactcctggcacccatgcttaactctcttcagtcttaaaatttggcctcactgcatagacaagatcatgactgtaccatgtaacactaagacatctgttcctacctgaatttttcttggagtagcagattgtttcattgagttgaccaagtttacgactcattttgacagatggtgattctatggtttatatcaactacttggaatttatcatctaatgacagctgtttaacacataggtcagcgtataagattgactagtaatgaaatcttcggggcatttttttcacctcctgtcataatgttgaatctttgggaaacctaccaccttggaaatgaaaagcttataaatatattgggtgaacagcagttgaattatttatgtgacaaaaaattctttgtcatcccaaaaagaaaggatggaaaagttgtccccgatggtttcggaagctgcagtgagatggacacagtatgtggagtatctgtggggtgagcttttcgtagcaaatttggatcctagactgccctctctgagctacccagtagtcagtcaaatgggtcaagtccttttccacagtttggaatgtgctcagggaatcaaaccgactttaatattagcctgtgacagttatattcagggagctaagacttgctctcactaacatcgaaagcgttccagcacatgttggaaaggtgtttggggtagccactgtttagacttgccttagctattgatcttcttgttatcgaatataatttagaactaacagtgagacccttagtggtgggagaatattattatcatttgttatctgcacaattaggaagcaggagagtacagcagaggctttatcctataaaccatctcgttgcctagagcattttagctccttgcagagtggtctaccacatgcctgccttcccacccccatcctcatctctctctctctctctctctctctctctctctctctctctctctctctctgtgtgtgtgtgtgtgtgtgtaatccaaacaggcattggccctacagtccaaagggctaaaaagactcagaaatccatcctcatccagtcatccagggaagaaataggagcctgcagggtgtttcttttcttttttctgaaggtttaatagaatcagtgtcattggcaatgattgagaaaaatgaaagtttttagatcaaatactactctagcgtgcatgcagcatgggaacaattgatgggcggcgtgctcttcctcagacaaaacccagtggctgctaatcagtgtgtggtgtggagagttttttgttatcctgaaatcaaggaaatattttacttttccctctgaggtgttccagagaaagattcttgatcaaagaagataaatcctcttcctacctgctaatgagtgagcagctggatttcaagcacatcacgtacaaggaccatgtgttacatttttttagtatccataatcaggtacacttatttaattttctaaaaatggaaagccaagcattctctttggttagagacatggagcggtgaagaagtaaggcagtgtttggcaagatgagtccacctaactggaatcaggccaggctttatcgggaaccagaggggcgactctgtcaagacaccccctctccatgcctccacttctttaactggaagcaagaacttaaaccagatggttaagatcttttttctgtcttccgtctggcatttaaagttgatcgctgtcaaatccagaatggacccttttcagaattacaatgtgactgaagtttgtcactttcttcccagccatccccattttgggggtcatccttcttcttttaggacatcccctcttgccccatgacccgcgttctcaccatggaaactcttatcaaacctagtggccataagattcattgatactacagcgtaaatggttgggaaacagattgcggtgttgtgtcttctgaggcatttttattttaatatgaatctgagcctccaactgaaaggatgaagctcagaggctgagtggaaagactgggggagaggacagaagaggaggggcgcagagggtttgcccacatcagccccgttttcttcttttgtcccagaatcatcgttaacattatcccctccgctttcaaaagggtcctcacttggagaatgaattatttgatcaccctggatatcaagaaacccttcatactgcccctaaaattgtacagtggaaggaagaaaagaagctaacctcttttcggtattttctttgtgccagattctgggcttggcactgtgtatacattattttactaaatggatcaaacagaatctatttcacctagccattaaacagcatctctcttaggctagaagtaactataccagagtcatttcacaggaaatgggttgagagtgttgcgtggaccatttttacccctaggaacctgaatcagaaaggctcatggaactccaagttgaaaagaaaaccatattgctataggggaagggggtgtgaaaatgctccggtgagagtcaaccccctgagtatacagtaggaacctccggtgcctggcaccacgccatgccttgtcgggggccggtggggggacccaggaagcgtaagaggtagcagccacccgcagagagctgcattccttaggagaacaggagcacggcagcggaaccacagtcagacggcagtgatctcctgcgcttgatccccgtgtgacaggaactctcaaaatgaaatccagctgctggaaaccccttggccaagaggtgcctgacacacatggtggtctgtgccccaggcttccgccggacatctcctcctccccgtcctcatcgcagcgtttaggacatcacgtcttcttgtgaagcccagtgttaactgcttttgttttttcttcctctattgttgctgagataaaggaaagtgaccaatctggttaaactcgtatagtagtgaaacctgggtgtgctccttagccgtaggttttattttaaataacaaactgttttagggattttttgcctcttgggggcatatcatagagcatacagttggggaaaattttgttgtaccctgaataagaaagtcatgaaaatgattacattaaaattgattgactatttagaggtcacgtaaatggatgttcagagtattcaaaggccatgcgaatgggtgaactctgctagttccaagtaattacttcagaaagcaagacaacacaatcaattctaagccctattaaagggctcgtggtcatcacttagaaaagcggcttccctaccagggaagcacagcggcagcgcagcctgcggcaggcctgtcgcggctgcatttccgtattgcatttgttataaaagtggagtaaagctacctatcccttacctgcctcaaagggagcctgcatagtgtctgttagggctcagcgctctatggagaaacatgttaaatttaaagtggacaatagctgctaacatttactaagcactcttatttacatgccaggaactgtgttaaacattttcatacgttgtttggcttaatgtgatacatctataatatagctgtcactaaccccatgttattaagaaccagaggcttagggaggtgaggtcatcagcttgtgatgctaatcaggaatgactgtaccagcctcactgcaaggattatgaatgggcatgagaagactatccagcatcactttgaaaactgtcatggtatctgccatgagaactcagggaccaccttggccccaaaagtgaatttcttaaatgatttccgctgttccaggcagtatggagaaatatctctgtctctgatctccgtacacatgaaatgcgactcagctattgccggagtggggtgaagacagttataacggccataaatattagttctccagcatcatatccaacaagaaaaaacaatctacaataagtacaaatgtttacttcagcctagccttggatttctatagccaaagggtttgcctctccatttcactttgactgtaaagaccagagtgaggaagtagattatgacgtccttattccatttccagaaaaaataacctttgttctgctttggattgcaaataacccttttgagagttcagaggcacctagaacccttgagtaataagttagaataccactgataggtgctcaggaacagagctgagctgtgttttattcaggctaacaataaggggcctgcattcttagtccagggaattcaagctgatgcatcgtcaaagcaaggcagtgaagtggagacttgagagatcggcctggcctggaagcatctaatagcccagcttgctgtgaattgagaatcgtaggaaaatagatgtgattctaacctacctctcattgccactagcctcctaattataatgctatcctatcctctacagaatctatactatgaaataaccttatattagaaactttcttctaatgaggtccctcagtactttagaaactaaatccttcttaattggattcaagacagaactaccttacacctaccgcgtttaaccccgtgatgcctccttggtgtatgggaagtgatcttggtttggttagcctgaaggcctgcctgctgctgagccactggtctctacctcaccatgagaccccagggagaccagctggccagggagttgagccaattaacgtccactttagggaagccagaccctctagttggcttgttacattcaacctgaagtttttcattcttccttaccttcagagaaaaatatggttctgctcactactttggaattaggttttgaaaaatacaaagcgtgataaattctatggctagcttattatctttcattcctatagtcaagtgacgttttctctaacaaagaagactccttgctttcttcacgtcaccccctgggggcctggacaaatgcacacgtcaccctacctttctgatgctcagagcagggtgggagagttcgtgaaacagctgaacacgatgattgtcccatcgggggaaaaaaggatgatgctgaaattcttccaatgctttcatagctattagacaattgaaatggtttaacataagtgtcttatttcaaagaaccagagaaggggaaaagcacattccagcaattttgcccttgttaccttttctatctgtgtcgtgctttggtggaatttacataatcatgggtgaggaagtgttacagtatacacatagctgtgcatattaggctgcacttgctttcccaagaggcttgaaaatgcagtcaatttaatctaggtcaaaaggaaagaaagaaactccattttccctgcagaaaacagggagcttgctagtcttcacggggtcacggaaataacagaagatggttcctccagggaaagtccccagggcaacaggaggctgccaggggcctggatcttgtggccagttgacagacaggtggtcctagcgtgtcaaatggagagttggagggaaggtatggggttgccagggaccccagtgagatcattgttccctcccgggctgaaaaggtggctcagatttgctgtctgcgaggaatcttgcagggaaagtgaggaaggatgttggtggagcatcgcacgactgcctcaggcggccagagggcggtgcgggtcccacgctgccagtgtaagtttcccaggggaattcctgggatggcacttggtaatccaaaccgtggagtccacataactcacatacggaaggcccgatggcagcatcgcccgtcagcttcctaggcagtggccagatggtgataccgctgacatcagggtgccaattatatcaaactctataaaactaagctaattggatacggtttccttaaaagtagatttctacaggatgaggcgttcgtatttgggtagctgctactctagctatggaagtcccatttttaggtggggaaaaaagggttgtgttaggtgactgttggagagacatttcagatgagaggtttaggttataaagagacattttaggtgacatgaacagagtgtgaagcagatctttcagagtgaggtggaccctgttagaggtggttcagggacattctccctatgagaggcatagactttgaggggtgctcatcgactcgtggttgctgggatggttttggctttgctcttggctcctggtgtgacttgggggcagcctgctaacctgtagactggtgttttcccatctgtaaaatgggagggtgtggggagttaggctggtagaactagtgtagggaccaagagaaaacctccccttggccctatgaaggttcactaagagtccctgacaagaggcacatccacaggagaaaaggcacgcaggttgatgagatcacggtttctgtgacacaggcgccttcgggatgcagacccaaagatacaggggaaatggtatacttaggtccaacaaagtgtgcctaggctcatttgcatacttaggttccacaaagtatggtcagccatgtagtaatgtgattggacaaaaaggacatgacgtaacgctaacagactgagcagggacactcggcaaggcctgcctgtccgcattctccctggcctctctgagcaggattcttccttctgggtgtgggaaggaccttccctggaatgggggtcttatgacctacagtcaaacaaggtaggtcagagaatttgtttctggccagttttgtacagaatgacggaaggaaagttagagcagtatttttaagttttatggctggctttggggaaagggggttctggtttctgtgacctgctatgaggaagagagggattccagtttctgtggctgggcttaggggaggctgggactgagagacaggagggcaggagggggtcagagagaaactttttcttgtgaggcttttatgctggagtactgcttcccgactcccaacgtttgctacttgtaaaattttgtgattccacaggaaaggcaaaggcatggaagtcatgagaaggcaacgctaccttaacttcttctcattttattttttatagtgttcagtttaaaggcgtaaaaggctggaggagcagtacaacacagatatgtctgatcttcttggaggttctccctttagctaacttttgctgtgatgggtacttttttcatgcccctggttcctgtatctctcagttgatgtcattatagccatctgcgttcagcatcaaatacaggggagccacgataataaaattacaggcaggaatacgtgagagagctgagaggcaaggggactgggctttagacggagcttgtgaaatcggtggcctcatttgttcacttgtatctagcactcctagaaagcaagcactgcgtggaggtccagccacaggaattcacaccaacgggcccagagtcggtcatagtgccctgatgtgaccatttcctagcagtgccagttcttcttggtggttggattttgggctaaaaaaagggctacatgggtgaccctccaggatctcatatcatgtcctgaggcctccttgtactttctaagaatgtcattttgtcattgccttttgcctcaagatgctaggggtataaatcaccttctaccacggaaaaaggactactcttttttttttttttttaaggttaatgctaagttttcttgaaaattttaattcaggggatttttgatgggtttttttttaacctttaactgccttgtagaaagtgaaagtagggggtcctggcagggccaaagccagtgactgagagttgaaaccgtagtgcatggcagattcgcttgagcacaaaatgccccacttagatccacagcctttggactctggaaaaaaaaaaaagtattaaattcttctccaagtggctaagattgagggagaaaatagatggcaaggggaatcaagtaagaggagtgtgtcctcttttgacttaaactggcttgcatgctactgacttgacaagaagccaagatcccagttgcagttcgacttgtgtgaagcaggcacctgctttgcttgcaaatgcacatacaaaagagagcttcattcacaggaaaaaaaaatagcgggttcactaatttagccttccagggccttcgtcccttgatctgtcagccccttagaattcaaaggcagcgtgtaaaggaatttcctatttacaacatgatgacttttttgatgtcctgaattcgaatataactcgagttgaagttgtctgctagggctattgctttgttgtttaataaaaaaaagaaaaaatatatagagagctcagtcatcagatgatcagtctggggctgctttcaagtgtttatgtgcttagatttagaaaacaaagtaggttttcatatatgtaagatgtcgaatggccttgaagacgtggacaggcccgtcttgaccctggggcagagtccacttagggagggaaacagctgttctcatgcccaaccccataagctccgaaacggaaatactttttatttgaccagctttgccgcagaattgcaggaaaccatttttcagtttgtctcattagccctcaagttgtatagttattttgtattccagaaaatgctccacagttccccataagaagatattactgaagggtggtatcagaaaaagaattagcagttagaactagaactttccagaaaggtccctcctgccatggtagagaacaccttacacaggggagtttctccttgcttcaggcgggtggctgcagaagagtcatgaggaatgcctccctgaaaccagccttgctacgcggggtcagctcctgcctttggcgttgtgactcgttggcatgtgatctgaagttcctgccctgcagctgacgagccagtgtttcaataattaaaaacaactcaactcactgtcctcctgccttgaatttgatcattgcgctttgcatgtatgtatcacaataccacatgtaccccataaatatgtacaaagattatgtgtcaataaaaaacaaaaattaaaatcccaatttttaaaaagaaaacatgaaagtaatttttaaaactgcgtcagccatgctcagtggctcatgcctgtaatcgtagcactttgggaggccaaggcaggaggaccacttgagacgaggagtttgagaagcctgagctatgtagcaagacccagtctctactaaataatttaaaaattagcctggtgtagtggcacatgcctgcagtcctggatactcagcagcctacagtggagaagatgactttagctcaggagtttgaagttaaagtgaactatgattgcaccactgcactctaacctggggaacagagtgagatcctgtctcttaaaacaaaaattgctttgtccatatattagagtcaaggaatttaaagaaaaccgcctttttaaaacagtgtctcagagcatcaaaccttggtttagaaaccttggaggaagtttctttaatgagtatggtgtcagttttcttaagggcagaatgagtttaaaatctgacctcatatcattgtctagagtggtgtctacattacctccacactgaaaaatataaatacgttattgctctttgattcacagcaaaccgtgatataaactggttatctttatatatcagtacatttttttttcctgtgagtattattacccagagtttccaagtaaagattttcaagggaaacagctgtggtttgaaaaggtttgtgataatccagatggtttctttgaggataaatctacttgatcatttaaaattaaagtctttcagtacagttgagtgtttctttatgattttaaacacactactgtgtgtgagtgagtgagagtgtgtgtgtatgtgtgtgagagagagagagagagagtgtgtgtgtgtgtgtgtgtgtgtgtgtgtgtgtgtaactaccattggcctttggggctttatctttggaaacagcaaaaatctcataccagtgtctcaaattatctaacagttaagcaggcaaaatacctgagggaactcttcatgacagcagaaactattagtgaaaaaatatagcgagacaccagctaccctgtgtggagtatgtcacactcagcctctctgggaattgccactctccacttctgatccatgatggcataatcatagctcacaattataatactgattacagattgctttccaagctgaacatatgcaactgtattgctaaacttaccaatttcagggaatctgggcgtcaaaagcatccacatccctgcagcaggcccctggggaggtaggcagggtgacagctgggaaatggggaaccagggctttccatacctgtctccttctctcagtgtccaggatcttcttgctgcttcatggctgccccgagatgctccctgtgaggcccccccgggcctgccttcacagacaatgctctgtgcccctggacctttcttctgtgctttttctgtcttgtgttcctttcctaagggccctgctagatgttgacagtgaacagcagaatcacagtgatgtgttagtggccagtaagatctggtgtatttcccctctaagttacagagaatcagcacagtctttttgtagtcaacagaagaagtcatcactagtgggactgctaggctctgtatggacctaagactgtgatatttggttctgggctcacctctcccgagttttccactggacctgatggacctatgaattttaaaagtcctggtgaggagtcgtgggaggtgcttgttaaactggcacatgaagaaggatggtgtttttttgtgttttgggttttttttttttttttttttgcttcaaggaccaaagcttttattattacaatgaattgttgaggtcgctgaaacaagggatatcctgaagtcacccgggcatggaacaccatgtttgtcttttctaactaggccactgccactggcagaagctcctgaatgagtagataagcagtggcatgaatcgtcccatgcaggtgcttattagatagtgtcaaatgagcaaagtggaaataggtgaagcagcagaaattaccagcattaagcagcaatgggagggttgagacctgcagaagcacctggttcatcagactgcatcagcctgtgctgatccccagagccccctggccggtcacctctaacatggagcgaggcctctcactccactccatggacagtagggaaggtgggtttcccagaatgaattctgaagcccaagggactgtcccctctgatgcatggtgcgaccactgaccatcaaagagccagcccctgggtgttgtagatgtgtgactaccccttacaccgatgttggaaacagagcctgcaggggaggaggcttgcccctgaatcagactgctgagccatctggtgctgcagctgacctggagaggaatccagtacatttcagacctgagttacagctggcgtggggaaatctaggagacaggtggttcccttaacagctgtatatttggttagggctgacaagaaagaaaatttcatccttgttgagccttcgtggtttttcagggatctgtagtagctccttgaccttttgccataataattgtcatttcagggaaaataatgatatttctctctttgttgaaatattgtctgcaggtgggtaatctaatattttacaggagcatattaagtgataggtggataaaaagactatggttgttaactaggagaaactcatagaaagtctttcaaacacattccagtatctggaaaggtacacactacagtcctgctggggaaaaacactaattgctgtatctaagctgactgtttcaatttggaggtctgtattcatcctgcaaattttaataaaacttaaccaatcactgtacttgttaagtgaaccattatgaatgctgaacaaagcataagacttcctttagtctaatagaagtaaagaatgcttttgaccctttttcttttttggtcctgaatgaaacactttggctgcatatccacctagtttcgtggggggatattaagcagacctgctttttacttactgatgagactaggccgggcacagtagctcatgcctatagtctaagggctttgggaggccgaggtgggaggaccacttgaggccaggagtccaagaccagcctgggcaacatagtgggacccctatctctacaaaaatgtaaaaagtagtcaggcatggtagcacacacctgtactcccaggtactcagggaaggggcaggagaaccacttgagccaaggagttcaaggctgcagtgagctgtgatcacaccactgcattccagccaggacaacagagtgacatcctgtctcaaaaataaataaattttttaatgatgaaactaactaaggtactgaggaggtaagatatttccccacggtaagtcattcagaaactaaatgtgaaaaaccaaaagaagcctctggggttagtattcccagtctccttgtctgcccaggaccccacatttgtgtaagttgctaattgcacaagggtatcctactgaggccgtgaatagagtagaaatccaggctgggatgggcttatcaagccatggactgtggcaaggagctacgcccacctggagatgggatcccctcttggaatcggcacaaaggctccaggcttccctgccaaacgcggcgcctgtggagctgtgctggggctcagctcttgggtcggacagatgaacggtaaggcacattagcagtgttacctacggtatcctcctgcgtgtcacactggaactagagcttctcttggcatgatgttaaagaatacctgtttagatgagtgtacacttttaactgaaacacttaagaactatgcatagttggaagaggatctgtagtgataagtgactgacttcaccgtactagttgtaaaggcagagtggaccttggatgaaactagaaagtatttgagatcttggggatcttcccatctccccttctgtatgtttgagtcctttcttccttcctttctcctattcacctgccatcccaccctgcttagataccagcttcaatctgtccgtttctgaaaaacaaaaaccacccaccttcttttcactaagaactttgttcaagaggaagaccctttaaagtagctaaaatcacactaagctgtaataactagcaacaattaaatgtctccttcctcaagggtcatgttttagtatgtaaatagcagaaggactacaccttcctagtggactctcaggcagcgagccatggcagggattttgcttgggtgtctgaggcaggagtgctccctttatccctgagaccactgtatgttggtcaaagctctccacagctggctcacacagaagtgcacacaattcactccatttacgtcatcattgttccttgtcgcttttatcttagcgttgtttaattctctattttcattttccctgtcataccattggtcttccagaccaacctcaactcttcgttcttggctgtggcgtggccaaactggcatcggtttttcatctcctgaacttactctttcgtaatttcctttatttcagccagtaaatggctgcatccctaagtcttcttttttaaaacatctcattcccaaaagttacctgcctgaaagtatcagattctgctttttttttttttaactgtggttattaaatgaggcggtaattcagaacttccccactgcttccttatccagaagctaacgccataagcccaggacagggaaaggagaagtcactgagactgtgtttgctagaagcgtttagtaaggcttgtcctgtttttctttgtataccaagcctgatgaggcatggttggtgtttttcttctaaaaatggttactggaaactgggatgttagtttccttttggaaattattccttggcatgaagcaattcctatggcttttctggggcttacatcacgccactgaagctgaactcaccagtgaagttgatcggttcagtaaaaaatctaccatcaagaagcagagccaagtggattctggtcaaagaactcaaaatagctgaaataagatgctcgtgaaaatggtcagtctcttcaggttgattctttaaagaaatgttataatgttcagttcccttcattcaagtgatacatttgaagggttcctgatctttggatgcgtggagtttttcaaatgccaagatgctatggtcatagtctaccttgtccaaaaggcaaaggttttgtatatattgactgtcagtagactctaactaaatcaagtgtaaaatgacaaggtttcaaatttctcttccaaacgaggaagaatcttggatgtctttagaaatcttgtatgaatgagattatactttattttccccctgaaatggcagcacctctcaaagctcttctggcccctgtctggctccgtgcgttatgttcctttaataaagccaaaataaaatacatacagtcttggtgagtgcatcactttactttttttcctcaaccacttaccaaagacagcccagatcaaaggttagcatctttgtttcttaaatttcaagtttttgtcctaccctcttttcccaaactgattgtgctgagaaactatattgctgaacaaatagccaatatctttatctacaagttgaagaaggtgcaagccctcctccaggatgcagaaggaatagtctaggatttccataccgttttctttggtggaggaggttggctggaaaaaggatatatgctggcctgcgcggaagggccggggactcccacaggctctttggaaaggaggaatcaaaatgttgccagtttgtatgccacagccatatatgtaatgcatgggccagagtccactaacatctgtttgggcatgtacccatctgtattgtagcttaatttctaagccagttaaaatacagtcttccatattggcaaatgagtattgagggtcatatgtacagaactttacatcatgtaatgtggtggagataaagaagaatgcactatcccagcttttaagaagcttataatccagttgtctgaagctttgagtttagaaagtctttcaaaaacctgacgttctggagatacactttaagaaaattataattaatgtaagcttgtgctgttgttattgtgattaaatgcttctcttcacgtaggtgctataacacaggtcccattcacatctcacccattcctccaccacctcccaccctcattcttgaatagctgtattccagagaggtgaggcacagagtcaggaattgatctccaacgtgggtaaagctaataaatatgatttaggatgaaaaggtactgtgtaaatgcttgagatgttgttattgctgttctcatatgctttattatttttaaattgtgcgtccttttaagtagattgtttgttcgccacagtctccattatatctaagcaaagcattcacagaaatttctaaaaccttttcatttctctctgtaggttgttgtttcgtaacattttatacaagaaaagctgcacttgaggcccagaatgcactgcacaatattaaaactttacctggggtgagtcggtttacttttgtaccagaatcactttattgcttgaaaatggtcctttcaactgaaggttctagttatgggctcttagtgccaaaaatgactttggtcttttgaggagtgtgtgctgaccccccagttccctgcagcagccacaccagctggccagcccataaaggagcgctggcattaacactgacgggaagcattctcaaatagtgcatcccctggttagaaaatcagagtgaccccactgggcagccacggctgccaaagagtattgggtgggctaagattttaaaaggaaaaaaaaacccaacacacacaagagaagcaaatggaaaagaaaaagcttttattcaccaggagctccttttcaaattttgtctttagattttcttttgaaaggacaaaatgtaccctttacagccataatattaagcctcctaatggtttctaaacagtcaatggtggttaacaaagtcagtgttttaatacccaatttgtggcttcatgttgatataggacagaaaatacaaagcttacaatttttttctccgtttccttcccagtaatatttgatagttggcacaattcaccagaaatgaactgatgttgcatgtaggaacaccagaatacagtttttctaaaggattttgtggcacttttatgtatttcatgctattaatttcctgatgctgtttgaatgttttccccattgacccaaatatcagtgatgagttcataatgacatgcatttgttataatgaagcacctgtggtaaccagtgcaaggataatgattttattgaaacctagtttgataagaataaaagaaagataagataatgtccctaatgttttcagggtataattctacctttgtgtcttttatttgtctctgaacgcatacacaaacacctctgtgtatatacacattcacacatgcacacataaccattgaaccaccacaggcccccagaaaagatagcatttgtatgattcatcctagactcgttcacaatacaagatcgtagtggcaaaaagctcagcaaaagattttcacaacatgaggttcttcatcacccaaaagtcataaattaagaaccttgattttgaatcatactactttggtattcccctttgtatgcgaggaaatcaaagaatagaaggttcgaagaagcaagtgtgtggtcccacaatggtcctgcccagtttcactgcttctctctgaaactgctaaggtggttcttagtaaagctgtttttattgagtctaagtgcttcactcagtgactttaaaaaaattgtattattttatctgcattcttcatgtaaatggacttttttttaacacagattctaggagattgcagtgttgggtcacattgtggaatgaacaagccaaggcaaatatttactgactcagccaataatagatgaaaatcatttttatttcccaggctcctaatcaaacccaaagaccactttgtatttcttcttttaaaaacaaatgctttctagtaatgagcatgccgaatcccttctaggtgtgttttttaaaattacttgagacagtgaactgttgttaatttagcatttaaggtatagtgtagtttgatgccaagtcacatcatattttaagtgaatgcagagcttggtgaatatgtatttatccctctactagaaacacagctcccagcatgcgatcttcatagtcgagggtgcgctcaagaaacccagagtgaatatgatgaatggggcatgttgaaatgcatgaaagcgacttatgagtatgcttctgtttgggattcttacactgactcttagaaaacaacatgttttatattttttaaatattgtacgtgtgttacttcttttcttcctaaaaatcctgcatgtagaattcaggggaggtgatgttacagacccactgtcaaggacaataatttgggagctggaaaagttggtcggtggattatttttggttttctccttatctagtttcatatgcccaattacttgaggcaggttgaaggaatttgaaaagtcagatctgatttgtaaggctgatagcctttccagtgcacacacttgctacatttgctattccaaatatggtaaatgaggagagagtttcacatcttgcatttatgtacagcttcgtccagtacacattacccttaacagctataggaaaaacatgaaagtgttttccttttagctgtgtgagtctttggtggacagaaagaaatgggaccagacataaaagattaatgcatattcttggaagaaaaaatattacagggtgccttgcggtttgattacaagccttgaaattagtcaacatttccataattctaaaccaatatacacctgttttcccactgtgatgtgaaggcacaacttaatttaacagagaccctgctgtgctaaatctctcattaaataccaagtgagttcggtaatttaaagttgtacactactattttaactggttgccttcatattatgaaattaataagaaattaatgatgcactttgccatatgccttcaatttctttctgaataaaactaaaagtgataaagaaaaaatacatcaccagctgacactttaaagcttttctggttgtaatcattttcctgtggataaaatccattaaaaagtcacttgctgccttttttctaaagtgtccaaaactttcgatttaaaacaagatcaaataatgctagggttttttccgatgtaattttcttttgcagttgatgttttgtttcataaggaacttttattatgcggccaagcttgattgatgtttggagtttgctttcctctgtatgcgccatctttctttcttgagggacacaaagaacttggttagttaggaagcagaaacaagttgataggatggtctgttgtgcaatcaaatgtgtctgccataagattttgatttaaaggcaccctcctttacatgtcaggaatgaattttagaaaccctttacatggggctggagaaacgactcccagattgaggtgacagatcagggctcttacggagcagtgcaaaatcattgaagacacgtttctcaaacttgcctcttactgggtaaccaaagaagacgctctgttttacatcccctgaaattctcaacataaaccctagaaatacaatggcagtcataaaggaagcaaattcaacagctcaacacagagcaagggatgagagtctgggagtccttcccttggtttgatcacacatctcctctagaagtggttgctggatgctccagcaacagaagaaattttaggtacagtgcctcattagttactgacatttcatgagattaatcccaaatgatcatggagtgcctacagtgtgcctagctctaagctaggtattggcaggaagtagcagggatcgagcccaagggggcctctagctaatctagctggaagggtggacagtagacaggtagttaatacttacatggttcgtgctttcacgcttttctgctgcagaatacccattccaccacacacacacatccttgagatgcctagtaagtagagcctttgtagcctgaagataacactgtgagtgtatctgcacaggctgggctacctgagaagctgttggatttggtgccttgttaggctgacttttcctactgctgggccatttatggttttggactaattttggttgcacctgctttgatgatatgtcaatttggggttacagatagcatcccttcttgagggttttatctaggcacaacctaactggtagtttgttcagtagaaatgtcattatctaccattgtgtttcccagagggacatctttgtcaaggcaacttgcaagattttcattttgttttttattgagctaatttagctcaattaaaaaataaagtaaaatagagacttacctgaggcccagaaaaactaccaagatcttttcaataatcagatgtcagggccaaatatcccttgtgccggtgtcagcaccgtgctgggtgtcattctctttccaaggtcttaacacatattgtctctggtaataaggcttttggattgaaatccacagcagtatcattagagcattcactgtataaattaatttaattaaggatgtaataacagagaggaatacagttttgagaaacctcttaaattttaacagcaaggaggaagctgcggaatctaaatgtcttgtaaaatattaattgcaaatttcttccagacatcttctctgaatatgccttacccatttctttttagaatcaccaccagttttattaaatgcagtttatattaaggagttattgccctaagagaacatttgtttagagtgctccattttagcagcagcatgccaaaagatgttttacaataacccatgcaaggtgagcgaggactgccagagatctggggtagaaaaacaaatgagcctgatccaatcggaggaggcaggaagggaaatggcctcctgggacaagtgtgttcacccaggtggagtgaatgggccccttcctggcctgccctggaagagataatggaccagtgtgggtaggcaccttcctcccaagcaggcttcactctgctcgccatggagttggcctctgtgttctttcctagtggagtgctgcagtttctctcttcagcaaaaaagcttgactctcactggggccaaatttcatttgcccattttaatgcatttggaggtgttcattttctttgaaccacctctcctacttagtgataggtattaatgcctttgttctcagagccacgattatcatcattttatcattgtcatcatcattattatttttgccataaaatctctcaaacctcatctcactgtgtcagagaaatttctcctgaaaccatcccattggaatcaaagcctaactgggccaagttagagtatttttttctcacatgcctttggtttaaaattatcatggaaaacaaccgaaacatctgtatgaacaggtttgagtcctcgaagtcttgtgccatgcggggcacacaaagcgctgatgcatttctttattcggcaaccatgtattgaacgtttattgtttgccaggcactgttctagataccagggaatactgtagtagcagccatgccctttataaccaaatcaccaaaccacaaagcctgccaccatgcttacacgtggtatgtgtttagtaagtagctcttacatagtgaatgcccgaataagttagtttttataatgaaatatttccaaaggcctacagttttattttctaaaaaaagataattatgcctaaaaatatttcaaatgttccaaaatataaaatgaatgtagatacgttatcacatgtatgtgtgtttagtgatacaaattgtttcatagacacagatctatatatgtgtatgtctatatgcccataaacataccttccacacgtacacctgtggatgtcagtccaaataaatggaggaagatgaaagttaaagtcctccccgttctctgtgcagcctgctggcttagtctcaattactttgtagcgaactttcttatttgaggcttcaccaacgatctcagttccttggtgtaattataattctttgtttatgggtgctttgagtccggatcatggcagattcatggtgcgtgttagagagggtgcttgagaaatggccgtgcgatgatggtgagctctgcttcccagcatcctcacagtcaggcctgagcggggcactgcctgaggagcttcctgagccatgaggaaacatgcctcaaaaggcactgtgtctgcctcctcatttgtgtaggtgtgaactctccttgtggagcaccccagcatacaaacgtgtggaacatacacgtattccacacatgtattctgctgcggaatgtgtcagtcaggacatccatttggtgcagatgcttcagatgtacatttgcagaatttggcctgggctgagaaattcgccctcatgggactgcctaggaggagccatttccctgccatctgtgttttcagataatactcaaatctcatacaaataaaagccaaacaaacaaaataaggactttgtttctcttggagatgactttttaaggactgtgacagagagtagcagggggagctccggaggagtccttgagggtgcagaagctcccttccccctgcaggagtcacagcagtatgaaaggggtaggggcagagtgtagacccagccccaagtcgggctcagccaggtgcaacaggatggctcccagctgagcggtatagatccaggagaggatatcggaggatggaaggaaatcctgggcccagtgagttccattctgcaggcccaggccccagggcaatgggaaagtatattttaatgcttaataaaaggccattacaaattgtctatttcacccgccataaagttttacacactacctgaatagcaggttgttttggttttggctggcagtctgttgattcagtaatgttgatgggcagttatttacgtacggctttgattaaaataaaaaactagttatttttaaagcatggcctactcggtataaggaattgtacgagagaaaatgtatgaggattcttcagtggtgcaaagttgaaaatgccagcacaggattacagtagggaatagccacaccacttttggcctcagaacccagtggaaggcaatgtttagttttgcaaacaacgtagtctcagctatatccctaattaataggactgttgccagggcttgtgtgagaaagtatgttaacgcgctggtactggtgcctgatcagatttgcaaaagtgccttgtgtcattgcttgagggatactggtatctcattagtatcttgtgaggggatggtaggatggtacaatggcaaaatgaagccatagttagatttcagagataatcatttctctacgacagcccaagattaaactgggaatatgcagttcacttacgtcgaccttagttcccaaaaggttgataggatttcaaaagaagattgtgggggaggcgggggatccatgaatttgattaaaggtctgcatggaattacagaggaaggaggtgagctatgataatcaaatgatgaaaggagaagtttgatatacacctagaaaattgtccaaattctgtcattagcgtatagggtttccatgagaactcatctctgagaatatcatatctggctggacagatctttaatctttgacatcagctgagcgtaactcaggagatgatgtccaggtgaagtgcgctcgtgagttcggagcctggagctttaggccacacaaaaagcatacagcatgggtagatgtggagagagttctcccaggaacaccaaggttcttcccccacacactaggaaatagggaatggctgagctggggagagccaaggccaggatcagagggagtcagggctctgccggatatggtctggtttgtgcagggaagcgcgctggacacttacaggagggcggtgtggggagggaaagaagtttcgtctgtccctctgctcgtttcaaccataaatggtcatagcatacaggtgcctgggaagtctcattagtagtatgacataagctgttgaagttggtttgataatgaaggaatatttcaggcccgtaccctcaccactctcactgcccaccagccgcagagatgaaagaataaacagtaaacagtgcgtgtggagatcgcagaaagggacactgtgacaaaggctctctttcatggtcctcattgtccctgcctgtcattacttcccattaacactcaaaacacacatttgtgctgccatcccctcctcctccagccttaaaaacgcttgcaatgccctctgtacttgatctgcaaaacaaaaatggttggactgagtggctctttccaatcttgcaaaactcttctttgctgtccatgcattgtctgtggtcatgtcctatttaacgaaaatctctacactgtgacttaacttggttctgtgatgggttagtcattttagagtacttcacgtagacaaacgtggattattcaagctttgactataccctttgagattgtctgggcatctgctttcctctctggttgagaaccaacagggagcttagtactcataatttttccaccgggaaatggagaaaagaaagggcaaggggatggactcgaacgagtcagtttatttccttgtgtacagccctggtttgacaagaaagggtatttaacctaatgaggtttcaggatttttggtggatttttttatctatttgattcctgtcctcagctaacatgggtaagtgactcctctgtgtttgtaaatggctttatagagttgtttatttgttatcccttctaaaaatatttcaggtgatgtatcgatagcattcaccttgttacactgaggacatctctgaagtgccagagattaaattaacttctctgacctccctaagcaaagcagtgatggaactggaattagaagtcgtcatttctaggactgcccagttgggttggcctcgtggtggtggatttaggtgtcatgctcactgcattgtagggtggaatgggcgtggcttaagaggccagcacagcacaacgggaacagtcaccgtgaaggaagtagctcctctttatgggttgccatggggaggctccatggctgtggtttaattttcacaactccacaggacatctgttgtataccctgttttactgacaaggaagctgaaactcaaagaagatgagtaacttgtttggggttaaacagctggcacctgactttacaggcagttgggtagaaccagtatgtctggactctaagccaaggaactttccattctgctgtgtgttggtgcaggcttgccggtcccggcaagtggtcctggcaggtggagggcctcagaaggaccacatttgcccctttggcactgtcacaaggtaaatctaaatcctcagtcctgccccactcctgcagctcgtcatagatgtggaacagcaggaccatgacagttctggctgtgtcagatggcatggacctgctgacagggtgcagcagcatgaacctagaagtcagctgggcaggcagtggccacacaaacacacacacacacacacacacacacacacacgagctggccctgccacagcaggggcatcggggcacctggcagcggctgtgcccaaggtgggaagccatgttcccttgcacaggtcctgaaaaacattcagcgagcgaggcaaggtatttgctagagacttttgggtgtgaagttactaacacggagctttctaagaggaagtgatagatcaaagacagtcatcactgtaagaggtactgctttgcgaaagtgattataaatgcaccatctttcttcagcagcatcatcgcattgacattcatgttattagggtgcatttctttatctgcatccacaggctttcagtcccaatccacaatctgcattttaatgcccagctccgtccaactgtcctcgccattgctctgcttccgtgttccacagacaggggaagggcaagtatggaggctcaccctggaagagtgagcaggactctgttacctgcaaccccaagctttaggcagcaggacaagaggccgaggttgtgaaacaaacggaaacctcaacctgcctgccatcatcacaccctcctgccctgaaaactcctggaggcctttagaaaggaactgttctaccctgttgttttactaatgaggaagtgatggtccaagcagtcaagtctgcataaccatctaagcttctgaatctgctgctgccgacaagggaccagactcaccaccacaaaccagggcactgagaggtagaaccaggcagcccacgccacagatggcacagcaggatgaacacggccccatgagacagcgctgctgctctccgcatcacagcaaagtcaaggcaaaggaggatgggtgccaggggtgcctctgcatgaagtgctggaagcttggacattcctaggccagttaggatcaaaggctgagcactggctgcgatattagggccagttctgggttggctctgtctagccatcacattgtggtttttgctgttatctgctgttagattcggccggaatctaagggatagagatgtatcatgaggtggaagctcaggctacctctatcttagttacaacagtcagagctcatgatgtcatggtggcctctggcagcttgggttagaccaggtggttatttgccacctgtaggctggcactttctacaacactgtcacgcatcagggacgagggtaccgagtgagagcaaaggataggctcctgcaaactcatctcctctcctggaggcttaactgagtgactgtgggtcgctgggtgtattttaatctgtgacattccacactttgtgtactcaccagcacatacacggtattattgtttcctcagaagagtgtgtatttaaatacctgccaggaaactgtgcaggtatttcacattaagtagcatatggggctcagtgtagtcaagaagtcacagggattaggaaagagaaaatgaattgctgtcattctatatatgttatatgcttagtaaatgtcagaacagtagtcacagaacctcaggatgtttctagcatattttggcttataaatgttttgtctacataatggatatctatcagtagctttcagaattcaagtaattttaatgaaataacactaaatgttcaagtattaaaagtagtggtaacagttaacagctattgagtgtttactatgtcctcagaactatgccaagaactttatatatacttgatctcacataaaaaacaaataaggtagtaatttgtcttccttacctgtttgccttttcaactagaagcctattgttctacattcaagaaagtgaaagtggctacacctcttagagaacatttctttaatgatacatcagtgagtatcttttatgggtaataatctacctattttaactagatacaagtatgataagaaagagacctttcagttaactgaagctaagctcatcctgtcttccttacattgctaatatctgacttacaatttactaatatttgtaaggtgtcatttaagtaggtgtggaagcattagcctagattttgactagttctttggtgtcttctgcagctcatagaggcactataatcacaacccccacccgcgcccctcgcaaaaaaaaaaaaaaacttggaaccaccattttatcatttgagaatctcagtcactgagttaacctgaatcactcctaaggcagagttaccaagattttaaaaactctgcaggtcactgacaaaaactaagtatcatcagtaaggaaaatacttaagagagaatcaaaagcccaggaaatcctgtagctgatttcagtcggttctcgtttctttgaatgttatgtgggtcaacagaggaagaaaggacctgtgcaggaaagtaggccggatggaattatagatcacagaccctagaagcacgtcctgtccaagctcctcacttgatagatgaggaagctggagcccaggaaggtgggaggacaggtgagatgctgaaggtcacaccagtcagtgctggggtgagtacagatcacatctcctaactccgagcctgttgctcttttcagcaaaccatgcccccgtgatttctctgcaaggttatgccaagcatgtcaccttaaagaatcagaaatccagaatccaaatttccagtctgtgtgtagcatttcattccatgacttgaggctgttgaacttggtgttttctttttctcatttccattctctgggaaagacccagaaacctaataagattcttcctggccatctacccaaaatgatatgtgcagtagatgaacttataaagaaccgatgaagacaaaggaaagcggtcctttgtacttcagtccatttgcatataaaaccggggcagtgattctcagcctcagctgcacaggaatagaatccctcgggagcttttaaaactgtgtatgcccaggccacaccacagccaaataagactcacttgggatgagagtctggcatcagtattttttttttttttttgagacagtctcgctctgttggctggagtgcagtggcgcaatcttggctcactgcaacctccacctcccaggttcacatgattctcctgcctcagcctcccaagtagctgggattataggcatgtgccaccacatccagctaagttttatatttttagcagagacagggttttgccatgttagccaggctagtcttgaactcctaacctcaagtgatccacccacctcagcctctcaaagagctgggattgcaggcctgagccaccatgcccagcctagtatttttacagcttcccaaatgattccagtgtgcaggcaagttttagaacttctgttaagagaatgaaccattgttgaccccaagggctaggtggtggtgacataacttgttttcatcttccgctttcatctggatgtacaggcactgactctgacctgctcatcatcttcccacaggtacactggagtcttggtactcaagcagcagtcacgtcatctgagaaagtgttagaagtgcagccttgcaggccctcccccaggacctgcatttgaactagatccctgggtcttacacgttcacacagaaataatcatgtgaggtgacagatacgttaactagcttgattgtgatcatcatttcacagtgcgtctgtgtgtcagaacatcactctgaaaaaattaattttttttttaattgaaaatactgaatcctgggtgacatggatacatagcaaagtttgagaagtgctgttctgtagaaccggtcctctccgatgctctttccctgggagtccctcacagggtgcactgtagggcaaccccgtttgtgtgtgcacacacacttctcgcaagtgctgggttgctgtgttccctcatctgagtaccaaagtcaagagagatcctctggagaggctgccaccctccctgtttccttccagacattctgaaggtggggtggagtagggcagcctgactatggaggacaggaggtgagaaagtaaatggagatgtgaggacatgctggtttttccagcatccttgaatgagcaactgggtttttccctcccaaccatcctctaaattgtgggaaatctctgagtgggacttacatagaattaatgtgtgtcagactgtaaggggatgaatggaaatgctgctattttaagcacagtttttctggccagaacaagctaattctaaagcatgaggaacaattttctgccacaaagagttaatctgtaatactcagcagctcatttccaccttgcagaaagcatcggagtgtagagtcctgctgtttcatcattcacggactcgaaattcgttaccaggaaagcaaagcatttattaccctgtgtctcttgctatccgcagcttgagagacttttgctgacaaagaaaatgtaactaccacatgaatgctagagtggaatatactattgcctgatgagggatgctgggtctatgtatgtttttgcaatttgggaggcttaaaaagaatgtcatctgccctgaacagtgtaagatttccccttgagtgagttctgagttcttgtttttcattcttccttcttgtgaatctggagaagtttttcacattgtgggttattcctaattattgtagctacaacaaacatcctggattgtagtctgtaaggacaaaatcatttgttgctgcataaaacctgaacttaaccatggtcagcgtttgcctaaatcagcagctgctgcttattagaccagcatcaaagagtgagctgcagttgggcgaccaaataagaaacaaagtgattagaagatccttgtggaacaggaaacagagtggggcaagacaagagagagcatatacccaggggaggagacaagctagggtatcatatctgcttgatggggtgtcagccctgagcagagaaggggatccggaaggagtatgtgggctggaagataaaaaggaccagggttcctgcagaacttacagaagcacacacattgtgtccattttgctcattgcaaccaaatgattaactcttcagaaaaaaaaaaaatcctgtttacttagtttgtatatggttgctttcttttttttttttttttcccaaaaaggcaagaaacgtttagtctttgatagaggagacagctttccaaacaacgggactcaataaagacagcatgaggttaactgaacctgatcctgtctcttctctttcccctctcttctctccattttacctgcagtgcactcaaaggcaaaaaaataaaaaataaaaaaataaattaaaatctttcatcatctcaatattacataaaaattgtgttcaaaagagaaaaccaaattttacctttgcattcatgtattattagtgttaagtaccaccgccccatctttttttttattatactttaagttttagggtacatgtgcacaacgtgcaggtttgttacttatgtatacatgtgccatgttggtgtgctgcacccattaactcgtcagttaacattaggtatatctcctaatgctatccctcccctctccccccaccccacaacaggccccggtgtgtgatgttccccttcctgtgtccatgtgttctcattgttcagttcccacctatgagtgctgtctttcattctcacattcctgtactcatttctgttgtttcagtatctgattagagctgaattaatgtagtcggggctaaaaaatagcttctatctctcagtgacacatttttggagactcataagcctcattgttttctcatcagtgacaactttgtctctgagtcagatgactcgagtctccttcacccgtgatcttggggggaaaaaatagaagtgagtaactcacacagccacaggaccaagtgatcacaatcacagcatccactcattagtggaaatgagctctggactcagtccagttgacgaatggtaaaatctatggctcggaaagaagggaaagagcagtgctgaagatgtttgagttcttggggtgacctttgtagctcctcctgagatgtgccttgatgatgttgccttgatgatgttgcatggtactgatttcaaggacacaccacgctatatttttacataatctgcttcagaggagttagcccacattcatggataggagatggcccacattcatggataggagatagcccacattcatggatgggagaagaaaaatggcagagcatgctgcatatgtggcgggactgtcatgaggctgtcagagtcaattgtgccaggttcccaattcccagagcagcatcccggagtcttgtttagtcatgatcttcagcctcttgacagcatttggttagcagacactatagcttggactccttggatgtgttcataggcattttatcttgactctgttctctaaacatggcacactctgtaagtttcattgtaatgtggctattaaacatgtccactgtacattaagatttactgggaaagaaaacctacctagaattcagtaaaattctaactaatgaaagagtaaatacaccagctgttcaggcccaacactgatttttaaaagggcagattgggcctgggctacagctcagaatgttgaagaggctggattggagcagagctgagggaaaaagagaaaaagacaccttacgccatgggctttcacacacgcaggagaaacaaacgctgtctcctaagttacaggaacttgggtgtactttttcagagactgcaagtaaagggtgtgatcaaatgctgccctttaaacactgacatgccccgagttctgttttcactgctttcttctcacgccgcgtgatttctttaggtcccagtgatcccaggcttccgctacctctacaggctgctgccagccaaatgtttatctgaaaatcgggcttctctgctaaaccccagacttagatacccagtatctgctattgaacagatccattcaaatggtctacaggaaattccagtactaaaattactattaaccaggtcttcctcctgtattgcccatcttaagtgaattggtgggtcagccaaagccaaacgcaagaaatggtcttcctcatctcctcttcctacatacacttcacctttctaacccccaacctccaacagtgaagataccgggatgctaccttaatggcacctctagaattgctccgtctttatcaagttgggactcaccagttgtcattaggggtaataaaggcacagcaagggtgaggggatttgggaggttatccctgtaatccccatgcttcctagtattctagatgctctctagaatgggagaggtgggtgtgccagagttgtacatcaccccctacacccacaggcatatgtgaacattgctgcatcttgtatcagaaaaatcagatgtgactgctgagtttgaagggtgagatccacgctctatactgtgcccctacctttttcttcagcttctgggacatttttgctcatgtgctgtgtcccagctgtatgatacgagacacacatttggtgtcttatcctgggaaggtagaggtgaacattgcttcattgtaatttactgtgtcacatggttcaatttatcctgtcacctgctgttcttcattcccctccatggctgaggtctcagctgctcctgttctgagctccaaactccttgagagggaacattgtcagagcccggcttaacacctcacaccatagatagtgctcaacaaatgtttgttgaatagatgaactctgaagaacagcttttattcatagacactctttcaacataaaaaaaattcaagttctggctgggcgcggtggctcacgcctataatcccaggactttgggaggccgaggcgggtggatcacgaggtcaggagacggagaccatcctagctaacacggtgaaaccccatctctactaaaaatacaaaaaattagccagatgaggtggcgggcacctgtagtcccagctaatcgggaggttgaggcaggagaatggcgtgaaccccggggggcggagcctgcagtgagccgagatcgcgccactgcactccagcctgggtgacagtgagactccatctcaaaaaaaaaaaaaaaaaaaaaaaattcaagttctttacaaactggtgggtgggggtgagaggaggcagggagatcttgatcccctcatccccatcgcaatcctttccatcaggtagatccgccctccacagacaacaaacgcagtagagacaggaagccctgcagagttaaaaaggcactttttactctaattataatccttaactgaatgaagaagagggttgacaatccctacgtcactttacattttactgtgtactttcatatatattttcttattcagtcctcacaatgatgcagtgagttttctggtacaatccctgcttcaaacatgagtttaccaagttttaacgaggtcaagcaacttgactcacatacttggaattggcagagtcagcattcaaactcagaccttacgcttctgtgatgttctttccactaacaaaaaacaaacataaagacaaaaacaaaacagacataaagacaaaaaaaacaaagcaaacataaagaggcaagcttcgcaagtccccattaaatgctacatttccacagttgttagaaattatgaaagtagaagctatgtcaccacaggtcaagtgctgtcaataaagagttcttgctttactccttaacataaaatctctcccacatgcttgtctcacatattcctcatctgtgtttacctttgccatttcaatttcagttacgtgcggtatatctgaaggcctaatccttgaattttctctttaaaagattgaacttgaagataagcatatttatagaacaattgaaccttagtcataatttctctaagctctaccaaccagtattttccaaagttggtgaacaatctcacacattagaatagaaggtagaaatcaaaatgagtgaaattaaactcaaactcatgaagactgagcaacgctggaggagagctctttgtttagcaaaataccaagcaaagtcagtgcaactatggaagacgagatgaataaatgtagctgctgaaaacaatatctgatgtcttgctcagatgtttaatggatttgcattttaaacatgggtaataagaaatagcccttaaggcactttgtaaaacttgccatttatttttaggagagaagttttttttggggggtggggggacagccttgtttgtttaaaaggaaaaaaacagatatttaatcatttttgcttaaacgtgagtaagaatggggaattaccctagttatgttttcattcactcagtacaactcccaaaggccatggaggtaaatgaatggaaaaagattgctgagtgaggtgtggtatttatgtgtctgtcgtaaatgaagttgtcattcctaaaccaatgaaatcatacattttttatgagaggttgcaacttgcagagaggtggaaatgttagacactaattaataaacgtggctggcaaagcaactcagacaactcaggactcataaactaagctatgggaggatcgttagaatacgaaattcagtagtgcttttccattgatttcatgaaatgcccgtatcctgtcagaaggttcaagataaaatacaatcggcttaaattttccaagttagttttgaaccagagattttaaagatttgcttgttagaggggtattcttgtggtggctttagattgtcttaaagttcaaaggaaactagagattactggataagcatcaataacattaacagagcattgaagctgcctggagtggatggaggatgccttgcgttgtgcaggaaacactcatcaattctgtggtttgtttagagggtagtgttgttttaagtcatcaagtcactgtttaacttgaattgaaactagtaaatactgcagatgaattactggatagctttccaaaccttaaaaaagaaagtctacaaaagtggaacttcttggaccttttaatgagttatctgaaaagaagagaatgtggtttcattcgtatgcaatatataaggttgaaccatatgaaacggtcactattaacccatgtttttaaaaaactacaaaaacggcaatttcacagcaattacccaacctaacttgaagtatagctgtttctgtataataaatgtagaacagttagattggcaaaggaaatacgtgtgtacgtgcatgagaagggtcattgtgccgttgtgtggataaacacacagcagaagttcatggaatagggggttgcctgattccactagaagagagagtgatggaataatgcgaaataggcctgaaaagagagctgagggtcaaagcatggaattccctgaaatacatgccaaggagctggatattaatttggtagataagtcaaagtctttgagtgggggagaaaaatttctagactgagttttagacagattaaaaaggcaatggtgtagaagatggaaggcaatgaccagaactggtgaggaggctgtttcggggatccaggtgagcaggaatgaaaacctcactagggctgtagccgtggaaatagaaaagtctatgagaaggaaaagaaattaggagagagagagagagctaaactgaggatttcaaggggtagaaaattaagcaaatttagagccacgccagagtgttaggtgagaggtctgagaagctggaagagctgcccccatcccggggttgatgtccccataagccgtggtctctgtccagcttctcaagttctctgtggggtacccagattcaggtcatttcctatggggtgaggcaggagtgtggctggaagagtctgagtagtaggtcatcctgggaagcagtgtaagagatcagggtggacagagtcgagccctgcaaagaggctcagaagatccaggtgaggagacttgttcccaatttgaggccagcacatgtaccaggtcgtcaaggggagcccaggtgcaagggctgcttcagccccactagcatctccacactgggtgagggttacaagggaggctgggggtcagccactcactggcttttggggctttgttcatcccagttcccaagatgtcgagaactgagtcacagtgagccccacctgacaacagctggcactggggagggcaccgaaggctgagggagcactgaggccccaggcagcgtcacggccagagacaaatgtcacaaggatgatttgttgttaaaccacaactcgtttctcttaaaatatgagagaatactgtttgtcggtatatgttattgaaagtaatggtaaaaaccacaatcactttcgtacaaacctaatagaatctaggattggaaatgtaaatgagccaccaggtaattaaaccacgcctttagtcgcctttaatggccaggtcaggcattatcatttcagtgtgtattttgcattgctcagttgggcagcttgtctgatttagcgcctgggtaagatctggagaacatctggaagaatgagtattggagcgcccatcattgacttcggaagacagttccacaagtcagaaaggaatcatggctgagaggatgtcagtatacttcccacttagtgataagggaagattattacctttctcttaatttgagctcattaatcagtagtgattgtgatcttccgagtgtcgcacacaattctcgtggtcttttgttgtaattgtagctgtcatagtacagccttagcagcactataatcctataaggcttttcatacgttgaatctttccatttatctccattttcaaaattgttttataccctctagtttcttgctattaaaacatagatctaagcaaaggattccagacaaacctaggtataaacttttaaataaaaactagttttgctttgtatttatttgggagctcaactgactggattcattgcttcttatatcacaaaggtgcattgacataaagggaagaactaaagtattatcaaataaatttcctgttcacaataacattgctaaacacagtgacaataccttctactgagatgatagctagttgggtgccacatctaatgggaaggttaaaaaacggcatcagtttattcatctttatcactaatatagtaaaaatatttctaagaaaaattgaactaagaaaagattgccatttttttgagtagcagtgcttctgaaagcggcacactcacactttgatcatagctgttatttttcattcatggtccgtgcctcctattttaagcctattcatttttcttctaattttaacattaaataaagcaaaatgaaagcttgtgttattatttagtatgaaaacacagaacctaatcacagctaacgagtgtgataaatgctaggctgtaccttctcttgtttggtgtgtgttttatatacaggaggtaacataggctgaggaactaggatgccaagttacagatggggttgtggaatgctgtctgacagccgattagagtaatctgtcagaaatgatgacttaatcaccataacagactccaaattccctcatagaattccacccagagtaatctagttttcctgcaatattttattttattttattttttgccaggactaaatggctttgttgcttgttttttcccctttggtgtacgacgtgattttaatggaaatgtaaataggtggtatctttacagcacaaaggctgatttggagcctgataagccaaaatcagatatataatcctgggttctgcagtttttctccatcactagattattagcctgtggagttgagcactgctggctgtatatatcccaggtgaccgagaaaggccattctctccaatgtgttctcttagctttcagatgggaccttgtctccttcccctcagggaagctcctatactttgcaaaataataatgaagaggatgatgatgacaactgtagcgggcacttactgtgccatcagtgttttaagtgtgtcacacacatcatggctatcaggaaaaagttgtaatttatttccactgtagtttttttcccctggttgggagaaggggatatgagataaggatcacttctgtttctttgttgttaccaaactcaaatccacttttttttttaaactggcttagatcacttttataaaattatgtcagcaaatggtgattgaaagttttctgacaaggcacagtgggtcgtgcctgtaatctcagcactttgggaggcctaggcaggtggatcatcttaggagtttgagaccaacctggccaacatggtgaaaccccgtctctacaaaaatacaaaaaattagccaggcctggtgcaggcgcctgtaatcccagctattcgggaggctaaggcaggagaatcgcttgaaccgagaggcagaggttgcagtgagctaacgtcatgccattgcattacagcctgggcaacaagagcaaaactccatctcaaaaaaagttttttgtgtgcctactatgttaatcgtgatatgtaaaagaacaacttgaaatagcgctgagacttggaggttaggtaaatgccatatattctgcctccatcatggaattggcatcttcagagggtaacagttttttcccgaatttccaaagcagtgttcagataaatagaccttgcataatccaggcagttaacataaagccacatagtagggccttttgacatgaatgattgttcacccaacaatgagtggtcttcactttgattcgttttatagattccagtgtacttttttgcactatcagtttgtgaatacaccacaaaatgtaagatcaattaacgtcagtgattcacaaccattgtttcctctcacacttctcagcgtctatgtagaacatttcagacagctggccctgtgaaagaaacctcagagtctaatccactgtgtgagttttgaacctctggatccaagcatagatttagctctgtccttgttagtcgaatggcaaattagccggggctacacttccctggcctgactctaaagctatttttttttcattacatgtttttatttctttcctgcccttttcataaaacccaaacagtaatttttgttcttgggctaattgttaaaacattgtatgtgtatatgcaaatacacaggtatactgcacacacatataaagtatgagttcctcattggaaagaagcctgtaggtggaggcaatctttatgtgtagcgtggaagagggaaattatggtaatgttacagattcttagaaaccccaaacttacttacaccacaactgtgtggatgcacatgacaggcggcgtggggtagaggcctcaggcttgtgctcccaccggacagacctggattcgaatccctgctctgccacctgcttgctgtctgactcggccaagttatttagcctctctctgcctgggttcctcataggtaccgatttctggggctcttgtcaaaattcagttaatgaccatgcataaagagcctgtagagtgacggcgaaggggaggcttcctctgtgttgacagcagttgtctaaaggctccattccacttatcaggaatagttatgacctccagatatggctttgtcccagtgataaaaactgcttgttatttattttttgaaacagggtcttgctctgttacccaagctggagtgcaggggcacagtttgggcttactgcaacctcttcctcccaggttcaagcgattctcctgcctcagtctcccaagtagctgggattacaggtgtgcgccaccatgcccagctaatttttgtatttttagtagagacagagtttcaccatgttggctaggctggtctcaacctcctgacctgaagtgatccacccaccttggcctcccaaagtgctgggattacaggtgtgagtgaccgcgctgggccagctgcttgttattgatctgacagattatttttgtcatctgtattcttttagagatgtccttctattaaagatatcttagcaagtttaccgtagtgttagtgttttgtttttatttttttaatttgaaggttcttctttagtgctgattgatgttcctaagtcaccatccctaaagctatttttgattattccccatctctgctatcaggagcataatagaacagtggctggaattagagtcactcatgagggagacaggcaaacctgtgtgggttgggggtgtcttcctatgtaatagaaggtctcgtggtggggcatgctgtctttcatttgaggggatgatgggcctccagttggtggcgaatcttttgaaacttgtttttagcattcccaaatttttttagagaaaaattcagaaagtacaggtgcctttggcgtttcatagtcaatatacaagcgagacacaagtattctccatggatgatttttgtgttgtcatggaatgaaagaaaaataccagtgggtctttactggccataatattttcgttttctcagttggcacatagctctttcgtgaattcacttctttccatcccctctctctacttttaaatattttatgggcagtaagctcacaatatgtgctagcacggctgctctctccagaggtcaggatgggtttaataatgagatgcgtaacagtgactctgtaaaaacccatttcaggttaaaaatggcatgttttattgaatctcatgttaaaggtggttaactcatcaattggtgatggctggggttaaacaagttccaacatgagttctcctgtgtgtgaggagccagctgtgccccctgcccgcagctgcttccttcccccaggactctgtctccagactaggcctgtgttggctcggaaccctcccttcctacagcagagacccaccgaggcagagggcttcagagagccccacgaggttgtgtccatagtggcgactctggagagtatagctgctgggtgcagctgctccgtggccagcttcacggcggcaccaggtggtgacagctgttggcagagctgtgtgcagcgctctgtgcatgcacttacccctcagacttgagaaatggctttgctccaaagtcgtactctcattttcattttcatgagtcacagctggggccttgtgggaagaatcgaaggtcagcttactcaggagtgaggggcatcaggtccagtcacaggccagccagggtgaggaccagggtggaccactcagctctgggaccctgtgtgtgtgtagggagggagaagaggtgggaggaccatgggctgcttatccccaggaggtgggacgaagggggaggcctgatgctgggaggcttgtgtggtccgccaccaacagatggctcctaccagggcgacagggacggaggcgccggtggcaactggtgctgggtcagaaccaagccactgcgtgctgtcgtgggtgcagaagcttagctttggggtagaagggacagtgggccaggggccttccctcaagaagctccagctcactgaaagcccaagcagacccctgaaggactatatctctgtgtgccgagatgctcccctccatgagctccaccttcattgtgcataggacgctgattcttagtacacagcagcaacagagcttcagcagatgccttcttgggaccgcgcttgactctagttccttctccccgggagggagaaagggaaggagcctttgaaatttcccctttcgctatgtttcactggtttttaaacaaatagggctaaatagagaccaagaagttaaccatgtaccttaacgtgcggctttaggcaaaatgttattcaaaaaaaaaaaaaaaaagcttctaaaaattcatgtaccatcaaggaaatcttcacatgaatgggtttagaagcctttcttgatagcaatgtgaacttgaagaaatgtgtgacatcccgtttactcccatcaacaggatctatttccaaaactcatgctcctgccatttccccacaagcatgctgcggccttgcgtgagaggaccagagatctcctgtcgtcttccaggcttgctgcaagtgcagctgagatgaacataagtaatagactcattaattgtttcatcgtgactcaggaaaaccactctgtaaagtcagaggctggtgtttgtaaaattcttagactcgtcgaacagcatagacagatcatgacagcacagaccactgaagatttttttagatacagcccatactgtgtctgaaaaatactcactcctgaattaaaacttcccattctgtgtggctggagatgcagcctcagtttaattagcacacgtctcttcagagactccttgcaaaaattctggaagatcgtgtactcccttgtcatagacagaggaaggaggtggcccctgggaactagcctcagccctgaccctagccacacagtaggtagattgaattagcgaccaccacatcacctgggccctcccccgtctcctgctgtctactgggacctgcaggcatgtgcagggcacagcatgagatcctgcctccagccccatctagctctggcagcagggagggccagggtccctagtcatggggaagcagttgagaagcaacagttctgaccccactcatttcatcattagctcttgagaagggtgctcagggtgtggccactggctgccgcctgtcctggcacctagggaagatttcattcaggagtgagtagatgggcattgtttctttttacttgaaattgtccagcctatgaacatatccctcactgttagtcttgtgctttaggtgtcttgttttcggtgaatgttctttttaacaacttccattggccgggcgtggtggctcacgcctataatcccagcactttgggaggccgaggtgggtggatcccaaggtcaggagatcgagaccatcgtggctaacatggtgaaaccctgtctctgctaaaaatacaaagaaaattagttgggcgtggtggcgggcgcctgtagtcccagctactcaggaggctgaggcaggagaatggcatgaacccgggaggcagagctttcagtgagccgagatcatgccactgcactccatccagcctaggtgacagagcaagactccgtctcaaaaaaaaaaaaacagcataaaaacaacaacaacttccgttgcttcctctgttggttaggatatcgtatcattgttcttgatcaacagtagggcctattttctcttattctgtgcctccaaataaattgttcttttccctgaaatgtcctttccacatcttccggttaacatgaggattgctttgagaatgaatgcagacatagcttcatctgagacgccttccccagcgtgtccttcctccatctgtgtctggtgtctcttctctgagttcgcaccgtacagctcttaccacgtctcttatcacgctgtgggaaatgcttgctgtatctgtctctcctaccacactgcaagctccatcacaatgagaaccccttctcatcctcctcttcccagcatctaacatatagtgtctggtaaaaacagaaacacgtgaataaacgagcagtcatactgggtcaaatcattgaaaccatttctgttacagggaaagaattctttttccatccttatactttaaaactttgaactagaatgtctactcttttataataacttctcaagaaatctcccaaagttctgggagtcggaagattttgaggaagtgaaacagtattatgacaatgactcctcccacccatttttttgtcttccttgacatttacatcttgtatgtgatcagaaatctgtaactcaaatgaactgttcatggtaatgagccattattaatacagtcctgattgaacacctttctctaagaaggtcacagtgctttgcatacattatctagcttgtcttcagaacatacctgaagtggggtgaccatctattcagaattcaccatggtctgacaatccacggctctgcgaagttgatttttcccctgctgagcccaggaaagagcaaaacaaagttcaggtgtgcagtggcagtagctgagttatcaccatcactgctgcttcgcagagccttctgaagagtcttacggcagcacaagccaattctctgagcagctgcacgaatgctaagggtgcagtcttggtgtcatatgagtcatacagctatagagatcaggtcctacaggagttggggggaagggaagattactttcccctagggatattgcaggtgcctttagacgagtgtgtgtctgccctcttcagtgagtgaagcatgccgttcttaaccgaaggctcatatggccaagtcccacattggacattttatggagaagcagtgtggtttaggggaggcatcaccagattaagagtggagatattagagttgtgtgatcccagctctgtcgttaatcacctgtgtctatgcagtcacttattcccttcatacctgtcagccgagagcactgactgcgtgatttccagggtcctttacagctttagagtataggggctctgtttttgctgctcccgaatttccacctgccatcatccacgcatttcacagatgcatctgaatgctcacagtgctctatttgtgctcttctgtttgtccctgttttttatgtggatgcgtatcgaccgccatgatagactgcacactccctgtgggcaggagccatgttcatttcatttttgtgtcccaggcataatgtaggtgcgctcacctcatctctcccatatcttgaacctgtgaatctcagtggactcttttcagcagatgaacctgtataagtctttcctgtcttgaaaggacagatgggtggcccccatcctccactgagcttcctgttgaactccctttgcaggtgacctcaaaatagaagaagccctcattcaccctatctactgttaccctcctcctttcccctctacttcccatgaccagttgttcactgcccctccacagaacctacttctgataaatcccgtgaagaattttttattgccagatccaaattctttggcctctcacagtgtttgctgtggcctgattctccctcattctggaaactcctctcctctcatggctcccatgggaccagttgctcctgcagctcctcctgcccctcactctgctctccttggactcctctttcctggtattctctgcagttctgtcctcggctctcagctctttgcacccttctttccctcgctgacagcttcgcgcatacctgtggcttcactgtcacgctaaggaacattctctgtggccctggcccgtctctcgagcctgagccccatgattacaacttctgtctgtaccccacagtcacatcaaccttagcatgtccagacctgcgctcgtcagccgcctctgaaactctttgctcatgctttccccattcgggcagtcatcccacagtcacctggttgtacagacctggagttccccttctccaccatccccacaaccagccagtcgccatgaagttcagcctccaccagtgttccctggcctgcggcagcagcctcttaactgtcctccctgcctgtgtctctcgtctgtaatccaccctccacacggcagccaaaatggcttttctagaatttcgatcttgtttcctttgttacttcttctgtacctgaccacatactttcagacaaaatttcagttccttagcttgcaagaccctctgagagctgggtgttgcccaccttcaccgccccttcccgtggtcctccatgctcacactgggagctccctgtgagagggaactgtcacccttccacttcctgggtcactgcggggctgccccgtgagtttcacatgccggccccccttcagtgctcgcacgtccaaggactcggcccagatgcagccttggctttcctcgccaggcaggattaagtcccacacccctggacccctgtgggctctgtcctgcctctccccacatgcttgccagggtgcttaccggctgagggctcagtgtctctcctgcccctgccatcccaccccctccatcctatgcccgccatcccatgcccgccatcccacccctgccacactgagcacctgaagggaggaccttcttcactggcctttgttcccagtttttggcctagagactgacatagggtacctgtttgctccatacctgctggacaaccagacagatgcatgctgggaggatcgcttgctcaaagactctgcccatctcccccaggcatgttgctggtccttctctccatttctataggatagaggtcacattcctcagcccaactcatggctttccacaggtgacttgtcctgcttttgaagaggcagctcacttagcctctttcttctccctcctcctctgttctgaagacccaggccggcattaggtgcacgtgatcctgactgcctgatgataatttcccatgatgaaagtatcagagccaagtgccatttccctttcattgaaattagataaaacccagagctgtggcttgcaagtgatggaagtccactggggaaatgaaaggtgccgagagaatgggacccattataatgaaagcatttgcgcagccagtgattccttccaccccgtggctcctgtgttcctcagggtgcaatgaaatgtgaagcaggaggacctttggaggtggtttgaggaattgattctaattggtaatggtggcagcattgtgtgcttggagcatgctctgcggaccaggcaccgggtgtgatgggcactttaggaagagccatgggtcccccgggtccgctgtagctcaggacctcggccccgctgtgtctagtcctttctactcctgtcatgtgctggacatgatcagaaggtgtctccctcccttccaccctcctcctctccatccttccttccatccttccttccattcttcagtggctctttgttcgtattctgtatttgtattagcatttaataaaaattatatactgataccaaagtcagtcaactgctagaccttcaaattactcatgaggcctaagaaaaacctatgtgacaaacataggatggccagaaaagtctgcatgatttaattttataataatttttataatgatacaataacaatagctaagttattttcaacgcatcttagcctctacttatgaagcactttacatgcattttctcgtttaattctgacagccttacaattcaggtgttacctccatctcacagatgaggagaccaaagctcagagaagttgagacacttgctcgagattgcatggctgtaataaatggcaggagcagaattgcctgtaacatagaggcagaaatcatatcgagtggcagaaccaggtttcacactgaagtctgactgcagagcccaagcttttaaatatgttctgtgttacagggccccgtgacttcaaagggtttgattcccgaacagaaaatacaggcttactttttaacatagttaatagtacctggagacgtcttgttgtcacttatgtgcccttaaaacagtatcagtaatcgaattgctgcagatttctgagatgatttttacagttgttcaatctgcctttactttctcccttttgtgtttttagatgcatcatcccattcagatgaaacctgcagatagtgaaaagtccaacggtaggtggtaaccaactgtcttgcttaataataatatctgctgctttaaattacaaagtcagttgggggcgggagaagccggcccagctgcttttctctctagaggacagagagcgctgctcctggaatcttctctgtggcctgtgtgtctggagtaatgcactcgccactctcctctctcctgtcctgttgatgatctctggcgtaaagatgtatgaggctgttacaagcagtggctttctgtgtccttctctttgggacttgccctgtatagggaccctgtggcatttggttcctgtctcctccaacaaagcaatacagggacatctcatggggatccagaggacgtctgcaggaaaggaattgcccatgaagaattaggctttctgtgggtgggggaggggcgttggtttttgtttttttaccttttgcatgtgtttcttttggacttggagactgccttattgtactcttctctaaattgctccaatgcatttgcatcagaattcagagttcagtctgctgattaaataagcgtacacttggtgcaaaaatctgcatttgatgaggtccataaacaattgggttttgcctattcgagacatgagagagttgatagccacatttccctcttttaagtttttgttccctttcagcgaaccttctgtcccttttttgtacttttaatttactgaaatgtatgttaaaagaatcttctaccatcctagactggagagctgctctgtcccataagactgacataatcagtactgtttccttccagcaggcagttttgcacctcattaattagtaatcagggcagaagccatgcacttagagatctacgtatctgcaaatgtaaattatgattgggctctaaatctctccacaaggtattttttgctaattgtagtgcattccattttctggcttctccacagaatagaaagttttgaagaaaattccaagtcatagcatggtgctgccagcacccgacttgtcagagctttcttctctcagctttcagcagaaggcagcggcccatacctgtagttgaagctgctcaggaggccaaggcaggaggatcccttgagcccaggagttcaaggccagcctgggcaacatagatatataaataaagaaaataaaaaaatagcttttctctctctaggaggagactttggtgctttaaccactgtcttctcctcagccctgcactttacttagggttaattcgtttttttctctactgctttatcacaaacatgacacttagcaccagaagttgtcaaatccgctgctgctctgtggccctgtgagtgagccacgccactcctgtagtcaccagttgttcatcagttaccgtgtgccacgcatgttgctaggagctggggctgcagcactgaatagaaaaaggaagaagaaaagaccccaagagactgtgtctctgaccttgtagaactgacattcagtctactgatttaagtatccagaagtcacttaaacattgaacttggatttctgcagttgtaaaatggaattgatggtaactgtctcacctaagttgccttcccctgagcccaagactcaaataaggtgtttgtaacagtctctgtaatgatagaatgcctctatgaaatgttgattactgtttgcacccagaggtggtctcctggcctctgcaggctctccatggagcgtgctggcctgggaagaagaccacttcacccaggcgggctcctttcagcccttgtgctccagaggtgcgtgcttgcagtctgatgacttccttggtgggagacacgagggatgactcttgtattttgggatgaatcctgttggtacaagtcatctcagagtgtgtggccaccaagaaatgttccctgcctttggctccatgatactctaaactgtatttagagtattcaggacaaggaccatgaagtgaaagtctatggaaaagggtttgtctcacttctgaacctttggttgtagatatagaaacatgacaaattagccaaattgaaaacatttgacctgaaatatcccagtactgaaacacaaagggatttttttttttttttttttttttttttttgcattttctgctgtgcaggtattcatttgcctcagagaaccctttctacaggcagctgccaggagtttgcagagtgttttgttgttctttctgtccagtgtccactgtggtccctgagaatcacatttgctttgggtctagaatcacagcacataataaaactgtcatgggcacacccaatgttgcatgatcacagaagccaaggaggaccgggcaccgttatttctaggataagacggttacctgaaaatgctgtttttcaagcagcagcctggggtagcagttatgaactatttggagaagcctggatttgacccgactccacgcttgttggttttgtccttgggcaagttatttaaccttactcagcatcagtgtctcttcagctgtgagagggggctacagtggtgtcatctgaacacttgttgtaatgcccgtcttacaaggttatttgaggtttacataagttaacgtctataaagagctcagcataatacccggcacgtggcaagtatccagtgtgctaagttctgctaagttaacactgttattccactcaccgaggcagccttttcagtgcactctgagcagcagaggccggcctgtccaggcctgggctgtttataccgaagcatagctctgtatgtacaaatcaaaacccccaagtcttctagttgggccagtgctccttttgctttgcggattgaccttcattttctgaattttcagtaagaaaagtccaaaaatataaatgagcggaaggctgcttttaaatggcttttctttccagaggcccaaatggaacctcaccttgcacagacatgaacagcttcgaggttctctttggacctgatggaggaatcaggaggaatatgtagttttctaaagcgagtgataaaagccacaagccttttctaatttcacatggcatttttgacaggtaagcatagtttcaaaagctcaaagagcacaaagatttctttggctcagttgctctaaatagctcctgtagttttgaaagaagtataacgagctctaattgcacttttattgagtttgctgacatttatggatagcacaaaggactcatcacagttagacagttactgtcttcattatcactgtgttcagatttctaaaactttgtatgtgctgagccagaaagagctgctaatcatggattaattcatgatggacaggtgaactccagaaaagcagtcacccttggcagctttcgtccatcgagcgattctgagagagggaacctctggggtgagccccgaaacgttaggttgcgctcagatcagccctgcactttgggatgtcactgagcagacttcccgagtctccatggcttcctgtaacctgccctttccattggctctgatttaagctgcagcctctggcacaccgatggaagctcgcggcatcgtgttttccatccacgtgctcccacagagccaggttgtccaaaaggaaaataatcccactctggagaagcaaaaactgctggggctgctaagaggagcacactgagtaaaccacccaccttccaacagaatccgccttttttgttatttttccattgcagaaagacgaatggcgggacaggcagggcttttgaggaggtgtggatttcatcctccatcataaacgagcagaaacatacttaaccctctttcatcctctatgccatccagcttttaatcctctattgctgtgcccaacgaggtaccagctgtgcagtactgaaagtcacaagcagttgctgaagttaggctggcagtgagtgatacaaacagaagctgcttcggttctgggtctggtctcagaggctggagctgtgctcactctgatgtctttgcctcttgccgcaagggaagttgcttgttgtttttactctatatacagagcgtaaatccatccatcctgctttaaccctccaacctcacaatttgctgggggtctttaacgcctagaacccagaaatgtcacttaagcctgctgtgtgtgtctctctcaaggcctccaaaacctccagtgtccaggtgtcaagttcagagctagcagcagtcaagataactaaatatcatcagcagagggtgcagacctgcaaagcctccattaaaaataggaatcatggggtggctccatccagtcactttctgattcacgggaagatgaagaaataattttgaaattcaaagtggagagacttacagatttggaggcagtaattaaatgccatatgttagcactaacacattgaaaagttgttaattaattcaggcagccccaaatccaggtgtgactttgacagattgtacacgcgggtgttagcgcagacttacaattagagattttttttttaaatgaagtttctattcccctaacttaaaaaagtcaccccgtgtatttaaagtattaacccattctcatcatatcatggaaggtagacttcaaatggctgctggtgtggaaccccttttgattctgtggtcgtcgttactaatcacgggggaccccatctgtgcagcacttcatgtgtaaaagcatttccctgcccttattcagtgtccgtcatggaaaatgacttttacccttcaagtgtttttttgttttgttttgttttggttttgtttttttaattccttaaagcacctagcagaatactgtgaacacagtgcgtttcatttaaactgactttcctgtaggttgaaaaaataagtgagatacttagtgcccgtgaatactcaggaaaaactcaccaagacggtcatcaaaagttgataaaaaagttaagtgaactcaaaataactgtgttcttgtagaatgtttacaaagctgttagggaccctcagaatgggaatttgggggatgaattgtatgactaacttgtcactggaaaaccaaaaaaactcagaagaaagccgggtgtgttcagtattccccatattgcctttaaagcaaacacagcccaactgttgaaaccacggagcaactttggctagtaagagattcccaaagcccagcacttctgtgcacacgcacaggtgcgctcacacgccacacacacagatggaagttaacattttgataacgtggatgatggaggtttccattttttttcttggctaatacttgatatttttaaaagtgcgagttatctttcttcttgttgcctggctgagttgaccttgagtgatggctaggaagtcagcatttcttcatgagtagtttccattttcttcatgttcgtcttaggaaaaaaatcatttttaagcttacccaggagctgcatggttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacataacaggaattttatttttactctcataaaaatgccagccatagtttgctgggggtaggagtctcggagacgagagggaaggaggagtcctgctgatttttctcccttttctaccccctttccatcccatctctccccttcctgtcccatctctccccttcctattccttttctccccttcccgttcacgggaatgccactttctcacagggcctcccccaccagaatcctcccatgttagtgagcacaggcggtgtagacggcctgcagcaggtggtgtggacggcctgcaggtacactcgttgcccagggtatctggtgtctctctggcttagctgtcgcgcctgtgctgcccatgactgaccaggcttcaccagttcacagcggatccatgctactttgccttctctgaagggaggaaaaagaacttgaattagaagttttccgtcagcgtacaggaggtcaggtcctcagcagtctccctcccaggaattggagcccggggtgcctgttgcccatgtctcctccgagtctgaacacaagcagtggctcaggccagctgatgctttcctcactgagctccttctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagacagacagaagctcccttaggtctcttccttccactctgggatgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgctaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccccgtgggtgtctgtgatgtcctaaaaaaaaaaaaaaaaaaggcacctctcctaaaaaggactccaaacgctgtcctgagatcagttttaacctcgtctttcgggccgaaagtagttcacatttcccgagcacaagcatggagattttgaggaaaatctcccgggccctgtgaagtacaacgtgtcttatcttccccaatgtcaggtgcccaggttagaatttgcgtgtcgtcctcatgatccccaaatgcacttttattccccgagaatcttgcctcccggtggctagtacagtattgtttccttcttgatcatttgtgaagggctggaagctcggggccatccagggtgtttctccagcagcagccgccctgttctcctctctagaatcggcttcctgttgagcggtaactaacctggctgcttagaaccaggtgcgggacctggttagcactgcatcaccagtgtcacgggaaagaggtactttcctagctccccagagacgtaagaatctctctgatctcttattcttgtctagatcagcagggatgaagctatttgaaacagaaaaatgttttcttccctcgaatactctgtgaaaagtttcattcgctgtttcgctccatctgcccccatcgtctttcctctcctgacctttctctgtccctgtcattcaggttaaaagaccatctacaaaaaaaaaaaaaaaaaaaacagaataaaatctgtatccaaaaatatccccagagaatggtagtgttgaacagttatacaagtactttggaattttagtcagcgcattactgttagtttctgaataggagaaaagaacttaacagcattacatgtcatattaaaacattttattagtaagcacaagcacacggggagatgggttcaggaagcaccaggtgggagggagtggcagggtggggcgcatggagggaggaggacagctggacgtctgcagagttggccttgggacacgtgcttggtctcacatggctggggcctggtttgatggggtaatgaagcattgattacaagaaaaaaagatgaaatggcctttgctcattcgttatttttatctcctagctgtggaagacagaaaattgttcataggaatggtttcgaagaaatgtaatgagaacgacatcagggtgatgttctctccatttggccagatagaagaatgccggatcctccggggacctgatgggctgagtcgaggtgagtgtgctgtctggaaagcctctccccttcagtgctaattggagctctgtgtcacagtcgagacagatgtaggcaccgcacacggcaagaggtcaccctgtaatacatcccatgtgataaagttatccaacctgaacttttcaccatagctgaaatcatcaccttttatttctccagttcagaaggccttggtgccaccatattagctcaagttatcactgtcaggtgtgaagccaacaggctgccctactgctaggcatccttttcaatctcatattgaaatggatttggtggggggaggtgcaagaaggagaagtagaaaatgagaaaggatatttgttgttttcatcttagtcctcgggcttcctgcctgtgcctgaaagaaatgttaagagtatgttaagagtacagtgacacaaactgggaaaaaagcgtcaatgttcacatgtagtgcagagcagatagggatgtagggtaactgggcctgtattggggtattagagttttatttcaaagagcaaaactcctggagtcctgagccaggggaactcgttaagtgacagaaaagcgactttaccctgaagaagattgtaggcacttctttgccaccatgatagaagcagaagctgtagctcagagccttgacgataagctggtgtttacagaatagttggaaatcactgttgttttccctgtttgcctctcccttgacaatgccacacacctccttcctggaaccactcataaaggctgacgctggaggttgacactcgtctgactgcacttccctgagtcagtccaaggtggaaatgtatatataaaatgtgtttttcacttctttttgctctgtcgccaggccagagtgcagtggcgcgatctcagctcactgcagcctccacctcccaggttcaagcaattcccctgcctcagcctcccgaggagctgggacgacaggtgcacgctaccacgcctggctaacttttgtattttagtagacatggggtttcaccacgttggccacgatggtctccatctcctgacctcgtgatccacccgcctcagcctcccaaagtgctgggattacaggcgtgagccaccgcacccagcctgtgtttttcacttcttacaggaaatccatattcttagcaacatggagaggttttcattctcttattactgcagttaccagtgcaatttctttggggcaaatgaggaacttggtttccttctcaatctctggctctgggccagcactggcaccccaaaccacatgttgaaagaaaagattggatcatgaggatgaaagcactcgtcttcacccttctcactagtttgacctgacttcagcaccatgtgaggaagaacatttgctcttttgattcttaaacataaagcttaaagatgtcagctgctagaatggaaggccgagagaacaaaagttcccacctacaaccacctccagagccccagcatgaaggtagtctacaggagaactaggaggcggtggaaccacgccaagcttttgattcctgtgttttcttcggaaggtggtttaaaaaaaaaaaaaaaaaggcggcatggaaatcagtttatgcattctctaacaattctgaaattttgttatataacactcacttaaaagatgtaattctctaaaagctgaacaagtcactgtattgagtgtgatcctggaatagcagatccagtatccggggctcctctgcggtttttcacctgtgccatcgtcaggggcaagcaaagccatccatcgctgtggcagactgcaccacctctggctcccaaacagcctcaccagccaagggatactagcatgccttcctaggggctcaaaccagcagaccttctaatcacacctggtggtccaattcttcatcatatatatgtccacttaagcagacaagccaggagggagaataccatgggaaaagacagtgtggctaaattaagaataaaatatgtagaaagatgtgatcatatttttgtgattccttttctggtgccaatttagtagttagaatccctgttatctcctgttgttattctcagtcacacttcagtgttaccgtagtaattttcattctccaaggtatggagaaacggcacaaggagagcccttaaattactcatagcgaaatctataatggcttaggggccagtgaccccaagttccagacccacaacttctactgaaatgaaatagaactttagtcattttattttcttacctctgtcctgagctttccccatttgtaaatgacagccgtaactatatctgccctgcttctcttgcagggagtcattcacggctggtgtgctagcttttcgtctgagcataccctctgcatgtgttagcggagagaccccgggcgggcagtatgtgtgcttgatttctgctccccgtctgctggcctggctgatctaggcagtgactctctggcacattttctctgtctgtccagtggggacagtaatgaacaggattgccgcctgcagcgttcagagctccttgagcatacatcagttatttctgcagatcaggttttaaagcagccagaacctccatgggaaagagcaggacacgcagtacttaacaagagaacttagctaatttgatctgccatttggttgattaaccagcacttgacaccagaagcagcctgttcctgcaacaagtgatggggagcagtctcatcaatattttatgcaaacgctggctcagtggaaagaggagaaaacttttccctccccatctgttttttttttttttaaacagcagaaaagtaatttctggtgaactgatgagaattccctgttgcaaaaaaagaaaaataagaaagaaagaaaatactcatttataaccatttatcctgagaactgaagacagacagtggtacttttttcaattcgcaggacccagggactcctggctacaggggcctgctcctgaatcagtgtatttgttaaaagcacaattctctttcatgctaccattttgctttcattaaagaattgcagttttgaatcaaatattaatgtgtctcccattagtggcactgcagataaagggcattcagcatttctgttctcagcgtctattgctggctcagctgtttaaaaataaataaaaattaagtgaaacaaaagcatggctgctctgcacagtaccttgtaacacaaaaccagggtataccctcttccgtgagaaagttttaaaatcaaactcttggattatggtgagggagagggtgcagctgagcggttcacttttctttttctgcttttgcccagttcacctaggaggatgaagacaaaggaggcaactagtctagctggctcctgcggatttctaatgtcatttcttccctgccacatcagtagtttcaggtcctccctaagaggggttacactgaggtttcaccaggctagttgacccagtacccccactgtgtcagagaggtacactgccctgacccacagctgtacccatcaagtcgtgctatactttcagtcggaatcactgccttttttttttttttgtaagtcgtgatctaccttttggcaagaaaagaaagtatttttaaaatcccatcttactcagcggccccagcccatgttccagggcagacaccctcaggaaattgtcacgactctacgtggaaagcacctaacacctgccaagcacctggagcctctcgaagatccaaggactcttcctggcttgaggcagcgtagccatatctcagtatgcgtttctccctttggggaagtaacccattctgccatcttctctaatttggaaaacactgagatgctttcaagcaactttgggatgctcagcaccttctgcagcagctgctcagcctctccaggcctgctgtagaagccttcatggagaaaaggagcaggatgccatgggcccacatgtggcaattcacatgaggtgtttgctctcagaagcagagcctgaagtttctaagccaaatgtgcttgatcgacagcatcaccctagcatgttgatttcctaaaatacacacactctcacttacccacaatcccacagtcagcctgggctatttaggtacagggttttctgcaccgtggcagttgaatatctgtaacccagagacagtaaaggagtttaatttttttccccccacaaactgtaggcaaatcttcactgccatttaaggtaactttctgcttgtttaagaatattccagctgtgtttatggtgttccaacattcccctgccaaaacccttgacaaatgaattggcaatattttcagggatgttggcaagtacagactggatttagctattaaatcctcattggtttttgtcatatctgatcagaatacaggaatgggcttttgactattaaaacatgtacacagtgcttgggaggctgatgcaggaggaccacttgagcctgggagttcaagaccagcctgggcaaacacagcgagatgctgtctcaaaacaacaacaacaagcatgtacacagaaatgaatcagttttcacacatttcagctctgcccacacagtacctaaacattcagatgtgtgggaactttggcgacatgcccccttgactccttactgcatttgccatcttgttccaaatacagacttccaatcttatctcagtgatgagattttgccagctattaagtaggtcctagtctgtacccagcctcgcatgccataaatgagtgatgtgtctgtgccagttttaaataaagtaactcagcatcagggatggcccatcagagtattaattcttatgccccaatattatattgatagcgtatgtttaacgttgctactgcttaaaagatacaaggaagattgactgcattaagatatttctttggctgactaggaacttataaacaagttttccataggttaaaatctcctttgtcctacacaagttatacttctttcacttgaagtatagtgggtactacacctttttcaaagaagtaacaaagaaaagcaagaggccctggcattgttcatgcttttaaaagtggctttacttttttttttttttttttttttttttttggtgcagagcaagaattcatctagttctcagttctcttgcagctaagaaaaaaggtggaacacctgagttaagatatcctttcaattgaaatgacaagtgtaataggtgtgttccaaaatcttctctgtgacagggctacgtgctttccttagatcttgtctgtaggaggaaattactttcagaaacctttccccagtcaatcatttatctgttttagcagcaagaaggtaacctcactgaaatgagaggaatgcagctcctttcatttctgttagcaattcgtaacattctgaaagtagggataataaataattgcaaaggtaaattgcaggttggccaaatttacagttggatttttttttgctgctatatatgtggaggttttcagagagtaatatacatgttgtcttaccaaaactccctccccaccaaaaaagaaagaagtatggcttcattattttgatacctgtatattttccccccagccttgtttctccggcatttgggtcagtagccaaattgctgattgctgagacctgacattcaacagtctagaatagttaagggctgaccctacaggatcagagcagttgtcctgtaaagacccagtgaacaccaccgcacccagaagctcatttttagtagaaaggggacagttacaacccaggttatttctgtccaatggaaagccttctggttggcttgagagaaaaagccagcagccagtcttaacggtagggacttacatgatcctgtgttagtataaagccatacattggaggcctaatcctaaagccacccatgtgttttcagtggtgttgaaacaaaaactaaaaatctatccataggacttaccgtgacctcctgttttagagaaattacagtggttaacaagctaccattgcaagaaacagttgactctgaagttgcttgacttcatcccgagtgacacagagagtgacatttttcaacatgcactcccactttataaatgacactgtaatttttttctcaagtaattgaacacagcacacaatgcagaacttgacagaaacccctaaggagacagcttctgtcttactgcaccactgccaatagaattaaaaggttaaagaagtcctcagatgtgtcagatcatttttttgggtggggtaaggattatataattacaagcatcagtcatgtttttaattgcacggttgttagaggaaagggcaatgatttgagtttatagaaacagaattttattgttctattggtaatacttctcttctgaggcctgataattgctgtatctttctcactaagttactttaaaaagttctgcatatatgaaattgtggcaaatgcataaactgtgccttattgatttttgttgacattttacatgtttcttacgcatttttaccctccatttggaaactgtcagcttggcacatggtgctggataataagagcaaatgaagtgaatacagcaatcttcttgactattaaaaacagaattagcccaggctccgcttggtttcaaatctatctccaatagatgatttgccttttcctcccttgtagtttcaagataagaagtggaaaaataaaaatctcttagtgttatttcctctgttaataatgccagggatgatgaaaatgcttctgaagagatgttacttggaaacagatggtaaatttggactggatcacctcagagctcagcatcagtatggaagccagtggaggtcctgtcctctgtcccacacttacatcatctagctgcctcagagaaggccactaaattgctgttattgatgacaaaagctacagtcagtcttagtacaggtagcgtgttcagatagtaagcttcatcagctgccatgctgtcagagaaccacatgagacagctcagcattcaccgtgagctgaacttcattcaggcttcttcaagccagcttagccaggaggcgaatgtgagatgagtttctcatgtactgagagtttttgtgtgttaaaaattatagcatgatgcaaacaaaaaatgcattgacttattttcatgactggatgtcgttgtgctttgagggtaatgggcaggcattgctttctcttattgctgttggattaaaaggtgcggctacagtattgacttgataatctcaccaggtattcgtgcagagcaaaagaagaaaatatattttatggctcacaaattgatttacataaaccaaacaatctgctggttgtttgaatgcagaatattctattttgcttattggccacaggggcaacaatctcacatcgttgatgccagaattctgcttttcatgcattcactctgaaatgacaatagacgtcagcctctcagtgtttagatctgcttcatttggaaatcttttaagtagtaataataatgttttgaggaaattgagtggaacactaaattattctctgatacctaagttcaaactgtgcaaggctaaagaagctgaaaatcaatgcacttttaaagtcattagagatcataagtgaaataagtctgtgttgctttagctaaccttttagtgtgctgtggttttattataatatcagcctgaatctgcattaatttcacagtctttttctctaagaagcccaagggtgcatgatgaataaaatgtaaatttgagaaggcagtgtttttattagtgaaaagggcaatgagccatgtagttggagcagtgacctgcatggtggccaacgctggtgcaggaagcaggagcaggcactacagagtctagttattttacagcacaagaaaaaacaggcacggaaagtttcactggtctcccagcagatattcacagaagtgtacattgtcttgtgtatgttagaactaaggtcaaatctttgatacgtttcagaaattgacaagtctcaaaagtcttgaagattttatgcaaataaatgacaatgcacgttttttacattttatagcagtattgaatattctcggagtaatggagcatttgtttttattaaaattaaaaattgctaaatagtttgcaacagacttggtatatttgtatttgcatagcaacaatttatgtttatacatacatatatattttttaactacctggaagggatttagatacatttgtttgctgacattttgagctcttgaaatttatttgctcatttgcccttggtgtgaggattttcttatttgcccctttaaaaatcaatgataaaatttgaaatacaaagccctgatgtgtgaatgccctcagtaaagatcatcagtcaaggagaaaatggaaaatagcaactttttattttagaaaatgcaaactagatcttgctgatttcaaacccggtggctaaaaacagtacccaacttcctcccctagtttccatttaaaaaataaactaataaataaataaatctttctgctttggtcagattagcaagtcagcactgtgaataaaaagcaaaataagataaaaccagagagagaagttgttttatttttatgtactactgagaacagtgtcgtcttgtggcagttctcgtagactgtgttggtttaacaagcgtccaacccttttgtcttgttgttttttgtctttcctgctccctgtccccttgtttcccacaggctgtgcgtttgtcacattttctacaagggcaatggcacagaatgcaatcaaagccatgcatcagtctcagaccatggaggtactgtatcatctgccctttctttgttttctttgtgcaaatgatggggaatggtaaagcaattctctcctgtgtggattgttcacatgacaatcacagatgtaaactttcaccatctcagttttcattcattcattctcattctctccttctctctctctctctttctctatgcatttttcccctaatgacttgaaatgcatttaggaaaaccttccacttgctctccagttatttatttgagccttttattgcagtggcacgggtcctgtgatgtaaagtcgtgagcactttaagcaaagtgtcattctggacctaaagaatcaaatacattccccacaccggggtcggtgcggatgaaacagtaacagcctcccaccccaaattactgcttgccctgtgctaagtcccagggttctttcgtttgtacagggtcaagttatcttccatctagtcaaacagcattgtgtttttacatcaagaatgttggagaaagttaatatttctcccactgcatttaacattgaaagtgcaaatttggaaaataggatttgtctccttccttaaaaagatgagcaataacaaagaaacataataaaggctcaaatgtggtctcctaatgagagatcatggctttaggggaaggtaaacaccctggtgtggatgcacacccacgaacctagatagatggctctgtacttttagtctgtgatttgggtcatggcctttcagaattttgcacaaaagcattccaagagtgatatgccgttacttcttctgtattgtctgatagaatcatttgggagtgcatgttctgctgtattatgtatactgtatctttgtgtatgggtgatcttttccggaggtggccttgtggtgttatctgaagctgtgttttcatattttgaaaaaagatattttcaattttatttaatatgcaaaaaacttttttcttgattgagcttctgttttccccccattttgttggggttttatttttttgtttgtttgtttttgtttgttttttgcaatgctgcatctcccaaagcatgctgggagctaagtgatcattatgcgtcatgttttgtgggcaactttttttatagtgaatcaaaaggtgggtgcaaaggggggaaggagtgtgcatggcattgtcattcagtgtttactgtacttttctgacttgtgataccagcattgcaaagcctattgtctttttcgaacattgatcttgactttgatattcctaacatatcttatataatcactgtgttttcctttcagtgcaatgcatttttaagacactcacaaccccctacctgaaggcaagctcaggtgaaaatcgggcatgataggcgataatgagcaggatttggaatgtctaggaagctaatcttgtctgacacgcagttacacgtgtgatggcgttttgcttccctctttctcttactgaggccgctccattcctgtggattagcctgatttccagccacattttaatcttcaattcagtttgaagattaaaatgaaactgctgttaggggcaaaaaaataaaaaagaaaactctttacttgtattatcttccatatacgcgtttcattcttatttttatttcttgtaatttagtgatgtgtacccaaattggtctcacctgagataattttgaacctcaattcttcagtgtttctgttagaaacattacgatccccattccttcccttggagcccccccagtaatgctcagagagccacggacaacccacgggagaccatgttcccctgtgttcctgtagaaggaggactctggatcataaagcagaactgggcatgaaccaggctgagaaacagtaggttcccatcatgtaaagagttggtttgaccactggggcatatttattcctaagcctttgatcctttattattaatatctctgttatttgaaaaccaaatttggtgtttaaaactggacattcatgcttacacagaggggtcctctgacacttaaatttcttgtttggtttttttttaattggcatttaaataggaggttatatattatgcagtcacattataattgtttgactaacgttgtttatttttaactaattatattatttccaggactctggcatacatctttaaccaagatgtattacctaattcacaatgatgtgaatgttgaaagaacaaggtcttaaaaacaattaattttatatcgtgccttctgtttctccacttgccttcactctatccctgccctgtgtttcatggtttaaaaaatcatttttaagctataatcattggcctaattttctgcttttatatcatttttactatttaaggaagaaaaaaatagatgttctgttaggagagatgctataatttgttatggaacaaatttgatggaacaatgacaacccttttccatgcaaaaccccctctctacataatcttcaaagtatgttgctctcttttaagtgaagtactgaaacatggaacagatacagaaaaaaatgaattacagatttttttaaatgatggaaatactatttttgtgcaatttactgacatttaacattctgtaccatgactctgtctaccagagctgaagaccagtaggctggaagtttaacactgaaatattcatctcatttttctcacttttttttattaacagacatgatatcctcatgtattcagaactgcatccccagtaactacccaaggtgataaggaaaaaaatgcgtttgttttccagaaaagagaaacatgacccaaagggaatggaacagagaatcacatttaaataggaatataacatttctgagaggagagagagagaggtctattatcatgctgagtttcaataaaagtttttattttaatcacttgggtagaattacttctttatgcctcagcaaaattgaacagctttaattgtgatgaaacgtgtaggcaagccacacgaaggaggagaagaggctggggaaggagggggagacttctgctgagttacttaccaagtggcaaatgttgcaaaggtgctttggaaaggaggtcttcgtgcttggggtgttaggcccttattatccctgatgattttatctagctcagtagtgaattctgtgacctttagccatttctttctcactacccctactccttgccttttaaaggaaattaaaactgaaagaagctgctagaatggtgagattcattagggaaagaagccaagtggactcctccgtctgctgttcacggtctatcttctttggctagaatgtgcttctgttttttgggtttgcaccagctccagggatggcgggtagcacaggtgtgctgagggaagaggcctctctgaaaacgtgaacggttactttggagaatgcctgtgttccctgaatatcttctgccctcatcctcaaaactaaaatgaagcccttttccctatgattgctgggccgataggattgtcacaatcccaaagttcacagatacataactgaaaacgggaaagagtaaaagataaatgaatgagagacatggccattcccgttacagattctcccctttgtcctctgtccacctgtggacacgggcagacacacaaagccaagtctgtctttaagacgagcagcctgagaagctcaattaaagaaccttggtaaggtctgttgtctgtaaggaggtcctgcaaggttgaaggaagacacaggaagagaaggagaggcagttactaatcagagcaagaaagcaagtgacttcaccgaccaccagatcccccaaagaaaccactggcagtgtctggaattttctgttgatggtactattcagagaagaaggaatatcaaaccgttttaaaccatttcagcccattccatgtgctccaggctagtgcagaaaggtagctccggtgctgagtgtcgtgagcggattccgccagcctgtaaccccctctccactttccaatgtgtctgaccacagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcggtaagtgctgggcaatgccggcgtggtcttcacccgctgaaactctgcaaactgacttttcccctccctacgctgaggcatttgttttcagtacattttcaatctcggggaattattgaaatcagcatttatgcaggatatttttccaagttagattgattctgttaagaacaggactaattgaattcctgcctgatgtaggaggggcaaagtcccacaggttaaacttctaactcgtctttgaaaggcaccccaaggccctgagttagaagacatgcagctgatgatgtaacgagagggaggccgctgggctggctcatccctgtcaggtcagggtctgcgccagcaggacctcaggtgaaatctcccagaacttccattccatgatcctggctcttcgcagtggaaccagattgatgaaatcaagtgtttcttacttcatctatttgaaaccaacaaaattctattctatttcaagccccagcagacccagttctctcagccattccttacatctcttggtgtctgaacttgagctttctggttgtttactcatgctctccatttcactttgtgtctttattgaaacacagtgaccagaatttaagacagtcccccgagcgagatctgaacaggacggagtagtaacctctagtgtggacttgagggcatctgaatggagcttgagagcggcgtttgtagtaaccatggcagatgcgggctggaaggcagccagtactccagagattttatttttactcgaattactgctaaattgtgctcttctaccctatttttccactttggaacataagtgctggacttcacatttattaatataatttcatattgtgagtttgggccttttattccagcctcagagagggtgtctctgtgtgtgtgtgtgtgtaccccatgtgtattgggtcttcattctgtcattttacattttaactatccctcttgtgatcctgtcacccattggctttactttgtagcagaagttgtgcttttgtgtcaaatgatcctccctattccaccttggaaggtgagatgatcctgcttttcggacatatgaggaaagggagactcaaagaggttacgtaacgttacccagaatcaaccagccgctagtggttgatgggacttgagccctgcgtgtcccaccggctggccatactgcctctttgaggactccgggtgctgctgtgggtcaccttcatctttttagctgccccacccccagtgcccagtgcccagtggggtctggtatataatagctcttcagtacatatttgatgaatgaatgagaagcatccttttcctgtcttcctctgtgctgctagcaaaagcattggctcaggttcccatcactttctgtccatttctctaccttgtccacgaagataccatgagagattttgtcagctgtcttgctaaaatctatatttgctctgctattattttcttgactaatcagtctaaaaattgctttaaaagagaaatgagtctagcttgactatgatttgtttttcacaaatgtgtgctgttcagatgctcacagtcgattggtttaattctgtgtaccagaatttttgtctgaggctgacatcacgctcaccttcctgtactttctaagagtccggcttcccccatccaccatttctgaaaactgagacacgtgtccactctgtcttctagcacgtctcctgtgcccccacggctcacagaaatctccggcacatgtttctgggaccacatctgcaaattgtttgtgtaggtgaaggagaggaaatctcatcctgatttatagaaacatgtttttagaagttctcactacgtttccctctgccatgggtgattctttcttggccatgtttgtcctactccctttcagctgaaaagccctttctctgaaagagcccttagctgccttgagtgatagattctgaccctggctcaccagaggttggttatccgtggcaataatcctgggtggtggtttaatgacactccaggtatttccacttacctcagtaggtgctattaactcctctaaacatcttcaaggctagcttaatttttaaaatttaaaaacattgaatatgaggaggaagttgcagttgataagcgcaagagaatgagaaacccagcaaatcaaaccgaaataaggccttgctattacagtgggcagtccctagctttcccaccccctcttccccgctctcttcctctttctgtgtgcgtgagagtatgtgtgtgggcagggaatggagagggatgactgaacacagacttttcttggttttagtataacctgatagtgtgaagtcccataatatcgtcgtacctgaggcttgggtttcagtcagccaagggtccccaacccctgggctgggtaccagtaccggtccatggcttgttaggaaccggaccgcccagcaggagaggagcggcaggcgagagagcgttactgcctgagccccacctcccgtcagatcagcggcagcctcggaatctcctaggagcacgaacctggtctaaactgcacatgctgaagggtctaggttgcgtgctccttatgagaatctaattcccgatgagctgaggtggagcagtttcatctcaaaaccttcccctcaacccctggtctggtgggaaaattgtcttccacgaaacttctttccccggtgccaaaaaggttggggactgctggaatcagccactgatagttccacactgcttggcgctgttacctcaattgagatccattttcgagtcatatccatgtgtagggtttatcatatcaaactggaaagacctggacttccccagaggaacggtgttctggattgtttcacgagccccaaataaattctgaaagttttgtttttttgtttttttgttttttttgagacagagtcttgctctgttgcccaggttggagtgctgtggcaccatctctgctcactgcagcctccatctcccaggctcaagcaattctcatgcctcagcctcctaagaagctgagattacaggcatgtgccaccacacccggctaatttttgtaatttaactagagatgggggttttgccatgttggccaggctggtctcgaactcctaacctcaagtgatccccaccccccccccaccttggcctcccaaagtcctgggattacagatgtgagccactgcacctggctctgaaagctgtttttaaaatagtgaattaatcttgttcctcctgagcacacaatgtgacaatatttcagtaataaaataaatgtggtaaatctgtgtttctggtatccatgtacatttgaatataggagaaaactatctgcttgcccacactgctaactgcatctgtactggtctcccttaccaaaaagaagatccataagttcagcccaacactcagtctttcacctaagttaagctgcggttcagctgagttggacaagtccagcagcaccccaggggctccatgcctttatcttgtggcacccactcattctgcatggcaggaaaaatgcagccctgaaagcactagtggaaaatgcagactttctcataggtatattaatgtttttgaagattgacatttacaacgcgtgacttcgatgtacataccaccagatagttgtgagttttgacaagctgtatgtttcactctgcagtgaggacttttaaaatggctgcccatttgcttggtcatgtagtggtggctgcagctgtacgcctgtgaatagatgcattcatgtttgtagttaccatgatgatctttatgttggcaccagagtcagtgaaccaatgtgcttctgatgaaagatgaagaaagctgaacggtgctggaaagtagaagagagggagggaatggaccctgattgacagagatgagttacggtaactgctagactacagagagagataattagtcacgctatgttggtttcaatagatctaacacctggttgttaaaaagagtaaattgattaattgttttaaggcagcagtgttagtttccccagtgtttatgtttcttaatagagattggacatgaatatggatttacagccccagctctggggaccttcagtccatcagtaggcagtagcaaccaaccctggaaatgcagagtaaactgaatttgtccccagtttaatgagggagttactttgctctcaccatctccactttgcccttgtgtgttcatccgcagctcctgcagcaggccacctcctccagcaacctgggtgcgttcagcggcattcaacaaatggcaggtaagtcaggaagcacgcctctccttttgaccgtgctattgtcagaatttggggttggttccgagggcaaagacaagaagcaggggaagagaaccaagaatgatgatcagacttgttagctttctgtctttggtgttaacgttggaaccgcctgctctgaagtgtctctgttacttcttaggttacctacccaccttcgctgtgcatgaccgctatagaatgaaggggctgagaaatcctgattggcatctatatcaacaaatgattatatcaacgactctctagtcatttgttgtttttataaataagattgattactgggggctttccatccagattcctatatctagggcagccaaatgattgacagccctctaaaattttaataatagacagtcaataaaaatgttctgacctccgtaatgaaagccaggattgcaggcctatctttgatgcagtttgcagccccttgataacgacagacaattaacagggtgcctttttactgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtgcagaatgaagcgttttttctttgtcatcatgaaaactcctttttttctacctttctgtttctttttttaaatatgtatccttggggtttgtttattttttttttcttgtttcacttcaaatgaatctggaaaaactttccagggggcttctccctgggtgtggtgtgtgatcggcagccccgccgttgtggcccgaggctcctggaagctcatcagctgatggtcttccttggcctgtagtaaaaatactgctgaattcctcgttgggctttaaatccattggcactgccacctggttccattgtaacatagcttttggattattagaaataggaataacttgatagttaaatcattcagcagcatctttacgaatatggtttgggaagctggccttggagctaagaatcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgccctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccaaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaagaaagagaaattttagacgactggatcctaagtagttgcatgtataaaattgaatgagacgtcagctatacttcctttcccaaaaaatcttaccattttcccttcaaactaaaaataacttcaagtgtgctttatggtttttatccaagagaacctttatgaaatatggaatttagaagcagaaaatggattaggaacatacctttataaattgacggcttttatatctactttttgtgcctccttggagttggttggtttttattttccctcttaaaacttctaatgaaaacttgtccatttctctctcagcggtgatatttgttcagtgaatttcagaaatctcagaaacttggggtctgagtttgggctgagagctgggatttttcttgaaagagaaagggagtaagagaaagtgtcttctctgcctttaatttgtttataacaactatcaactcagaagatcatataacagaaaaacaaggggtagtgttttaccattttgtttttgacaaagctccttttaaaaatcatgcagctgtcctcatagcaagctaaggacgtgactaccactttgttactacattacggttggaaaaagggaagatgaaaaggttcagtgagtaatgtgagaccacagcactagtcaatgacctaacaaggattagggtatagaattcccaaatatcacaacaacctgatgaagtagggactctaagttagcccaccgcatggccgggcaactgaggcttagagagatgagcagacttgtccaaaggcactaagctagtaggtggcaggaccaagcttcaggtccggctcactgatgcaaacccaggctggcaaaccgtgctctgtgtctcagccccttgaggtgtgtttcacggcccccacactgttaggaagcacttcagaggtggtaacaggaaagctgcctcccttcatcctggaaaacatctcaagtttatcatgagtgagtttttctttttaggggggatttttttctaggataaagaattgttactaaaccagttccagaggttctgaagctgcggcggaagtgtcttttgatgaacgggaggaaactgcttcgtttcaattctgattctgagtaaagcaagtagtaattcccttccagaatatctggtctaagttttgaaggtaacaataacattatggagtgcaaatatttgcttaaaaccatgaagcagctcttcatttatcaacttgagatctgttctcttagaagactgtcttggtgtctagcacgagtggagaggagggagacatttgcaaaaacagtgtatcggaggtctgagaatgtcgaattggaggcgctcccggagtggtgaagtgtgcttggtacatccacaaagactcacgcagaacttggttcctccccaagctgagtctccagcagtccacactgcaggccttatgagaacgttctataaccacccatctgtcactttttaacagacctgattggcaagcacttgtaacaactgacatctgttcatgcttattgatatgcagatttatggtaattgctatgaacaataagacacaaaattacctaaggtgaacattaaattaaattttcatgcccttctccttataaataattttttttaaatcttaagtttcaagtaggcatattgcgcatctgtttggtacataatttcttcgttttgagaaggatatttttccccaagtattgaatgaaagttgaatccctgtattctcaactttctttgccatcttcttagcccatcgttgagttcctaaaacttactgaaatgttttgcatgttcagtcacccagtttattgcccctggttcgagaggtgcccatctgagcagagtgcttcatgaagtcaaatgcagtttttcttctcggaaaggaaccgtttgccaagcacgcgcccttgcctctcggtctggtgccctttcaggatgagcgtgtgggataaagtgtgacttggggtgcagactgaggaggcgcctgggagaggggctgagatggggaaaggacggggcacccacatacctcagaaaagagagagcgacagaggggaaccagaaagaggacttccggatgagcggaagtgaagcccgctgttagttctggggaggaataaggggagttgcaggagaggccccgcgccccatccaggagcaggcctgcgcctgacacctgtgcccgagaagcctagtccggctaagaagggagagggaacctctgtcctcacccagatgccctggctggtgtccgcacatcaggccagtgcctttccccaaaaccgtttctcccccgcataggaggggaaggcaggcaggtgcgatgtccacgttccgggtgatggcgctgtggctgtggatccatctgtggtgggaggagccaagacatcagccaccagggacgtgcatcgttgccagggaagggcccaggaacactggggccaagacagtccccacgctcttctcgccccgggttattactgtggtgtgacagagcatgagatggtcagtagcacctagaagatcggtaggtgcagggatgtccatggggcaggatggacagaggacacatgggccacggcctctgcctggctgagtggacagaggccgctctgggtgggggaaacggtgccctcactgccctccagcctcagtcctggttggagtgagatgcccaagaggcaggggaggtcctagggctctgaagggctgctctctagggcttcctggcgccagcctccactgggtccttccccattgacacctgtgcccaggaaggtagctaagaatggaggagctcgggctcgcctggctgcttctgatgctggcgtgcgtgtgcatgcctgtgtgcgtgtgtgtgtgtgtgtgtgtgtgtgtgtgtgttcagaatgggaggaggcactgtcttcatcctccctcttctccgtgtcctcactcctcagctctcgtttcttcctgatggcccaagtcactgccccacccccaggctgtcatgcagtgattttccactaccacttgtatctctttcagattgtcaaaagaggtcagaagttcttcagctttttaggagctgtcaccaaacacattttgcatgcacatcacacacatactttttcataaaatgtcagagtttgtggagaccctgaaccctgtcagggacctctgcctcagaagcaccaagttcaggggactgacgtggggtagatgaagaacacgacgaagagcactgaggcagcggcggacgagggtctgtctggtcactgaagcagctagagccagtggtttgtggtatctgggattctggggatggatgcagaaggaaatcacgttaagaaactaggccaggtgtggcggctcacacttgtagtcccagcactttgggaggcagaagcaggcaaggatcacttgagccccggagttcccgaccagcctgagcaacacagcaaaacccctttcctacaaaagttagctgggtgtggtggcgagcgcctgtagtcccagctactcaggaggctgaggtaggaggatcgcttgagcctgggagatgatggctgcagtgagccataatttcactccagcccggtgacggagcaagaccctgtctcaaaaaatatatatgtatgttaattgccaaattgattgagagagcaaaacgtagtacatagttaagtagttagtggttaactggttaacctagttcttagttacaaatgaagacacgatcacaagttcattcccagacctctggcattcaggcgagttgcacaaaattcgtactggccccaatgttcttggaccctggggcagggagcggcacttcatggtgaagcagcgctagactggaatccgccccagctctcacatctgttcatactgttgtggtggggcgagcaaggccactcccagtggatatggggacctggggggtagagttaacttctgggcccctgtcacattgcctttcgaaaccctatgctggaccagccctttccttcctcttcctcccctccatccgtccctccctatccctccctccctatcccttctaaacttctctcagatgcaaagtttaaggaaggaaatggataccaatgcacaggaggagaaggaagaggtcagaacagctccagatggggaccgagagggcagagggcagcccgtgggtaggccaggctggcagggagaggacaggcacccagggaaggggcggggctctctcagggagtggcccttggagaatggctcatggtgttttcacctcttcatgcccgtttcctctgtaacatgtaggagagtcacaatgcccacaccacgtggatgtgttaggaaccctagtagcagagcacgggtaaggcactgaggagcttgcctggcacgcgctttgttcttgcttctgctgtcattgtcgtttaggacagtattattgcagttattagtctgagagcttcttttttgagcttaactctgcactaggcattgtttgagctttctatgtgttgacccatttaatctcttaatcctcaagaggtgagttctacttcagtcgcactttacacttgaaaaccccaaggtgcaaacaggtaacgagcttgctccaggtaacaggctgccagtaagtgaggcagagccagctttcagcccgggtcatgtgagagcaggacctgagctcttgctgaccagcctgcgctgccttcgggaggtggtggtgattgctgctgttatccctggtgtcaccagtggagcttgtgttccaagaaacgtgaggccctgcctcacctctggtgtacaagcacttaacttcttttctctttaagacatggggtctcactctgttgcccaggctggacttgaactcctgggcccaagcgatcctttagcctcagcctcctgagtagctggaactataggcacacgctaccacacctggcttatgagcacgcacttctgaaaataagagttgggaggaccatgaaagcctcatgggtcagcacacaaggactaggagagggacaggctggaagggatgacatctcttgcagcttctcagctgggctgtgctttgctttcctgtgcttctctaccatccccatcgaatcaaagacttcagggaggatttcattctgaatctgggcctatttcaagaaactgatgaactggtgggatttcttccccactccctgacatctccctgctctgatatccagcaatctgctcgggtacacagactatcatgttttctactttatcctcagtgtgttgcacagggtctagcccatcatggccactcagtaattactggatggttggatggatggatgatgggtagatagatggatgggtgagtagatgatgggtgagtgagtgggtggataatggatggatgggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgagtggatgagggactgagtgtgtgggtgggtgggatgatggatggacgggcgtgggccggatgagtgggcatggactgtcgtgcgtcaggtggctatgatggtatcgcagtgtcgtgcgctgggtcgcatgaatggtgaatgcacgtgtgtggtgcgcgctggatgcaccgcgactgaactgtgctggtcgaggtggattgatgggactgagtcgtgtgcgtggggtgcgattgagtggcagtgaggtttgcttcgtggacgtggatgaggggatgagtcggtgttgtgttggggtggattgcaatgcgcaatcggtcacggagtgtggtggatgtactcggatgtaactgtcgtggctaggttggaatgatgagtagtgaggctgtgctggtgggctggattgtagggaatgaggtgcgtggtggtgtggactgagggcatgtatgtgccccgctgtggtgggtgcagcggatgagcgtgctgcgtgggtggatgacaggaatgtagtgtgtggtggcatggaaggaggtgaatgacatgtgtgtggcgtggatgagggatgagtgtgtggtgggtggatgagggatgagctgtgtggtgggtggatgagggatgagtgtgtggtgggtggatgagggatgagtgggagcatgatggacggaggggtgggtggatgatggatggatggtgggtgaatgatggatagatagatggatgggtgggaggatccataccacaatgagggatggatgggtgtgctgatgaaggatgtgtgagtgtgtggatgatggatgagtggatgatggatggatgggtgagaggataatggatggatgggtgggtggatggatagatagttgggtagatatgtgggtggatggatggatggtggatggatggtgggcggatgatggatggatgggtgggagaataatggatggatgggtggatgataggtgagtggatggatggatagttgggtagatgtgtgggtggatgggtggatggttggatggtggttagatgatggatagatgggtgggagcatctattccacaatgagggatggatgagtgtgtggatgagagatggatgtgtggatgacggatgggtgggaggatagtggatctgtggatggataattaagtggatggatggatagttgggtggttacgcggaatgatggatggatggatgggtgggtgggtggatgggcggatgatggatatatggatggatggttggatggatggatgggcagatagatggacgagcaaatatggatccgcctccttgattggttctgactaactcttcttctctccttttgtcctcacatccctcagatgctggggatcacagtgtcctctcctttccactcttcatctcagcttccttgactcatagtttttcctttccttgcagtctggctgttgagcagtgttagctatgcccccgtgtggtgcctcagagactcagccactccccctggactttccaggcggcagcagggaaaggcttaggagaatgtcagaaactgttggatggtaaagtgtgtggaggagaaatgaagaggaggacacccaggcccttagccctggatcctaaaggagcgggcagtggagagaacctgagtgctgtcagctcagttccaggacctttagtgaatgtcagtgggtgagagaaggactaaacatgggccctagtaagtatctgtacagtggattagttaatgattgagaggaaacagccaatatttgatgctgttgtaaataccaaagaactaataaataatggggaaaactaaaaccttggctagctctgtacagacaatactcttcagagcaatttatgtaaatgtcaaacttgtctgttaccctgtttgtttgtcttacatagatttgctcatcacctactatatatattggtgtgtgtgtgtgtgtgtgtgtgtgtgtgtgtgtgtgtgtgtgtttttacatggacttgaaaatgagtaagacataatttttgtcctaaaggaacttggtatctggttgggagggcaagaaatacatataaataatgtcaacatagggtatgatgagagccacgaaagagttataaacaaacagataaagaaatttgcagctaacagagaaagcgtgtgcattaaatgtaaaccctgtctccttaggaggaggctatgggatggggcagaaggctctgccaaggcccaggagggtctcctccatggctgtgaggccttggccagggacctcatatctctgacccaagtgggccagctgagccaggccatcaacacagctccatcactgaggctcctacctgggagggtcatatatgtcctggagggggacccgctggcctaagcctagaatggtggctctgcctgtcattaatcggtgccatatgcatattgtaggctttgattttggtgctaagccctgttcttgtgtgctcagccatatgttggtggtgtggtctggtcatggttcacgttagaggaagcacacatcatgagagagcccagagggcatggacagacctgcgtgaatgtacctcattccttgcaagacctcgcacagccttggtgctccctcacactcaagtcaaacatgcattcatgtgtttgtaggaaacagccccttgctggggccatgttggtctgcagtagggccaggcaatttgcatatttcctccattttcctaaagtaaaactgaaaaatgagaccagggcctctcaacacccacgttctcatgaatatggcactgtgtgacccttgacgagagaaaaccagagagtgctttcttttgattatgttcacttgatgaagcaaggttgccggaagtctgcccttttcttgcagaaattcacaggattacacaatacttctgtcccactttcaagcatccctgtgaaataagtaggttttgaaaagcaggtgcttggctttcaacctaagccaaaaggtctggatgactcctggaagaagacagagtatcactttggacaaaatgcaaatccatttagcaaccaagacaggaggaacttttttctaagtggaaatgcaccctggttgaggaggccagggcagaagagtgctgtctagagcactcagcagccaggcactgagctgcgcccgtggctgggggcttacacatgtatgttgctagaacattctctcatccctccaccagcgcccctacacacacattacggaagcagctctcagggcactctccctaaagaagactgaatttgctccgtagatattgattaagtatctggacttaagaccagagaagaaggtaaaatgaagctgaagtccaccatctttctatcttcagttcctctgtgtagggagagaaccattgtttcatgcttctcacatgtgcagtcttctggtaaagtgaatcatagaaacataatttgaccattcagagaacctttggactgagagatggaagcgggctacagggagaaaagatagttaaactaactatccggtgtagacaccagggctgagcccacccctagattgttgccccaaatctctcagctaatcccactcttatcttcatgctaattttcatttctatttttttcataattttcatgagtcacacatttattctagttaaagtccctcttttaaaatataaatcgctttaaaaggtaaatacaaatattttacaaataaaactattaaggtgcagccatttctattcagtcattcttgtgttcatcaaatatgaaatttgaactccctatggacacatttgagggttcacacttgaatccagagagagaagttcaatggcaatagcaataacaaaaataaaaggtgacattcattgagctcttaacgttgtgccaaagtaatttgctttcatcatcttatttaatctgcacaacaacccttcaaggtggggttcagttaatgctgccattcactgtcaagaaatagattaacaggcttagaacccataccagttcagcttccagtaaaatgtagtttcttctgaaatacctcgttttgagggactgagtttaccttgaagcccttcctccagctgctgccacatctcaccatgtcttggcagctatgtcatagaagctgccagtccacaaggccctactgtggccagtcagcactgaaatctctcctcttttccacttacctctacagcatggcaggaaggccttgggctgagaatactggttagcgagggagaagcgcaggctctgccagggagaactacggggtgggattcaggctcctttctgggtatgtggtctctaggaagagcaactgcatcagagagaactgaaggagaggtggccttggaggagagggctggagagcccagctcccacccaggcaggtgaccttgcacagggtcgtctgctctcatcatgtgtcctgacgatttgatgagcctgctcttgtttggaaactgtagaagtgtgaggcctgttgctgaaagtaactttctcttccctccacaggcatgaatgctttacagttgcagaacctggcgacgctggctgctgctgcagctgcggcccagacctcagccaccagcaccaatgcaaaccctctctctaccacgagcagcgccctgggagccctcacgagtcccggtgagtgtggggggtgctcttcccttgcaggtgatgcagcaggagtggcaggtaggtttccgtgcctccaggtgcgagggtgaggctagacgtgtccaggatggagccgggatactatactgggctgctttatgtcattgggttattttatttttaaaaatggtcaaagttcgaatttgtcttttattttccatggataatatgcaaaaaagttttcagtgagaatccactgtgcaagccgttctcacacattcactctgttttaaacactagtccattcaacactagttaagttgttaccactgtgaagagcctccgtctcttagtctttctttgtcctgcccttttccaaaaaataagacaatgtaagaattctgtttcaaaattcctagtcattcccatgtcacatttcacagcaactccatccatcacatttgattttaaaatccacggtccagtaaggaacatgtttgctcatttctggtcaggctctggggtgtgtcatttaaagtctttttttcttcacaaattttgttgccttgttgttcaaaagcagatgccagttgtcttttcatacaagccagatagaatgtggttgcttagataccgtgatttgaggttttgttttgtttttttttaatttaaaaaagtcgaacgtttcactggctttccatctctgagttttccagacctcaatagatggtctcacctccttttctgttacatgaaggagatggcctggacagtttccaagcttccttctaactttcaaaatcccatgaccccctatcagctgcgccccaaggattagctaagtgttggaaaaacgttaatgaaaaaatagcttcaggaaacacacatcgaaaactacagcccactccacgctggctgttttagggcttttgacttgagggaggaatgaggcaggttcctagagctggcagttctcaaaagagcagttgccctttgtctctgcataaaacattgtgtatctaagacatttcacctgggggattgtttcgagggagaagtctgagagatgtttaggagaagctggtggatttccctgtaatgtgctgagatcgcatggcaggtgtattgacttcactgtgtacagtgtcttcaaaaacataccgttactgtatgagggccttatctaatataataaacactattcctgaaaaatcaactttgtcacccttaatttcaggaagttaagtgatagcttcagtgcaacacatcaacttacttaagtaaatcctgtaacgatcccttttgagaaataaacatttttaacatgatagatttccccttcataaaaataagtcatttttttaaaaacatgaaaattagaccctcccaacttagatttcacaaatcagattaaaatgtattttcttaagagggattttttttctcccctgtgagcactttgattaccccaaaatagcactgagtattgtgaatgcattttggagcatcttcagtccaaaggaggcttgacagtttaagaagccaaatgcagaagcagctgtcggctgattggtgtagctaagataactcaaaaatcatatcccaaaagcgctttgtggtgtgagcaggacagatgtgctgcctaccttcgggagtccttcagtccttcagggacttggacaagaagcaaagcaatgagtgtcagatctgtgacagaatcccactgaacaaggggaaaggggactggaggaggtgacccctctctcaaaaggtgacctttgagcagagacctgagttccgtgacggaagccatggcgcgtgttgaggcagaggacagagccagtgggtgggggagagcggagtgggggctctgtggtggaccgcgtccgttccagcccacgttgggaggagtgtgagcttgttgcaaccttcttaaaatgtgggctactggagatcatgccactgcactccagcctgggcgacgagcgagactccgtctaaaaaaaaaaaaaaaatgtgggccactcagacggtctagggcgacggcctaggtgttagtcggaaaggaattttaaatgtatgtgactattttcaatttcttcctgagactgcagtggaggaaaatgtgttgtgggatgagccttcctccctgctggagtcaaaaccacaccagcgcagcgtccttgccttgactgctctgtaagaggcttcttgcccttcagaacacgccgctcgcttaggtgtcactgagagcgatttttctcttctctactgaggaatgctttgcataataactgaaagtattttattagaatcctaaagtgtagcagcagcagtgattgaaatctacatttcaattatttttcttaagtgtaactaaaaaatctgatgtttaagtgaaagtaaattatttgtctaatttccatcagggactttttgaaagtcacagaaaatgtggttagtagaattcatgaatctccacttcatcaaggcagtttcctagaagataaaaggggttgaaagccattcccaaggccattgccattatttactttttaaataataataaactgggcatactatttggaccatgagccagttcacttgccctgtgagttgaagggaagcctcatcccatctctcctccacaggcctggggtttaccctgtttttaagcgtgtctcttaagcttcagacaaattcatctggaaagcaaagggacaattcaatcccccaaactgttaatttttttaataattgtaaatttatcatttcaattttgcatacccaggaaaagtctccctacagcattattataaatgattttaaacagtcttggctttaaaacatgaaagattaagtcttaatttttgttaaaaaaaaatcccctcaggcaataaataggttcctttgtctcatggccttgaaataaaaattaaaatagtttaaattgcccatggttaaaataagtgtttcgtgcaattatcagatggtagtgaataaaattagaaattaaatcatgaaagaataaaatccaggtaagtgcatattatgccttttatgagtttctcacgggtcttttgaagcctaatttaatcatgtttcttgtcttttattttgatatgatcattttacctgtgtttaccccagtctcctatttagttaattaattcttgggtcatttattgttacccagtttttaacctgtttttgacgactgtgtctctgtttatgcaagaggcaaattgtctagaaggggtgtagctaggtattaaagaagataatgtttgtcttccattcagcttgcaaatgagttagttttgtctggtaattttgagcgcttgaagagactgttactgttaccacacatgaatattttttggtattttttggtctaaaatgtattgcattcacgtaccatgttattccactgaacttcttctgtcttcttctttaaagaaaaggatgctttaaaattctccaaatgcttctgtaagtgcagacttgaccaagtacacatccaggatcatagactggttcttcccatggtacaaggcattctaaaatgctaggaagcattttttcattcccaccattgacccttcaaagagttatcactttgaattctgggtggtattttccccatcttcaaggtatccccagcttccttgaaggctgtgacaaacaccaagcttcaaggaaatggtgacacttcctctttgactatctgagggtaacagagattggagtgtttggacgttgttcaggcattccctgctcgcctcacatagtcatgaccgatagacggtgactgttgttcttgcacacctgtgtcaccaaagcagctgaatgagcagtgggaaatgagaattcacccttgaagttatcctgtggcctttccattgacagggggctttgtcgccaccttcaatagatgtctgcatttgcatcagaggagaacttgcattaggcaaagaggtgtgatgcataagctggtttaacccacatttctgagccttctagttcatgcagggcaaatacataaaaatgagttggggcctgcactgccccctccaagtggtgacatgcacgaggcagtatcaccagatgggaaagagtggggcaggagagagggacagacaggtggacaaagaggctgtctccccaagactactgcagtggtcccacagcctcagagtcgagaattaaacttgccccacagacctgcccttcccgctgcctgccccaccctgctaaatggattgtcccaatggctggtgtgacttggtcgctgatctttgcagctggcccctggctcagctgcgtgcctcatcagcccctcagttctccctgtgaagcatcatttccctcccaggcaacaggagcctggaagagacccttgtcttctctctccttgtactactggaacagcctccaacttggccccttccctctgtctgtcttacacactgttggcaactgcggtctagactggagtgaaacaaactcctgagtgtggcattcagggtccacctggaccacctccgcccttccatccagaatccagccagcacacactcgcccatatcaggccaccccccgtagcccagccacgccgtcggcctttacgccattattcttgcaagcttctctacctagaacatctcccccatttcctcccacaaaaatctaatacatcactaatacttgttgcagtgctcattcttgagaatagtgtgggtgggtataaaagcgtttctaatgcacattataaaaagtatagtttatgctgcttctgtaatttacactataagaagatttttggcggtaattagtaaaaactgttttcagtaacctactacttatatgaatcaatgcaaatgccacctctaccatgaagccttctagttaggattgatcacttccacatcgtattgctgagtaagttcctagctcattctagacctggggcagtgcagaggttcctgaggagctgtcgggctgcttgaggccaggggcagagagggctggagtgtcagtgctggccaggcgttctgcagacgtcacccctctcctgtgctcccagggcacactcggcctcccttcactaacactgaccctgttgtctgcaggacggtgatgtgggcactcactttgtgtcttgccctctagccagtgagttattttaaagtagggaaggtgtgttatttactcataattcccccttgcatctggagcagcacatcagacacaggccctcaagtgttgtttgttttttttttaattcagtggaatagcgaagcaaaaattgtcaaagacaaatgtttaagggccatctgttcagtctagtttagcgcacacgtctctaaggaggcagctaaatccctcacagtgacgttggcagggtcagcgtacccacccagttcacctgtaaggcgtgcctctgcctggatccctcaagaaccaaacctgcaatttggtttcaccttacaggtgaatactcaggtccaacaggtttctgaagaataaatcagtactaacttacaccaaaacaatcatatgaagcagtctttttattacaggggcagcttattttacaaatagtggctttcaaaatgttctgatgtcacgatatagaataagtacgagtctggtatcagagaagggcatttcaccttcagaagaaccacctactctaatgtgtgcttttgaaacataacatcatggcagatcatccccagaaagtgcccattagctctgtgtgcactgctaagtccacgtagtcttccggtgcctgcccacactgcttacataagcaaggtcccatttagctttttagagtattttttacttataccacacttataaaatacagggcattttataagtgcaggggaccagttattcctgggaagatgggcttagcctttaccgtcctctttttcttcttacacccatcttttgtcattgtttattcttaagagaaagaaggaaatctcaaggtagaccattcttccctccactagcggctaagtgtctcagtcaggcagagtcaagccagttggtaaaatgggctgttcatgtgtgggtttcaatctgtcacacggccaggcgcagtggctcacgcctgtaatcccaacactttgggaggccgaggcgggtggatcacgaggtcaggagttcaagaccagcctgggcaagatggtgaaacccagtctcgactaaaactacagaaattagccaggcgcagtggcaggtgccagtaatcccagctactcgggaggctgaggcaggagaatcacttgaatccaggcggcagaggctgcagtgaccaagatcacaccactgcactccagcctgggcaacagagtgaggctctttctcaacaacaacaacaacaaatctgtcaaacgtcttttcattttttattttagctttcctatggtgctgacagtcaaacttgtttacactcattgctgcagtagaaagagcactgacctcccggtctttgctcatttcctgcaagtttcaacattttacactgcttttctgaaaattgtcttctttgctcgtgacattatggggctcactttattttcattaatgttaatggagtcacacattacataacatgttctgtaaataaaatgactctgtagtgactgtcacctcttgatagattttttttttcattcattcaacaaatatgtatcaagcatctgtgtgcctggaactgttccagcactggagacacatcagtagacaaagctgatgaagattcctacctgcatgtcctttctcttctagcatcagcttttaagaaaagcgtcattttactgaattcacaccatggtaaaaacaatttgaatagcctttaagtataaattgtaacttctacactcttaaaacgtcataaccaatattttgtatatcttacgttaaattttgtgaatgagaccaagagtgggagagggaagctctcttctctcctttcttcctctcctttgagctgtaccatctttctgtgtgtttggtgcagcagagagctgggagtagggccccccttaaggtagaactgcaagtggccaaaccagaaagcgagagggtttagcccttggccctgctgctcgggctgctctgtggcttctccacagaagcatgacacacaaaccaggtggtttgaaagttcttcggcatgtaagactgatactgttggggagaacagtagttggaaacagtgtgtctgcctagtaaatgtcctttatttggcattgatcatcctgcttctaaaggaggagagagcatgcaaacccctcccacccagaggggttttgagggccccttgtgtggagggagtttgggtgtgcaatgaacttctgcctagtgagtggatggatactccaggcagttggtgcaatgccccaacctggagcaggctggagtctcttaatagtctgtaaccaatttaaagcttaataaagctgcgcagctttgggggtagagatatttacggttcaccacagagcccacgctgggatttatgcaagtagattccacctgtgccctgagctctccttggcgggtgccttcatccccgggatggacagatcctcgcgtgcatcttagggctgccactcaccaagcgcattgttccttgttttgagtgggctttttaacatgtgcagacattgactctaattcttcacgtatttgctttttgctgttggtggcgctggactctgtgctaagtgtgatttgtttttaaatattgctttgcagactcttctgtattgtggcaaatccacatcagatccccttgtgatgtttatatgagctcaggctgtgttttctgtccagccacttaatgagattttttattctcactaaatcacagaaatttttatttctgtgatcttgtatgatacaaacatgttatcaccactagcactggtgaaaagcatgtgttgcttaattgtgttatattaggtgggaaaatcagcaaagctttattctagtcacaacttcccagaagcgtatactgtaagttccatttcttcagacttgaaagcaataaaatggaaatttttagttcagatgtggtttaatcccgagaacccgtcaccatcaactagatgcattggccacctacaaacacaagcaaaatgtaccgacctgtacagcacagacagcaggaaggcaggtaaggtacaggggtcagtgacaggagagattctgccccaaggaagtaagggaaattttagtagaagagttgacatttgagccaaaatgttcagggtgggtaggatgtttaaaagtagaagcagaatggaagatacatcaaatgtgggaaaatgcagaaatagcatttaatcagcaaatggaagttcatctcacttttcacaagcatggacatatggaaaaggatgcccaccggggaccctgagagccggggctcaggagctgggacttttcctgtcagcagtgaagagctattcaggactttaggcccaagaatgatagacttcctgtgtgactggactgaggcacccatttgatgtgagggagaacaaaaggaaaggaggaaaaatgatatggtgtgttgggcctgggtggccagtggagcattgctctcagttgtgaggggagttgaggaggaagctgtcatataaaatgatcggacgtggcacatggagagctcaagtgcacatgaacggacattccgtgaaatgtgtccagcagcagttggatgtgtgaccatcaggctgaccagagccgggagctgcagagtggattgagactgacctgcagaggccaggcgggctgccctaagcccggggaggggtgaggtcatcaggccaaaatcaccagcaaggcaaggcggggaccaggtgcagaaagccttggggtctgtgcttgtggaacagagggaccaggggatggaaagggagctttctgggtagcacagtgtcaggggagccaagcaggatggggctggaggaggaaaaggcagaaagagctgactgaagtttgagttggggagtgggttctccccagactggctgcttcactgcagtggttgacagttttgcaggcagtgagagaggacacaattctatatgacatgttcatgaaatgtgaatatttttaaaaatctgtaatggggccagtcatggcagttcacacctgtaatcccagcactttgggaggctgaggcaggagttccttgaggaactccctgaggccaggagtttgagaccagcctggccaacatggtgaaaccctgtctatactaaaaatacaaaaattagccgggtatggtggtgcacacctgtggttcccagctactcgggaggctgaggcaggaaaatgacttgaacccaggaggcagaggttgcagtgagccgagatcacgtcactgcactccagcccaggtgacaagagcaaggctctatcttaaaaaacaaaagaacatgaaaaatctgtaaaagtactggggtcactaggggaagaagtttttatgtttttgttttaagatggagaaacaaaacatatttgtagaccaaagagaagagccagaacaaagggaaacaggaataggccaatgagagctgaaagctggactagagttggagggctggctggagggatgagctcagcctccagcgtgtccctctcctgtggcgagggggatgctgccttctgagggtcgggtcacatgtcatctccccctgggaggagcccccacagcagcaccctggccttgtggtgccatctcgacctggtactagcacacaagccaacaggcacaaatctgaatcagggctgagtcagcaggtggtgcagcctgagggagggaacactgacctctgtcaggattggggaggatgccaagaatttaggacagaagggtacttatatcacatatgggccaagaattgatatatctggggctagaaacaaaaactcatgccggggcagaggtttaagaaaaagtcaacctacagaatgtaacagaggatttctaattatatttgtctttctagagtatgtagacatcttgatcaagagtcattggagcaagtaatgtaatcttaattattttctcagttgtgaaatagaattaattgctaatactcacttttcttgtggaaacattgaggtttatatatacacacatatttatatttatgtaaatgtatactggtgcttttttaaaaaaacgatgtttaagtatcatatatgggaaagatcgaatcattattttggagtgatacgaaataccacagctctggagaacagaagactaggttaaaactagaatgagggctgatgatgtttaggttaaaactagaataaggtccgatgatgtttaactgggttaaaactagaataaggtccaatgatatttttctctgaatctcttgcctttggaaaacaagtatctccccacctttcctttaaaaattaggatgtaaatacagggagaagacagtttcctcactcctttctgcttttgtgttctgctgttcaagggaacggggaactttctacctaccacaaatgccacttgagctcctagaaccaacatcccctccttaccaaatacaaaatggtaagactgggttaaacagagcaagactgctgtgtccaggcaggatttctgcactaagggtcaggcctgaggcccctggggagttgttggtttgtatctcgggccacacggcgggcggtgcgtgctctgcaccgggcccttgcaggggcagcagtcctactgagtccacgcggcgccccagcgagcctgcagccctgctgtgacgtccctgggctgcgccaggtgacctcttgccccctgctaccattggggtcatgttgcccagaggaaaatctgcctcccagaaatgatgttctctccatctggacaagctgccccccaaccccccccaggaaggccagacttcagacaggctgtcagtgacatggtgacatgggcctgctttcctgagaagcccctgtccttgccctttctcttcagaggcccgagcccggtcccatcattaaatgctacagctgctgttatgtatccaactgcctcttttgtgatccacgtgaggaaaacagaggcctgcaagggtcagtggtttgcccgggatgttagtgacaggtgaaatgacagcgccaccgcaccacgagacagtccatattctaagcaggaactcctgggatcccagaaccgtatttctgggtttcgccaattacacattgtcccccttgtaaggagatcatcaacatttttttttttcggtccttctccgggccatctgtaaaaacaaacatctggggccagctaaaggggaagtatatacttttgtttcagtaaatcataagcaaaatatcattggcagggaaaagaggtttgatttttccctctcatttgccccgctcgtaggagatccctgtgtactgcctgtatgaatggactcttccaaactcatggccccacactgcctttatgagtgcccgtcttcacgggactggggaagatgctaaaaattaggccgggtagggaggcaccctggtttattgacaacccatgaagtagatttcttagatccactagacagagcttccacaagcctttgggaatgaacattaaaggagtggaaacaggacagctgctttggacgtgaggagcaggtgctggcccctcacttccccgccttccacatgtgtgccaccgtacaataaagcctcagcagtcgttctgagtccagacccggccctctagactgaattttcctcttcccagtcttcctgagaaccagtagtgatgactcttgcccagcactgcaccaagccaggtggcatcagcttccttgggaagcagaactggcagcagaagagaggggcaccaatgtctctggggaaggtaccctcttccaggctgggagtgtgaggtcacacctcaccactgcagcgcccagtgtcactttccaaccctacctcctcttcctcagtcaccccgcccctccctgcccaaactatcttcgagggactaaattaaaatgaaaggtgtggttattgtggaataattaggcctcacggggggagaggtgtagtatattaatgccccagggttgtgattggctagtaatgctagtgcctgtgtcatggcttaattatcctacttcctcacaatcttttcctgcgcagttggaattccgcatccaagctcgtttgaggcaaaacggcgaccgcgggctccagtgtcctgagtatgtttggtcaatgcaggcgattttctccgtgtttacaatgattttatttcctaaaccacaaagccactgtgttttcactatctaattgttctgtggaaagtgtttaacgagggcaccgaaggcaaattcttgctgtcttctgttaatgttgttttgttgcagctttaaaaaaaagtattttgctatccaggaagagtggggagtagggttaatatgagaacattaatgcatttgttcctagaaagcaagccagtttctgggacagacttaacgctagacatgccctgcagatacactgagaccaagacaagggcgaaggggaaaattcatatgggaattatattttaaataaagaactggcaaatgtgagagatggataagcccctcattgctgtttttctccctttcgtcgtggatctggaatctttagaaggatggaggaatacccaagttcctccgcaggcagcctcaccccaaatcaagagtcttgttcaccatcccaccttctacacagaataagaagcccactggagcccctatgcgggccctgctcccgctccccaccccgcttcccccccacttgcgacctgcgactccgccccagaggcacgggctgcgcagacaggcaggcgcacacgagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtggtgaagactcccacagcacccccccaccccgctcccgctgcccccggccccgactcccgttccagtgaggggaggtgggcttctccaggacgggcttggactgggcctcagctcccacctgtgcagagtggcggcctgggagctgagcgtggccctcggcagccctgcttctgagctgcatcagaggaacggaggggttctctggccctggcccggtggcaccacggcagcaactggctttacccactctgtttctgaagctcttcctattttctctggcacataagcagaagggaatggtttgatgagggtcctgggtggggccacaggctcagccatgtcgtgaggagccccagttaggccgcgggaggtggagtgcgaggcccttgtccagcgcactagggcctgcatgtgggcctcatgtggagagagccagacagggtgcccaggtcagccgcctccgccttcgctggaaccgcctgcccctcctccgctcagcagatgccagctcagtgcccgctgcaccagtgattctcatagtttctagggaaacggacaagcaaatccctgctcttcaaccggctgtcttctggtggggtttcttttcctctggaagaacagaaccgtaacttaccactctcacctagtttttgactctgggttccttggtgcccagtgactgttgccctttcctgtcacaaaccaaaccttcccactccctgcagcctctcaccttctcatgcctcagaatcaagttttcacccagtcgtgatggaatttgacagcaccgcatcggatagtcctgacacacgtggttctctaatgtttgcatgcaaaagcagcgccgagggctggttcaactcagatgcccaagccccacaaccagagcgtctgactcagcgggagtgaggggagccccaggtggtgccgatgcgggcgaggctgtaactttacagtaacgatcttctccattaaatgtgtctgtggctacagtgcccccaaaggacaggattgggcccgcctcccccagacaagaactctgaccaaatggcctgcagagcatccgcagcccagggccctgggccaaagggacttgacaccacacaactgtggtctttttcttggtgactttctctgtgatctggtcatttaggatcgagttgggtgtacttggtgtggcagctgctgtgtataggtttccccgggagagaaagtaaaagctgtttccattttaagcttaatggggcttgtatttatgtcgatcctttgttctcgggtctctaaattgacatgagattttcacattgttccgctgtgctgcggacagtggaagttggagccttcaccagagttctgcctggaagcattagaatcctgccttcccggagtcctctctttctctgccaggagatgaagccagcgtgtgtttggcacaacaataagagcttttcaatagttggctttttggaccttgtggccatcaagcctagcctcagggtctacagaaacccccttgatacatgtcggaggcatctgctttctcaccccacaaacagggactcgagtgcctcagaggtggcccagcggaaacttcttccctagccggctctcctctgtatcgaactaaaatctgcctctgaacagcttccacccactgatcctaattttgatctcttgagctgcaaagaatatctttctcacgtcaagacctaagactgtttcttgccttagtcccttgcctctctaggctcaattttactcttatcagctcactctctttcaactcaactttcatgtctggtcacccttctcgggacgctctcaaaactatacacacagactgaccttcccaatgactggactaatgagaaaggctgcaaaatcagtcatccatccagtcgccactctggggaagaagatgttgaatcttcattgcaagtgctgtaaaatgaagtgtaaagatgcagttcctcttttgaggacagaatacccagattctcctccttcagatacagactgaacacacgtttattgatcacccgctgtgcatcagacatcagtgccgccttcttggattgccacgcccatccgcagaggcagtgtgtgttactcccgtttcgtgaataaacactaagcctcagctgaatggagcagatggcctaaggtcttacagactggaaggaacagagccaaaaaattaaaggcaaatctgagtgagtgcaagtttactgcttccataagtaagtctctgcagtagccactagatagacataagaggggaaatagaatcttgacttccacatcaacataatgctgactttgcagccagacccctgggtttaaattctggctctgccactgagagttgtgtgaccttccgcacgcgacttcacttcacaggataactgtaaaggacttaataggctaaggcatgtgacgtgcttttggcaatgagcagcacgtggcaagcactcacaccttagctgtgctcactgttagctttattcccagtacggtggagctgcagaatgttagtttcctgttgctgagatgacaagttaccaccaacctcatggcttaaaacaacacatttattatgttgcagttctgtagatgaggaacccagcagactcactgggctagggtcaaggtgtcagcagggtgtgttccttctggaggctctcggggtaaatccatttcctttcccggcttctgcaggccaccagctttacttggctcatggccccttcctccatcttcagagccagcaagtcctcatgctgccatctctgattttttctcttttgattccttcttccatttacaaaaacccacccagaccatccacaataacctcccccatctcaagttctgctgatcagcaactttcctagtccattttctgtggcttataacagagtacctgaaagtaatttattttaaagaggaattatttcttacagctctggagactgagaagtccaaggtcaaggcagtgcatctggtgagggccttcttgctggtggggactctgcagtcctgaggcagtgcggggcatcacatggccggggctgagtgtgctaacatgcttgctcaggacgctcttcctctacgtataaagccctacttccactcctgttacataacccatgaattccttaacccactaattcatgaacggattaatccattaatgagggcagagccttcatgatccaatcacctcttaaaggccctgccacattggggataaagtttccaacatatggaatttggggaacacacattgaaaccatagcacattccatctacaattttctctttgccatgtaacctaacatatttacaggttccaggacttaggacatggatgtctcgggttggctggggggtgaacagagaacataatagtaatttttagttccctctccaaacatagcccttaggccccaaataagcttcatttacctatccaggaatggcgctgtttgaacagagagagaagagagaacgggaatgcctttgtcaaacacgcatcggcatcttctggttcaactcggtgccccctcctccagccctggcccagtggatacaggtccttcccagttctaccagtctgatagtcacccctcctcccacaggaaatccaaggctggtgaggggctagggggaggtggtccaggttatccacatagcagagaaaagaacttttttctggaaagtggagctcaggtccttgcctctctggaaatttatttgagttggtttgagagagcttccaaacagcccttcctccacaactgctgtatccctaagtggcaaaggccattggcctccttgtggagtcctcatgcccacacctgggtgccggcgcccatcctgcatccctcacgggtacaccggggccagtcccttcaacactctgggcctctgcttcctcatctttcaagcgcaggaaagactccagtctagttcacagtttgcctgggaggatcccacctgcagtaaaatatccgtctgaaagatgtcctattacctgttattgtcagtgggattaggaagagaaggaaggttggggggttcagctctcagctctgttggagatattatacgggagttattccaggtgatgatctagcacctaatgacctaggcactcggtctctgacctacagtgttaacctaagacaagaatctcttctgggtgtagtgttcatcccagacctagcacagctctaaggagaaggaacccatcccgtcccctcagttgggattagtgtttgggattactcaatttgtagttttccaacagtgagcttatctgggcaaacaagcaaagaacttctgtggccaggccaaggtgggcatatcctcaccatcagggtctctggaccacctcgcttttcctgttctccacaccccaccctgccccacaaacagttttcacaaaaggccacagactttgtctgcacatgagctgataaaaccatggccatccttgcctgctcaaccattctctttcctggcacgccagctggcctgaacgtccgtcgcctgattgataggttttaaccagtggtacaacaggcttaaaatgtgacgtatccaagttattgcagccactgtgcgagcaaggtgaggtgcactttgcagcctccgtctgggatcctcttggctttgttctgcctcctcctgcttggatggtgcagcctctgcttgaagaggtgttctgggagattatgaaccaacatttatagaccgcacctctcctgagatgctcctttggcattttgtaaaacttttaagtgagaaagcgtagggtacagttctcagcacagactgaaggaatctgaggtgggaagaatgcagatggttgtccgaggcagcatcttgccagcctgccagcacagaaatggagagtctgggtgttggtggcaccgcatgtgtctctgtctaagacctctttctcaattgtgcatctgctgaacggtcagtctttaggtacttgatcaaggttggctgtgtgacaaattggagtttttcttatgctttaaattatttgttaacattcagaaggttcttaaaggtggctaaatgtacaataaaactaccctcttacaactgagatgccagttggggtgaattttcaaagtattgtctgatgatgtagagtgcacagggagtctttccactttaaggcaagtcatctagttaacttttcttagtctcatgcttgattcttctccctccttttcttcaccgtctccccaactttctactgggaccgtctaagaacagcgtagtaagaagtgagaaattatgtccagttcactatagccagcctcccagtttttaaataggaagccagggtgtaaagagacctaatttgcatattgattcattgtcatcaataacaaaaggggcccagggagtttctaggccgcctccacctctcctatggccccctgagctaggctgccccatgctcataggctatgcgcgtatctgtgcctaaggagttctctgtccaactcactgtttgccatcaccattgggagtcagccacatgagagcagtgtgtggcatcaacacacctgtttgcagacccaccttggagacttggaggatttgagaagtcttccctaagcacaagatcagccaggcctggtgtcctccagcgcctcttctcccttgccccagggcgaagcactctctagaagcgcgctctgacgggcactactctggaggcacctggatgggggcgcagcaggcagcatctctgggccagcagttcacagtgtggacatcataggaagagaaaggttacagcctggcatacagggccctcctgtgatttcctgcaaggtgggagaaggtcctccagcagaagccagatcagtggctgtgcagtcatcaacagttggagatgtttagatgaaagtggggaaaagtgttacctgctttcattgtttcataaaatagatcctatatcattttgtctgttctgttcagcctctacctaataactgatgatgatctaaaaatggtgccaaatacagtgccaaattcattacatagattatttaatctttacaataacccggtgaattcagtgcccttcttcttcctccgtttaaatacaatgaaacagaaggttggggagatgagggaacaaggcaggcttaatgaaaccccattttgcctccagttgttttgtgttttgtttttaagattccactgaaaagagctgatgaaactatagagttgtgttctttattaagagctatagtttcatttttcagtagcaatggggctgggccaggaccctttttcctgcctttctcagtgatgccccatgccagccaacctccatgatccttcccctgctcaccacagaggcaggcaggtgaccatccccacttacagtgcaaaaaggtggggagactggtgaggtctgtgctgtaagatgacgttctgcacagtgcaagctgcagagactaagagcaacagcctgtcttgtgttttgtgtcttgtgttttgctagatataagattctgagttaataggttttttctttttagcactttgaatatgtcatcttactaacttctcatccattgtttctgctgagaagtcagctgttaatcttactgggatccatgatgaatcatttttctcttgctccattcaagattttctcttaaactttcaacatatttctgtcatgtgccagggtatagatttctttccatttatcctacttggagtttgtttattttcttgcatgtgtggattattgtctttcatcagatttgggaaattatcagccattatctcttgaaattttttttctggtctttagtgcatgcattacacactttacatgtgtgtgagtgtgcttaatggtgtaccatatttctgtgaggctctgttcatttctccattcttttttctttccatcctttagattgtaaaatctctatcagtatatcttcaagttcactcattcttctgccaactcaaaccaactgtggagccctatggtgaatttttcattttggtttttacttttcagccccagaatttccatttttttaaatcaggacacaagtaaattacatatagcctattaaaacttgtcagttcaattcaggtcacatttatttattaattaaagttgtgtaggtattttgcagattatttcactggacttaccctcatttaaaattgtttttgtatggtgaactgtctaggctaatttttatttccatcactttcctactgaaagttaaattttaaaatgctgccgtttgccatttgcctggtagatgtctatcacatgctaggcagtatgattttcttagaattgcaagtgtcctctgtcctacttacttgcatgtactgtgttgatttatgaatgttgaaagaaatagatttactttgtaaaatgcaaaaaagaatttccaattttttctttttataatttcagcctttttattggcattctttatttgatgaaacattgtaattacacttataatcctttaggcatgattttttagattgttatcatatttataatagctgctttcatgtctttgtccaccaagtctaacatctgggccctcttacgcacagtttctgttgtctgctgtctgctttttcctgtgtacggattgcatgttcttgttcccttgcatatatcatagctttctattaacaacaggacattgtagatgttacagcacttctgggtgctaatcctccttacccactgcacatcaccccttccccactggcttctcatttgtgtttatttccttactgatttagcaagaataattcagtgaagtctattcccctgcactgtgcctctgctgtcactcctcagaggccacagccttgagctatgagtgacattcctatttttcctttgttaaattacaaaattcttccagacagctccctttcactgcctctttgcctgatctctgttaagtttctggctgctgtatctctgttgttttcacttccagctgttagcctccactaatcttcagttgtttgcgctattatttttggcccaggagcataaattgtccccacagtctgctctgattgtccccacagtctgctctgactgtggctgggccctttcgtaggggtgctctttcggccagtccttgaggcctgctctgatcccaggaggactctttctggctgtccctttccctgccctctctgctaagctttcagctggtctactttgccatcatggagctactgcctactcttaattgctcaccaacaaaatttatcttgtttctgacagtgcctgaggtttgaactttcctatactctgttccaaataattagttatccttaggggaagttacagagccctttgttcttgtgacctgtctctccctgctctggaggtggtgcaggggcagtggcctgcttttctgtgaatgacacctctggtctacaggaagggtactgtgtgagcataggagcaactggtcttctctccttgcctctcccagcataagacctccacccagtgagtgagatggagtgaatgggacccagtactcagaatgctatgcctagcgtagagcttcccctccatgagtaaaggctggactgaggtagggacccctctgcttcttggtctagaatagagcttctgccacagagttggcaggggtgggagctgtgaattgtcaatgttggtagtctccccctccctgggagaaaccataaccctgtgtatttggagctgtgggaagaggtagccccatcttcttggccatacctgcccagggtagagcttcctttatgctgagcttcagaggaggggatttgtaccagggaagggagcaggttgtgggttgtgggtcacatgccacagattcttgctgctcttactgagatttgataaatcttcttgagaaaaatatttcttcatctatacacttaggacaatttccagagactttaagtggttggtttttattatttttatctgttgtagttgtttcactggaaggagggcccaaggatatccttattttagaagtacttccctggtgtaccctaaaattgtgtgaaaatgttcaggccttttttgctggtttagaattcaaacatgtgcgagggatagtttttaacacgctacttactagcgcagcaatctggcaaggactattacatgtagactggcatcggatgcagtccctagaaaataccccaaataggagagacttctatttctggcagttaggcagactagattactggaaagaccctcccaccgggaaaaaccctaaaatgtatagtaagattttttaaaatatttttaatgacatcaataactactcaattagcaaagaatactcataaatcaatgattaagtgaaagaggaaactcagagaaggggtagcatattgaaggtggctttccccttaaggatatttggtgaaccgaataaattctaataactgttcgcacagctttcccaaccataaggaatacaaggaagtccaaggctcctgtgcagtatctaataggagaccctccccatacgagcctgaaacctcaaaaggctaaactctcagtgtaaagatgaacaaaaaatactccccactagaaaactacaaggaaaactgactatctcaaaacatagtgctgggtagggccaggggaatttccctctgagaattcataacaataaaccatccctcacgtgagtttacaacccagtttgattgtatctgagtggccaaaaatcctaagccatgaagttaaagtatccccagcttgtagtttcctccagcaccttgtagaatcaaatgtaagtcatcttgaaagaacccatcttcaacccaggcctcaaattattcctagaaataaagttccaagatatttaagctcacaaccaaaaaaaaccccacaaaatatacaagtaaaccaagcaccaagagtgagaaatagcagggacattattagacaccaccattattagacctcagatattagcattattagcatacaacagaaaggaaatacagctaatatgtttacatattaaaagaatttgaaaagcgaaaaagccactgattatgaaaaatgaccaatcatgttgataacattctagaaatgaaaaaatataatcaaattgtaaaatttggagatgtaagtttagcggaacattacatacaattgaaagagaatgtggtgagctggaacacagattttggagatgatgcccaaccgagaaacagaatatgagaggtgaagtgacatggaatagatctaacttaggtctagctaaattcctagtggaaaggagaaagagaatgggggaaagtcaatataagagcagctaataaccaagaacttttcagaactgataaaaggtagaaacaaaaatccacatattcagggatccagatgaattccaagcagtgaaaataaaaatcaatctaaacttggaagcaccatagtgataaatgcagaacaccaaagacaaggagaagatctttaaaacagagagaaaaaccactgtccaagaaacacaaacatctcagtacctgacctctcaacagtaataatggaaatcagaaggccataaaatgtgcttggaaaaacctctcagtctcgaatacccaggaaagaaatatttcatgaactaggataaagatgtaattttcatacaaaccaaagctaaaagactttttcaccaatagaccctcacaaaataaagctgtattggatataacttcaaactaaaggataaataacccaggtgaaagaagaatgaataataagcaaaggaagtggtaaatatgtgggcaaatcaaaatacgtggtatgaagaataataatgaagtgctgaataaaaactgaaaaccaagctacaagtaaaatacatgactacatgaatatcccacatctgggttcagagggggctcttctgccttaaagtattctcagatccttgaattgttctggcaaagagcaaagataagtaactttgattttcataagttaaagatgacttaaagtttttatgaccatatatgaaagagtaggaatactatgcatgacttccaaagtagtagagaggggaaatggaattgaaagacaaacctggctggcttggaggctcacacctgtaatcccagcactttgggaggccgaggcgggcggatcacgaggtcaacagattgaggccatcctggccaacatggtgaaaccccgtctctaataaaaatacaaaaattagccagtcatggtggcaggcgcctgtagtgccagttactcaggaggctgaggcaggagaatcacttgaacctgggaggcaggggttgcagtgggccaagatcatgccactgcactccagtctgggcgacagagcgagcctctgtctcaaaggacagcaagaaaggagagaaaaaaatgtaatattagcagaacaaataggacaaaatctaaatacccctagtaaaagacttaaattatcaggctgtgttgtttttaaacctgtctgtgtattagagatgtagccaaaatacaaacagataagtaaaaagatggcaaaagatatccaatgcaaaaacccaaaacagccggctttcttacaccaaacatcatacaaaacagacttcaaggaaaaattagaaacaaaaaggttgccccaaaaaggtttatttcaccagaagataggataatttccaaatctatgcaagtagtaacctcttgcatagaaatataccttcaagatacatttccaaaaataagcatgtttacatggagttggaatgacagacgttcacatgcttcttccagtaactgacagatcaggcaggccaagaaatgtcttacatttaaatgttttccattttagaagtttattgaagatattatgaataactttataccaatatagagttgaaaacaaaatacagcaatttctagaaagcagcaacttagtaaaacggattcaagaacaaaaagaaaagttcagtcatcctatttatcagggaaatgtaatcactatttcagaatcttcccatgaagaaatacaaagtccagaacattttactggcaagtgctaccacacacttaaatgacaattaattttaatctgacacagtctattccagagaacagaaaaataggaacactctcccagtcactgtatgaggttagcaaaaccttggtagcaaaactaaagacagtacaagaaggaaaaataaaggcccatcttactcatgcccataggcttaaaaaaaaaaaaaaagaactaagcaagatattatccaataatgaagccaaagaatgattgtcaacttcattatgtctaaacctggcagggcaggcctcccattcgcagatttccccaccatccagcagtgagtgtgtttgcagtattggtaaaacagtgctgtgaagatttttttaatcaccaaatctgtcaaaattgccacaagtacaatcccacatgtccttcacccaaagccacaagcacagctcctcagctccgtccactgagatgatgacagaaggatttccagtctcggctctcactcacctcgtgtcttctctccccttgtctctgttttccttttgtttttcagtggctgcttcaacccccaactccactgctggtgcagccatgaactccttgacctctctcgggactctgcaaggactggctggagccactgttggactgaataatattaatgcactagcaggtaccatcaacagtgagtatttgctgctctggtggacagccttcccccaaattctccacagaaagtggtcagccagaaatgacccgaaaaaggatatgccacggggagaactaaaacttgggatggaggagcacatgctttgataggcaaaagctgtctacactcgttttgcctcagaaaatccccaaccactctccacccccagattctcttcagtgtgtagcacagcgcgtgtgctcatccatggggttctgtggctggcagctcttttcaggtttccaggagtttggtttggtttggtttcggtcggttctgtcctgcgaggcagggtgttacggtgggaaaagttaatggactggaaggctggaagcctgaacccagctctgctgccaggcagctgtgggaagtcaggcagatgctgctccctctctgggcttgggagtctccatttgagaatggaaagttctgggtcagatgattcttaaaggtagcctccagctccaaagtctaaagattcatgacaattaaataggggagaaaattaggccttggaaagaaggaaatgaaactgaggggagaggagccactgctggcagtgacatgatcagaatctttattaagcacccacaggtatgggtcactctacatcagtgaccatccagagggacatcatttagctgtggcaggttgaaataggctggaggcaaatcacttagaaaattgtacttggttccgaaacatatggatggactcaccagagaactgcaggttctgtcctccacagcccacccgctcctgtcattctcggttgatgggggagcagtgtgccggccagaggataagtcgtgttttagattcatgctcggtgtgggttcctgtactgaggaaactgatcctcagcccacagcggggacatgtaatttccctgtccctccgtttcagatcccctggttgcctgagagtagccaagcccagcagatccacgacagctaacagagctgctgatacgggagcccagttagctaccatgcagcccaggcaccccggcacctgcccattctcatttttaataaaggagtccgtgacagttgttgccctattttaagccatggttcaataagtggactgtttttaaagggtgaccaggcagtatacttttttaaagcaaaataatcccagtaatttcatactgtaaaggctcggaataccttgcactggacttggtagaaaatgaacctaaaatttatccaaataaaaattaacttgtataatcctgataaatcattttcagaattaggacatttttcaggttttagtacatctttgtatttagtacatcttttggggaaaagcgaaaacgtggaccgagctttagctgaccatacctcccaaatgggacggctcgtgattagcgtggagcccgtgaagtggtagctgtgccgcggcctcattgttttattccagttagaaccgcctccagctttgacttttccagcagccaagtaggagcctcactgccttgacccccatttccggtacagctcctcgctctgaccttgtccttcacctaggtcgaggacgcgtgtgctcgcacacatcccctcatgctgcttctcttgccccaggacctagttcccctaaaacaaggactttgatttgaccgcctgcctgtccttggtctgcagagtaacaggccagtgggaatggttgtcctcctcagcacgtgctcatgactggtgtgtgtgtgtcctctcgtctgcgtcccgccctgtccacgctgctctgctctgcattgctgagattttcccatcgttctcgtcagggactggagaggggctgtgttgaatggcagagaaaccatgagtagttcttgtgtggggtcttgtgtgatacacattttgcttctggcaaggacaacaggcttaaattgttttgctttttaaaattctttgccaatgggttaatataagtctgtatagttcatagaaaacgaagaaagaatgtttgtcatttcaaataacccctgctagatagtatgaaccaagaaaatatttaattaaacccaaaaccagacaccaatgaaaatacattccttgtgattggaaagtgttactaatgcagagccgttttacaatctccagcattgacctcgagctaatatttgctgcttgtctctaaatatcaacagaaaaccttccaagatagagtatcttctttcagaccattccttctcaacagagatgattatgctaccagttccactggataattcctaaagaaattcgtcaagcagtggttacctggacagagtcagcttctcaaatagttgacggcagcttccatagcactgctatgaatcccaccccactgcagcagccattatctgtttccatatggagagtattcaggttttctgaatagagccaactcttacccaccgacacagcggtcagcaagaaagcaggtagatgactcaccagagccaacattttaccctctttcctgcccaagagcccagcacctctcccaaaaaacgaagtttttggtcagtagacaagtagctcaattaaactgtttgagtttgatatcctttttattccctgatacattaatgagtcaaagggctaaaaaacagtacagcgccctaaaaatgtaagaatcatccagatcagaagaaggaacacatgtgattgaccatcagagtgttcacctctggattttttcagggttccctgagcatgttttatatgttaacatctgaactaagttgaagaacatactttttccacccaagagtctgtatctgattttatgtgtttcagtgtatgtcaagtggcatcttatttttccttgttttaatgcataattcgaatggcttccaaatggcttaccatatagtgcttaaaattatgattgtttaaaaaaaaaaacagctgcagatgcctggtgaaaagtgtctatggaaatattttctgtgaagtagagaaaagagaagatgctccaggcatattttcgtggcttggcactacttgcattgtgaaattactgttttaatctgtattcctaatatctatagtttacacagccccacacaacctttgtgcccttaataacacaggcagatatataagtgacacccagtgcacatatagacatcttcatctaccttagttctagatattttatacttagcttctcatttatcagcttgcagcttagaaggataatccgtcatctatacaaaggaaaacttaccccagtgaagtggttacaaatctgtgagaatattaagacattctccctttttctttgatttgggataaagcctagcagggcagcttgcagggaatgtggtctgcttatggcacttggcttgtgattctccttttcagtgtcatctccttagtcccccaacaaaagacattcacgctcatgtttatgggttagtccttctgtgtcatgttaacagattcagtcatctcccagctcctgggtctctattgtaagttgagggcctctggagaggaatgaggcagaagaaactcagtagtcaggctgcgtgccggccctactgacgggccaggtgcagaggccttgctgcgcactgccgcacctgtcacttgcttccagccttccttgtctaaatagcatgcatgggaatggagatgataataataataaatgagaggaaatggtcgatccagtggaccatttcaaggaaaagccctattcttttaagtggaagcattttattcaacttgactttcttcacagctctgcttctgttatccagagcttttagaggaaatcaagtgcctgcagctgggttgaccaacactgtctttgatagaattaatctagaacaacatcaggtgactcacaggaactgttctcagaagtggaaggccgcctctgattgttcttcaaaccctaccaggttttcagctacttttccaccctggacctaggaaccaccctcccagattttccacgatagttgtggtttaaaatattctcagtgtgctggtacttgttagaacttttttgttcacatggatgtttataccatggaggtggcgagcccctggctggagaggccaaaccctccccgtgtcccctgactggtcccccttgagcatctgcatcccttgctcatggtaccgcctctgccacctccccagggaaacagggctggccacagctgtctcctacatgcacagcaccagcagaagtaaacacgacccttccagaaagcagattagctctgaggtgtagtccagagacacagccagcctctgtgaagtggagccaggagagaaggatgtggctggaatgtcactggctggagctccaagcctcacaataccctctgaaacatccatccagtatttcaagagcaggagctgtgttctgcttctgcattgtaagagagaaacatttttggcaaaaaggagaaagagttcaaagtaggaagataatttttctgacctggaaattaaaaaaacagctgtgtacagagaagggagttgggtcccagtgaccactgccataaaatgccacctgtgtatctggcactctggagaagccgagtcgtggaggctgcacatcgcaggaaggatcccccgtgggtctcacatgacagggcctgaaaactcccacccgcagcagacaaggcatcatggtggtgcgatgctgcccacccctccatgggaacttggaggcgtccactggagacgagctgctgtcttcagcccgtcctcgtctggcagcaaggccccacatggctctgcaggctgcgaggcacacccagaacctcatgccttgagatccaagcagagcggcgagtcgccgctcctctcccgccagaatttcctccacacgggcatctgcatttccagaggactgtgcccagagtgcgatcatctgtaatccacagcacccgttaacagcctggccaaagtgagaccaacagaatttatcagcagcgtccagcccttcccgagttattgtacatacccctctcacctatctcaaaaaacacggaagttcctttgcatcacacaaatagtgggaggtgaggatgaagtaagatcactggaggaatagagaaatgactctccagccctctggtggccatagtaacagggacagaggggaagcacagcggcagggaggtggccgcgatttgctggtgtccgagggatcatttagggtaattaggacagtctgcatccaagctctttggacagcacttacttgcatgacccaaagaaaacattaatgaaaatctcaatgattttcattaatagatagaccccttcataatgagaaacaaaagcagacacagcagggcctcagctggcaacacctctgaactgagcctgcactcaggaggctgccactccattctcacgccattcacactcgtctcgccacccctgcttggtgtctgttctgagaagcacaggaatacccgaggtgaggcacaatgacagtcctccactgttaagctatagcctaattcatatcttacatgtgtccttttaattgaagaggcgaagttggccaaatagaagcacaagtggagtaaacagaacattccccacctgctctgttagggcagtagcgttgctgggcgtgtggaggtcactctgctgccggattctctggtgtttccaggcagccttaccttagctgtcctccattctcattagacttcttacctattttttcagttagccatccttgctgttttcatatctccaatcaatagccctactttcattgagattttcattaatgttttcaataagctcttctcagaaacatcttttcttaaagaactgtgatcataaagggacccagaggcaattgtgatgtcacctcttccgtttcctgagttgatatgaaagttagcactctataaagtgttgcttgctttgactccgtattcagggaaaatgtgacagtcagccaccccagtagagccaaagagcagtcaggatacaaggggagaaatcgagtctactggccaccatcccgttcccatcaggtgatagccaaggtccagcccatagacacacctctgtctccagctgactgaaaaacatgacctggagctctttcagtggccgaaaccccagttgccacttgggcatgtgtgcatgcgtgcacgcacagaataactatttgctgctgaaaactgcaccactttgataccgaacgagtagcttcagctctctgcgactgtgggaagggtccacatggcttctgtgcctcaattcttcatcagccaggctatttattcctaaggtcctagtccctgacatcatcattcagctgtttagaaagtccgttttcccacactgtaactcctcaaactgcaggtccactggttccgagagtacagaacttgtcctctccaccatttcctcatcacacggcctaagggaaaaaagttttatttcatcctttcctcctcagccctgcaagctatcccatagttcctcaaagagcccagtaaatggatttcagtgtacagatgttacaggcctctgctactaaggttttttttttttttttacatgctcctaagctcccagaagcaaaaggcttttacttccaaaagataacaacggtacttgccagtagcacgctgcatggcattgagctgtctcgtctaactcgtgccacagtgcatttgaatcactggcctagggagtgagggttctcatggcttaggtcattttcccccattatcacgatttatttcttcatggtttcatttttagtttcctgtcagtgtaattgtgtgctagctgcatgtacttgctgttgtactgtgtttaaatgattctctaacttcctttggaaagcactaatgaataagtgctgtttctcttctctattgttgggttttttgtaaagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtaggtgccgcccttggccccaggcagggcccagcccaacaggcagcactggcctctagagcacggttagaaggtatcaaattgaactgaacccatgtcataacagaaagcagttgttttgttattcatgtttaaaaaaaaaaaaaactgaaagctgggcatggtggcatacacctgtagtcgcagttacttggcaggttgagatgggaggatcgcttgagcccaggagctgaggctgcagtgagccatggtcatgcctgtgactagccactgcactccattcggggaacacagacatacccctctctctcaaacaaaagcaaaaacctatttatttcagtctttctcacttggtcttatagttaccttctaatttaatttttcatcgatctcttcagatgaagttcttgtccattgtatatttatataccactctggctttgttgataaataaatggtttcaattatttcccccagctacatcttctgaagggttatggcatctctgcagatctaagtccaggaaagttgatcacctttcttgcaatccccaaatatcctctcactgctcaccccctgccataattaagttctataaactattaatttcccataaactacttcatagctgctgactgtaaataattcccagggacctccctctcccaagtcagcacagaccatcaccttttccccttacacagaaactacttgttgggggaaggggatggatggccacaggcttctgtgggtgaaacgctctctgtcctgtgtttgccagggttttggagtccacacatcctatgagtgtgtggccggctctcagtaggtgatggttttcaggtgaatgatgaaatccatggttaggattgccttggtctttgtttaattgggggtcttcagggaaagcaagtaagtgatcgattgccttgcttctctgccagtaaagcaaaataaactccaggaagttaatgctaagaataaattaaagctaattatgaaatggttcatgagtaagaccaaataaggatcactggtcattcttccttacttgaagctcctttagagcaaaatctgctgaatgatatttttttctgacttgtttaaatatgggataaaaagctagaatagagaagcactaagggagattttttgaagtttctttcccttctcttttaccctcaccccatagctccaaactgctttgtctgaagtgggttttaagagaacacagcttaaaagatactcatggtttttttttttttttaaaggaaggaaaaggttttttctttgtataaataacatggatatcacttttaaaatgaaaaatatatgaaagtctaagttacttttcattatttcaactttctctttgactattatggtaggcttttgaaacatgcacaggtgttcagacaactggttccccaggcttgtgaaagagaccctacatcataaacatcacttgtcttcccaaagaaaggcctgtgtgtgttccttttctctgtggtctgagtaccatggtgacaaatgagggcagagagcagggccctgtaggacaatgatatcatcacacagaggccagaaggccagttccccacatggtggtcacctctccactacagagcagggccttccagtaaactctagagcagtttagggatgaagtctgggccctgaaacaacatgtttcgaaacaacatgtttctgaggtttcatctgagcccactgccctcaacttactcgcctggagttttaggggttactgcttagtgcagtaattccccttctgagattaagataaaattgcccaaaataaccattgcccactcctgatttaagagtgcgggttttcagtagcatgcttttgggtttttgatttgttcagtttttctttggaatcatctcccaccttgtcataactctcttctgatccctttctcacccagttaatatgtgctcaagaaatttaaaccatcttcttattagtttaagtaaaacataattttaaaagcaaatgatgccaggcagagcaaaaataataataataataataataataataataataataataatgaattccagattttctactccacagttcagtccgaggttgcgagacctggtgtgttttttccccagacaggaagtgagcctctgatggcccgcctctgtccattacctgcaggaggcgagtcccatgaggaatggggacgctggtggactcttacagctttgttcctacaaacgtccccagttctttatgccagatcaagtgccctgtgagagagataaaacatgaacaccccaacagccaggaccagtagtgagtgtaacagagaatctaacaagtgacagtaacgtgcactgggagaaatctgatgaaagggtgacttgtgaacaggtgtttcccatttctagaggaagagagatgacacacaggtagaatcccatttttaaaaaaggtattttgttttttcctcttcatctcagccaccttagttgcatacaagggaggttttccatatgaaatctttttttttttttcattttaatattaaaaactcgggggatatacaaaaccaaactgtttcttggtgatggaaaaattgggggatctatgtcaagagatggtgctgacatttttttcttgggaatatcaggagcaaaaggacaaaacctacttgtgtgcgtttactggtctctctgtttccttggtctctgttgggcatagacaaattcagcatgagcaacattctagaaagctaggattactcaggcatacccagtcatctgtcatgtgcattgaaactgtattttctccccggcttcaggaggtgagatgtacttcacagttcaaactggggcccaataactctcatttgtgcatttggatcttttgtgcagtagcaacatgaaagctggtagcaccaaatctgaccatcagacataccacccaggatgtgcacacacagcagtgctcagaacatccctttccagtgtttcaggttttgcatcttttcatgttaaattttgattcccttaaaaccagaaaacatctggggaccaaaggcccccctgcaattgtgtccctttaaaatagactccttcccatgccctagaatacggatatatcccaggaaattggcagcaatatggaaagttacagtagtcattaagacacacttttaaatgagaaaggaagagttcactctgtggcttccatagtttgcctcaagaagttttctttgtgaaaagtcccaatcattaggatactttcttgtgatgtattttgtggaggcaggggaagaagcttggtttgacatttttacaaagttctttttatccccattttacttttcttcatgccacacagacacccttcccacatctagggaccccagtgcagctatcccctggggttgcctagttgggcaggcaggcctgttcctctcctgtgaaggccagttgaggattcctgacccgctgcagaagtcgcctcaccagttctgtgagcgcccctcctcggaagactccatgcctggaacgcccaagaaacagccagccctcatctccctcagctcatatttatgcccttttgtgccgcttttaactttcacatggtgctcatatgggtgggggagagtcaggagaggaaaagcgagggcagcttaggagcacgcacctctccagccagcagggccaagatctccatcctgcccttgctgcctgtgtttactgggaaaggataggtggacgggcagagcttggcttcctcggtctttgcccagcttctacatccactgcattcatctccaaggctaacgcccaggagagtcattcctctcaaagtcatgagactcaggctaccttctttccttgccttgactcactgccagtcatttctaataaagatgattattagactgtgtgttaagagatttggcaaatcaaaactggctggaaaactaggcaaatgatagagaaatcggagcagcattactgctacatccattattgtcaattgttacaattttttagaatgcacagagcacccttttttccttctcacagcctgtccgtacctgagaaaatacggccacccaagaaaaacccatgccaagattatctgtccccattctgcccactgtcaccttcagccccatgaaaaggtgactgaaatgcatatgccaaggggcagtggcacctgtgactcacagaagactgtcagtggaaaggaagccattcgtaaccagcatctttggaaatcaggaaaatctgaaggatgattgctttcctgaaaggcactccagcacttgacatttatccatctgtttgtttgttcaactaaatgcttagcctacctgttgttaaagtattcctaagaagggactttggaaactaagactcaagggataccttactctgactttttttttcctccttaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggtatgcaaaagaaactaagctagtatattgcagtaggttcccaagtgaagagtcgtgggaaggaaaatgtgagacagtttcagccaggatagggccttccccacattgtgttgggctctgattttctggatccttgtaagcagatttgggcaaagaaaggaaggctctgggaaattaaagtcaacgcccatacattaggtaatcttctatactacactattaaggaatctaaccacaatttagctcatcttccccactaattccttagccctccaggtttagtacaattcagacaccgtggttgtgggcaacaccatattgggggcttattggccttgacatacacgcacacaaagacactttcacagacagacacccattcatcagcaccaacacatccatgtgttcaggctgcttgcgtgatcgcagctccacgtgcccgggatgagcagttgacagatctcacggttacatagcacgctgcatgatgagatctgaagggccaccatcggggagtgggaatgaatgcggagtccaggggcgtgcagctgttatcagagactcagctgccatgccccctttcctcaagcagcctggactctgcctcttgtgggtgtttttcgctcccttagggaggaagggatgctcacagaatggactgatgttttacaccaggacaatagcattcattaaatatattccttgtttcatttttcaaaacctattggcccccaaagcagtttacaggccaggatgttcagagtatatattacttggcaagctcagggcccagtttgagttagagtatttgctttaatcactcctgcaatttaataattcatgctggtgggaaatagtaacagcataaaacccaggtagttaggtaagggctggaggaaacacacagaattctgtgctgtaaaggaaagtagcaaagggagggtggttctcaaacttaactctggctggtaatgagtaatcaggccaaagagaatgttttggcttctaaaactctaatcctaaggtctaatttgtgctatcacccaggaaggtctgaaggcatggttaaaggactccgcatgtcagccacttacagtcaccacgttaccctagcagcaaggctgtcagtcgggacccattcggcggctgctgtggcaactgtataaacccgtgtgacagttcagtagagagggatatgcaaattaaatcattatggggggcgggggggtgtgtctgagcaggagcctactttagggaggcttccctacatgatttacaaggctttgaggctgacttttgtgtttttcgtagctaaacaatattctagatttggaagggaattctgcttcatgatttgatttgagaaaatacttccttgaaaacagattgtttatcagcctacagcctccttaaccatgtgctcatactgatgtaaaccatagctgttagtgtcagcagacaattcttgagcatgatggactggtttccatttttgtggaacgctatagcacccagtttgcttggtgagccagccgcatttcttagggctgccagtcataaggtagtgccccgttccttcctagttcttagccaggttttgttatccatctcacctttgtccatttccattctgtaactatcttgctgttccttgataaagacccagagggaaaggaaagtcagagcaaaaatcttggatcccagatcacatttattgggaatgagacttaataaaaatgtaaacagccacttctttgcaatccagcctacctctgaaaagctgcccagcgttatgccgcatgcccatttttatcagccgagaactgggcagaaaagtcatgtcctcttcttcctcctctagtttgtaaaggaattttctctttagctttaatagcagatggatagaggtgcttagtatagaaccttccgaacagctgacgtttagacctaaatgtaaatcaggaccatagcttcctgtcaccactcggatcagcaccctttacagccttgctatacctctgctgctgcctcccccagtgctggaacagactctgggaccaagatcctcttgtcactgggtctttgcagttctttttcaaaagcttgccttccctgctgtttatggtggaggtcgttgctacagagtaagagatggggaattctcttcagatgattaagttctaagccgttgactatgtatcccccagactttgggagatgccagggagcaatttcctttctgctgaatttactggagctttggaaatggaaagtgagataaggagaaaggcccagcacttccctagtctccttggtattaactccaaatgggtaaaaatcaagtatgagtgagttattctagagtttattcgctaattgacccatcctccagctaaacaggtgtaggctctgtgtgacagacgatggagagctcgagtgacaggctggggcttggcagtatctgctgttctccagcccttcccttcccgagcctgcctgttggcctcacctggctgggacacgtgagcccctaggggcccccacagccctgaaatatttacaccactgcttgtatgagtagcatgtatggacctggggttcttttggagagatactaaaggacttgaaacacaatgatttgagcgagttcagtaagtggaactgaattcagccaaacaattgagtctgaggtttcagtgttgtggggaggggtgtgtgctccatgatgccacatttccagtccagccagctgctccacagctgctcagtgggcacgccccatcatccactcacggtggactcacgatcagttccgcagagctgtgctgggcccgtggggctggcacctcatgctggctcttcagccttccccagagctccagcccccttttctgttttctgctgggcttcctctccaggctgactccctctctcggtattttccaggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatc

SEQ ID NO: 13881 - DNA, 69199 bp, Human
  misc_feature (1)...(69199): n = A,T,C or G
gaaagcatattcacattttgtagtttaactgggaaaagcagtaacacaaacatttttttcccaaataagcttttacaaatttacaacttcccactctgttgtttttactattataaacaaccttgcgcttgtttgatgatctcattggcataaatctgtagaagcagtagtgctgggtaaggatatgtctgttttcagatttttttacacgtattatcaaattactttccagaaagattttatacatttatatgtttatcttcattataaggaactgcaatgtcaccattgttgtcaacattgagtattatcagtgcattttttggttagtctgaataggtgcaaagtgatattttgaaacttggatttctttagttactaatgaagttgattttttttttctatgtcttggtttttcattttagattttatttttatcagacctatatttggcttaaagattcagcaatctgtaagtcttattttgaaaatagcagactcctgtatttttcactgcctgctccatagaagtaagcactctccactgccctggctgattcttttcctgtgtgcctccattgcgctaggtaacatgccagtattgctgcttcatgcatcttccgtttttggcatttctattggtttcctgctttggagaatgagggtttggttttccaccctgcacccggctctgctacacacatgcatgtcccttcaactttcagggatttgacttcctttactcagctcccttgtttttaaccccacctctccttaggaaccaccatttgctttgaggaggggatttcaagaatccctatagttgctattttagtggggttttaggggaaatggaggtaaaagcatatgttccatctgccatcggtaactggaagtcctttttcatgtctttagtcatcatttttataaaatagtaattaaaattgtgggctgtggagtcaagactgtctggatttgaaaactgtctttgctgtttattagctttatgcctgtggacaagttgcgtaaaatctctaagcctcttttttatcgcggtgtaggattcataatgatgcctaccttagagtgtcatgtggtaaggcagggtaaagtgcttattagcacagtatttgctgcctggcagtatcttactatctgccaggcacttaataagaatgcagtatagttgttacagttgttactgctgttgctacttttaggaatttcttgctcataacctttgcctagttttctcttagaatgcttttttttttggtaagagaagccttttatatagtctgttattgatcttttaaaaaaacttatggtatatattcatactatttcatgttatgatctcgacttttgttgtcagatttatgtttttgaaagtctcctaatgttaataaggatgaagggtgtgtgtgtgtgtgtgtgtgtgtgtgtgtgtgtgtctgtgtgtgtgtccacacacatatgtatgataaaactggagtcctagagaccggttaggagattgttatagcagttgaggctgttgataaagggaactaaaaggctaaacaaagacatatttgtatcatgtaaaataaatattgtatcttgtgctagtttattttgtggagatccaagttcctttactttttaaaagccgttttgaatgtttgtctcttctacccaagtgggcttcatctgaaaacttagagctttcagtttcagtttctacttaacatcaatttctgtgaaattttagatccgaaattgattcatgaaggataagatttatcatgtcctaagtttatgccttaatgaacttgcttttttattgaatattacatgtattgctattacaaagttgtagttacaaatacttaactcatccttttatttgattttgttgatttgtcattttaggcagtatttattttttgttttattatgtcttagtttcataattaattaactttacgattctttcaatgacaattcatctaaatttgatgtcttctccacagattcagaccaggatgtagcactcaaacttgcccaggagcgagctgaaatagttgctaaatatgacagagtaagtatccatatttaacactttgggtgagttttattagaaaaaccatataaatagaaatggatttgctttttggagggcttacattccagaagcagtttgtttaacttcatggggacatagagatcatcttcgctgacttcatctcctgtctttcttcatccttttctccacttcagtcggttgctattcctccagcacaccagacttgctcctgcctcagggcctttgcactggctgtttcctctacctgggacacttgtgtcccagatattctcatgcctcattgcctcacatctttcagatctttgcccagatgctatcgtcttactgagatcttctctgacctcccacctccctgtttaatgcccctgattctaccctcagcactctgtacacctgccgagactctacattctaggcaggaatttcttttgtttgatttacttttgtatcctaaatgcctaggacattacctgattcacactaggcactcaataaatacttgactaagttaagtatatggaattacatatccgttgcgttcataatttacatctgctattataaatttaccatggatcttagattttgaatttatacaagtgtgtataatttccattaacgttttatccttatgttggtatggaatctgttttttgatattatagaaaatcacaattattgacaattgacatacctctttataccttacctcctgaggtctataatgagtcctagcagtgatttataaatgtcatgttttgtatttgcatcacttgcttgtaattatgtatctgttccttctgattatttgtgaggataacaggagattaaatcatagaaagtcacctgcactgtgtcctgcttccatgaggcatacaggtgatgctcagcttagcagttatgttcccagagttcatttttggaacatcaaacacagtttccttcattgtgatgaggttttattgtagtccatgaaaaactcagttaacttatttaactgcttcactaatttaaaaccagtgtcactctcattcattcctgcttgtgtgcatttttttccccacacaattaacacagtccaggcatcgtgctgggccttggggattcatagacaggagtggcagcagcccttgcctacaggatgctcccagtgtactgagaggagaacacacaagcagacagatggaggtgtccacaagacagttgggagtttgagtctaaaatttgagggattgatatagatagttatatttggggtttcttcactgatcagtgttagttaatagcctaagagtaaatgatacctagattaagaagagcagcgggctgtggaccgaactttgggcacaccatcaatgacgagttacccatgaaaaagccattagaagagttggtggagcatgaggagaccatgagaggacaacgtcacaggagttgggaagagggagtgagcgacactgacaagtacgcttcagagatccgttagatgaggcctgaagagcgtgcagcaggtctgactgctggaaggtcatttttgactttggcaagagtagtttcaggctggcatagctgtgaagtaaagaactagacgaggagcttctctgcctgcttctctaaggagtttgcataaaaaggcaaaaaagaaaaatctctttctctgagacgtgtttggtctagaactgtaaggttcggcagtttcttctggagtggctttctcatccccatcgctcttctttcctcattagcttccccaaggaaccctggcctgatcctggctcagctccgcgtcagctgctgctgacacacagcatcttccagagtcataactaggaaatagtgtttatcttgccaaaaatagttgggtttaaaggggaaaaaaaaatgttaaggctcataatgcctcacttccagctcttatttttagtaatacattaaaaatagctcttatttcttcgtccttttattttaaaaaattattcagttttataaactctgattaacacctttttttgtgccttattttagggacgagaaggtgcagagattgaaccttgggaagatgctgattaccttgtttacaaagtcacagatagatttggctttttacagtaagtcacatagattgaaagcttgctttttagattataacgtttctgtggtcacctattatattgattttctttatttttaatataattgctgtgaataaggaatagtcttacaatatgcgttttgatactaaattcctaggtttcttttaacaactctgtgattaaaatttaactgtttaagatataatttttaatattttttgcaatttagtaagaacattaagtgcagtaggtgagttatattaataaatcaacagagttaaatgcaaatggataatttgtattttaaaaataattataaaacatttcattctgtaccagcgcattttaaaaataaatagcaattcgaactttagtgttatgcagcctgaaaattagccttgtaaagaaatgccattcatcttccttatagttataaatgtattcataatattgcttctcaaaattaattccattcatcctgaatatgttatataaagagagaggtctagatcacataaagtaaagcagttaaaataatttggatccttaaaaacatccttcacatgatatgaatctgtctgttctggttctggtattgtttaatcggtttcctacaggctagagacttctattcatctttatactttagttccatgcaatttaaggattaactaaattttcattcaactgtgctcttttccaatttcatttattataaataggaaaaaaagccaggactttttattttataatacatgattaaattttgaaggaaaaacattcgttttttgtatagttcacagtaatgtacagtcctctgaccttattttctccttttctttttttctgagtctagaatttattttgctgtattatgtttttctgagagtaaaaccaaccaaccaacagacagaaacagttcccagagctggagaatatgtgctcttcttgtggctttgctgttctctggtcatgtagccattttgtgcttcatttttaaaacaggaattagtttacatactttttttatgtatcttcaggtgtatttgaggctttgaaaaagtaaaatataagaatactttataaagttctggacaaatattaagtgttattatacctaatgacattagctatctgaaatgttcttctgagtagttataatcagaagactgttttgtttttgtcgagacaggtcttgccctgtttctcaaactcctggccttaagcaatcctcccacctctataatcagaagcctttgaacttcactagaataacagcaatatttaactatgatggaaatactgtttttaaattaaacttccacccctacttttttaaaaaatcaaacttggctacgcacgtgacaagaaatgattgcatatttgtgtgggttagtgtgcagatctggggtatgaaggacaatttaaccattaagactgttaacaccagtgggttccaaacttgcctgcacattagaatcagctgggaaactgtttaaatagatttccatgtctttcctagattttgattcaaaagataggaggcacctcagctgattttgaccttcccaagtgtttctggtgggaatgaaccactgtaccagattttttatttttattttttaaatcataagatggtccaaatatggtataaaatacatagggaaacctgtgcattccaaaatggatctattaattacctaaattttcttttcttattgcttaaaacaacatgagcggggccctagaaacaagaggtacttttttttaaactggcaaatgctgtatttggctttttagcattatggattccaatgtaaaattttaagtgcacaaatacattattaacatttaaacacacccttgtgatcacacatacacagtccattaatttgggggaattgaaaacataccatcaagttaaaatgaattttaagaaaaaactacattcacaaatctgaaaggtatacaaaactgaaattgtaaaataatgaatataggtgccagctaaatttcatgaaatatgcctgcaaatgtggatccagtgatttttccacacttgtgatagttgggtgggaagacattccccagtgaaagcatccagtctctctgactcttgtctattgagaagcatttctaggtataaaaccatgtttgaactattacagccatgaaataagtgattctgacccaggagcctagtctgtatttggcaatctgaatattgcaatcagttcttttgtatttatgttttcactgtctgtgctaaggtccatttggctctagtggggaaaaagtgcaaatatttattgtgcacttactgtgtgctgagcactgttctgtgctctttacatggaataactcagttattcccctgaaaagctctttggggtaggtactgtttttgtcttcctctttttaggcgatgaaaccgaagcacagaggtcaagtaacttgccgatgttgtattgacagtgagcgtcagctctagggtgtggaccttggcagtcttcctgcagaacttgcattctgaactgctacagtatgctgcctgttgctgctttcttgtattttaaataagagaaatacagaacaagtgctttgaaatgcctagaaagaaatttaaagggggaaaacgaggacctaaagagaaggatactgtttgaaatgaacactgctattgagatacgtactaagatagctaagctcaccgctttttaaaaaataaagtagattggtactcattctcatactttttatcacactaattttatttactccatgatgtggtcctaaaacagacaacacagatgaacataatgaagcatagaaatggatattagggtaatgtcaagccttaataaatttcaccaaaatcagtgatttttagtacaatgagtagtttaagtaaaacattttctccagacattgttactagtggtttttattgcttgtcaccacagaccggagttttatgcgctattgaataaaatcatttggtgtaagcatgtagatattattccctgtcacaccttgatcaaaagagcatttttttctactgtcttagttctttgtaatttttgattcattctgcaatgaaattgggttttaagtgtcaatgttaatacaataaaatggcaaaaataactttgcaacctttgttgcctgagtttatatctaattacagttttagaaacttaaattacctgttattatatgtggagtgacagtaattaacaaatatagaacaacttggttttggaatagattacacaataaatatgaaagctgttgccaaaccaactgagctctgccagatgagcaacctctttgtttagtactcagcagtgaggcattctccccagtgtgtgccatgatggagttaaagctggagaatagagaaacagagcttgtttaaggaagaagttggagaactttaacattttaatcaaaaatagtcactgctagtctacttaacaaagaatgtttggtatttggataatgatagataatgtatttaggtcacaagttattaatagaagaattagaaggaagtcataccagaaataagataaaattaataccaagcttcagattttcagctacttatcaaaatgtgtatatttataaaagcagactctctgtagtttactgtgactgtataaaatgactgtatatgatatgcagaataaaggtgggtttgtttttaaagagtatcattggccgggcgcggtggcttacgcctgtaatcccagcactttgggaggcccaggcgggcggatcacgagatgaggagttcaagaccagcctggccaacatggtgaaaccccatctctactaaaaatacaaaaaattagccaggcgtggtggcgcgctcctataatcccagctacttggaaggctgaggcaggagaatcgcttgaacccaggagatggaggttacggtgagcggagatcgcaccgttgcactccagcctgggtgacagagcaagactctgtctaaaaaaaaaatttaaaaaaaaatatataaataatatatatgtatataatataataatatataatatatattttatatataataaaaatattatatatataattttgattacaaaggcttgagaactctttctaccaatcctataaattttgactggcttaaatttaaacttagataaaatttactttaaaaacaaaaataaaatttagtcaatatagtcaacttattaattttaacaagttaacttttaagtttccaaatgaaagttcatcttatagttaacataaatactccacctagctgttgagaggttataggcacataaactccgattagtaatactttcaaagtttaagagtagatgaacaatgtatccagttaaggtctctctctttccagagatggctgtcttatggttttcccttactgtatttctgtgagatataggtacttgctatcagcttggtgttttcttaaagcagcctttaggtgctcttaagcccttgttctctaaagcagggtttggcaaacattttctctaaagagccagatatgaaggatctttggctttgtaggtcatacggtctttgtcacaactgcttaaccctgctgttgcagcatgaaaacaaccagagacaatacattcatggcagagtgtgacagcgttccattaaaactttacaaaaatgcacagtgggccagatttggcctatgcaccatagtttgctgacctaaaggaattctctgcattcacccagattgtggtccttctttcttctcctccacttgaaggatatttaggaggcaaggtaaggatgcatccatgcctgcaggcatgtgttcatcctcctgttcatatcttcattcagcaccgtttactgagctcttccagcatgccaacttacgtattctgggcattacagggagctcttggtaagcagcagcagtgtcatcctcggaagggtgtgaaatttaagcatatgccggcacagagacttgagggggaaaagctctgtggagattggtatgcacacagcagattctccatgaaaagttttagatatggagaaatcatgccagaacatctgtataggaaagctggaccacatatttactctatcatccatctatgaggtctgaagacttttttatttgtaaccagtttcgtttcttcttgagaatcgttttctcagcctccgtcccttttcttcatatactcctgcatgatctgagatcttgtctgtatgaagttgaacccactgaattagtgctaaaagtctctcgactaagtgaaaatgttagttgtattatctgtgaaatgagagatttggactctaagatctcttttggcggttattcttttgtgttagttttgtggctgtagtaattgttcacctaaggactcctcagagtagaaaaagagtgcctttgaaaataccgtactggtgaataccgctctaccatgctcttcaagatgatatattatttgatctcaagagaaactaaggcaagaatataaacatagtgttgccaaaacagtactactgagaaagctactcaaagtgcataactttgtttatggatagcatgtggtttttatattactgacagttaatacaagaatctcagaatattttatattagagatgatatcacaaatatactgtgtcagaaatgaacttgatcttttagtgtatatttaaaaaataatctcttgaaattttgacagtgaagcattcttatttatttatttatttatttgtttattttgagatggaattttgctcttcttgcccagggtggagtgcaatggcgcggtctcagctcactgcaacctccacctcccgggttcaagcgattctcctgtgtcagcctcccaggttgctgggattacaggcacctgccaacataccctgtttaatttttgtgtttttagcagggacagggtttcaccatgttgggcagtctggtcttcaactcctgacctcaggtgatccacctgcctcagcctcccaaagtgttgggattacaggcgtgagccaccgcacccagccaagcattctttgttgtactgaataaagttttctctttaaattcacaagtctgttggaggcagttttttccttatgctatttttttaaacaatcattgattatagaccatagtttgaaccaagagtggaggtggtggtctaaagcagagggtggcaagctggggcctgtggagcagatccagctcaccacctatttttgtaaaagtttcgtgggaacagagccacacttgatttacgtagtgtctgtggttgcttttgtactacaacatcagagctatcgttgtgaaaaagacggtatggcccagaaagtctcaaatacttaccgtttaaatatttatcttgcgagaagaagtttgctcactcctagtctggagcagtgctgtccagtggacctttctgcagtgatggaaatgttctatatctgtaccgttcaatatggtggcttctagctacgtgacattcatgcacttgaactgtgcctagtgagactaactcagtgttaaactaaattaaattttaatgttaattagatgctttttattaataaatgtggcttgtggctactggtgacagtgcagggctggattttgaagataggtgaccctgtggttctagagtagctatcatttcatattgaattcaatgaatggaagcctatgtaactcttgtgatgacaaataaatattgtatgtcatatgtatctataagtatataagcttttaaaagtttgttttgatttcaacaatttcatataatactgtttttcctctgcagtgaggaggagctcccagatcataatgtggctgtggaacgggtaagtcctgctcttgatgtatttacagttactggtgaattgcctttattagaagaataaaattgaccacctttgtgattttaagtgccatattatatgggaatggtacagtcattgttagattttggacctcattatgccactgtaagataatagttaatggtgaaataatattaggagattttaggagattctgataggtagttggcagacttcattctagactggcaggtcctgagctaggcgtgcttcagaacagagaggctttgagagcacagctgcccagctcccacctcagtctgtgaaatcagcctctctgggtaggtaatttttaaaggcttcacaagtgattctcatgtaccctgtggcaaataaagcaccattctaagaccagcagttctttgaaatgtgactgttccaggagattttagtaaatttcttacaacaaccaaaatcgttttctgtgggtcagtattttagtattttaagtacttagagaagtgttacatagtaaacttgtcaacatttaaaaatctttcctcgttatacatagcaaggaactggctccacacccaggcatgcgtttgaagtagtgacggaatgttttaaggttgtccgaaatctcccttttcctccccactgtttctgtaccagaaaatgaactgtagaatgaaagtgggggtattgactgggattattatcagttcatgtatgtttgatgaggacaaggggctgaatttcaggtaatgaaggtgaaattggaattggaatttgaaaaatattttagaaaatcttcctgggatcaaacttttctgaaaatcaaaactgtagcaaaaccttaagatgtagatgaaattgccattttatgtatatagagaaccctataggcagacctgcagttgaattctcttgtgactgtctggttctctctcagtatcataacctagaggtttcagcaaatgaatacctttgttttaatatctacataattgaatagcaactatgtatcaagcactggcctagttctgcatagaatgctaggattaaataagacatagtttctgccttggagaagctcacatccagtgactacaggtaggagacgactggtggcttggtggggccatagtatatgtgaaatgcagtggtagtgcaggtggaggggaaaggcagattctttgtagctgaggaatgactgagaaggaaataatgagtaatagtgagaagttggtaaatgcccctgtgaagtttgtggcagtccaccttgaatgggaatgtaaggatttgttctcacactctgactatgatctctcttttgggctgaattaatgtaatggattctttgtaaaactaaatatattgacataaagactggcagagattatcccttcaagtgttacagtgtcttttatttgagaaatcagaaagagttggaagatatctttaacaaaagatatccacatttggcaaaataaaaatctggcagtccagtattgacttctctctccaacattcccctcccccttttgtaatttcctgatccagaaagtttgaaagtcttcagaccggtgatttaaatgattcaataaatggggaggtgaagaaaagaagaaatatcagacacaggaggatgcatgcttgaggaatattgtttttcaaaattttttattagttttttaagagatgtgcctatatagtaaatgacctcttaatgcagttaggcttataattaattgattgttttctccagaaagtttaatttaatggggaatcactaaaaaatgatctatgcgtaccttagtaatttattttaaaataagatataactttatattcacttgtcttttatttgggggtggggacaggattcagaggctgttgattgggtttccctaaggccttttttacggaaactgcactcatattgcatgacttgccttttacagttttggtttctttaaagtggaatgagaacttagccacatgcaaaacagcctaaggctggaagcctcttagtttatcaggatttcccccaagttcttcaggtttgagttaagttcttgtgttctgtggtgactgcctagtcctagtagccaagttttaccatttccaggaaatgaattaaaaaaagtttacatttttaaaatggaataaagtctagaaatgatagccttgctggtctgcagtctttatagagcatacacttgaagcatgctcttatttccattggggaagacttgtacactagtgcatagtcgggtaatcacagctttccttccagctttgccaatgtattattttacataaggcagttctctgtttaaaatagggagagtggtatacagtccttcctaagaggattagtattggtgtttactaagtgctttggtttcccccaaacaggcacttaagcacataaacaaacattatatttactctgtagagaactgtattaataatggattatattgtttctttgagtttattgatgattttaataaggaagaatagatatgtaaaactatgaattttcatagattcagctatcccttcatgtagtgcaatcttttgcatggtgtataggatattggaacctatttatatcaaaaaaatcttaatttaatgtagtatgaaatcttattcaagatacatgactgatagactttccaatgtcagggtgttctgtaaaaagacacgtttctttttgtacttcttgtcttcttctgacctctgctggtgaggtctaggcatgcctgactcccatcaactttgtcctcactcatgagtcctaactgaaacgaaaaacaaactgttaagatagggaaaaaccaaactgtttttcctcctctcatacttgacacagcacagaatacttccggttaccaagatatgtgtcggtttttccccaagtggaccccaaatttaactctacaatttaactcaattctgacactaaccagagtaggtgcagacctcacaggttaagagctcacttccataagattgcctctcatgtcagaagccagttgaaagtcttaggttatcacctgtgaagggctataaattagaggttcccacaacctccaggagggaactgggggcagagatcatatagttctcattatatcacaatacgcagtaatgttcaaatagagccattaaagcatctgaagacttgaatctgagcaaatcccaagatttcttattctacaagagaaggctatgtaatatccatccatgcattgtgtacgtgtctagcctttactatctgaattattagccatgttaatagtgggaagggccttggaccagatagaagacaaagctatgtagatgattcaacaaatgattattgaatacttactattcagctggtcctgtacagggttgaaaacgtagtctcagatcactggaggttgagaggtaacaaagaagatattggttccagttttaatccttcgaccttctttgccccagtaggagaggccagttctgacttagaggcaagatcaacttaagacaatagggtattatatcataaactttaaacagaagtttagcccttccctgaaaacagctcatgggaagaaaagtatacagcagtgtagcattttcttagctagtagaggtaatggagagatagcagagggagtagaggtggagatgatggcctttgcattattttccttgactgtatgttgctctgacattctgagagaagtagaattttcttatgtcagagtcttctatacaattataaaaatttcattggtgagaagcacatccagtgcccaaaatttagttttgaacatcttctccactacagggaatcacaggttcttgaactgatggctgactgcaggttgggatagggagagtataaggtgggccaaaatcattttgtaccagaacactaagaaatggtaaaagacaaatagggcatatcaaaaggacaaatttgaaggggagacattgccactcagacgggaagtagtctaagccacctcctaggggacagtttgaggttcaaaaagaataatgatgataatggattataatcatggaatcaaataattctttagattatagtgatattggaaaggggaggagctagaaaagaaaactttttaannnnnnnnnnnnnnnnnnnnggaggagctagaaagaaaaactttttaaagtccaaagttaataatgtcatttcataatatagaaggaatgatagaaaaaaaaacccaaacaccattttaccaccatcacagtcataattgattcaggtagggatcatcagtggatgatgagaccattgggtagagttgttaaggaacatgatatgcgccccataattgattcaggtaggaatcatcaacggatgatgagaccattgggtagagttgttaaggaacatgatatgcgccctgtctcaaagtatatcacgtggattattcattagttacaaaagggaatttctctattaatggaaaaattgggcaaatactaacctttactgaatgatgaaactgtagcatcatcgctagaagtggtacagcttggcatcgtgtgcatctgatgtgatgtgctgggaaagacaacataatggggtgataatcctgctgaaatccagaggagccaatcacacaaagccagatagtgtggccttgacttttcaaaacatcagtgtcatcagagacaaaggccaaggcactttggggacctgccagcaaaggcaatgccgaatgcatgattggattccgagttgcccacaccacagaaaaaaccagctataaagaacagtcttggggcaagtggggaatttggtatataggctgcttatgaggtaataaccagttttaaatttcttggatataatggtactgtaatcatgtaggataatgtgttttcattcttaggcgatacgtacttgaaatatttagggatgaactattcatgtcgtgattgtctaatgatcagttccccctaaaaacctaaatagtataaatgaaatctagcaaaaggttaataatctgtgggtctcatgaagcatttataagtatgtgacatactattctctcaacttttctgtaggtttgaaatatttcaaaatacaaattgagagaactaagatgtttgtgtatgaagccaacagaattatttaatatcagtttcatataggctgttaacatcagcagctctgccttttggcaacactttgaaaagtgttacccgcatgatggaataattccatttctaccattctgccacatacgggatattattaacttctggttacttctgtattacagtgatcacattgctatcagaaataacattctggtttcagtctatctgttcatattcattctacttcccacccctccaccttgagaccacagaatgttattaattccttcatagggttcagttgttttttcttatgtaaattctgtttaatttttaaatgtttaacttttcttatataacaaccactgttttaggtgataaaaacatgaacatatccagtctctgtagtcaaggagttcatactttgataatacaatttgggcatttaggccaactagaacacaggtgttaggtgctgtaacaatgatcaaaataattctcgttttatagatgagacaattaaggtacagaaagattaggtagtttgccccaaatgaaacagtatgggacagaactcagatttgaacccaggtcatctgggtcttgaatccatgccatggaatgctaagggaacagttggttttgcttggaacatggagcgatctgggaaaggttccaggcgttggacatttgacctaggtcttgagaggatgcataggattttaccaaatgatggtgagaaaacatgacaggcagacaaataggaaacatttgtcataaaggctgaaaatgcattgtgtatgggaatgacaaatagttcatggtggccagatcacagaagtagcaggaggtagaactggaaggtgaattggggccacattctgaaaggctgctcatgtgtgctgtgctaagaaatttgaactttacttctagaaaatgggtagccattgaaggattataaactgggacatgtgtgaagggttgtggtagcagtgtggaggctggagtgaagacaaggatcccagcagggagcttctgttttcatctaggaactctgattacctgaactggggaagaggacaggatggaagcaggagacagaacatggacccagcagagtgtggtttggggctgggaagtgagagagaaggagggcttagtgggtagtgatgctgttaattcatgtcagggacagaagggtactagcagcatgtttgggaaaatagtttcggatatgtcgactttaaagtctctgttgaactttaagtggagtttctaatacactattatattccagttttgtcttattgtggttgagtctatggcaagatgacattccctagcttattttttgggggcacttaagttcacatttgtcacatatgaatatgttttcagttacttcttcaaaacagttgctggaatagttagcttcggcatctttggtgagaaagtatatttcatctatgaattatagattcatgattgggggaaagagactttcatgtgcattcaagtttggtattgttgaatggacagcattatggagttagcacttaaacttgattgaatactgatacataattttcggatcctatagcttcccaaggggtgtgtgtgtgtgtgtgtgtgtataatatatattattttattttattttttgctgtagggaaaagcatacttaatgatccttaattttttttgtatgtgtatgtgtgtgttttgttcttgcagcgtgggaatgtatagcatttaaaataatctgtatatatgataagcattagaattcaaaagtgtgcttttaaaaaaatgactgcttcctaaagtgattcattgataattcatggtcataaaaatgaaagatagcaagagacctgctagatctcagcagggttgttcctggcaaagtgtatgttgttatactcttgggttggcttgaattatttggtgttttcctgttggtggaaaaaaggattatgctttgaagaagtcaggggagaaagtgcagaagaacaaaaaataccaaatggcaatttagatcaatcttaatttttcacagcttggccttctctaaagtcacatttagcagaaacattaattagatttcagtgccccactgagttttaaaattaaacatatttctggaaccatctgcaacagtttatcactaataatataatgaggaaaatatacttagccttttgaaaaatacgaattataaaagaatatctttttctcatgagtgctcatcttttattgtgagaaacccatcaaaaattttaaaaagagttaggtaattgagagttttaagaatatgcctaaaattgaaattctataaaaatattctcattggtgagataacttttcctaaattcaggattttctttggaattttatgtacttttaggtctaaaaatagtggtggtgaggcatatatgccatctgccagcataatgtctgcctgtttgaggctggattgcagacagtcagtaaggagctgctgcttccatccaggaatgatgattgcctgaactagggcagaggacaggatgggagccagagatgtggtggctcagagtgtacgtcctggagccaggcttgcctggctttgaatccgtcttctaccacttatgagaggggtgacttgggacaagtcccttaagccctttgtgcctgtttcctcattgtaaaatggtgacaatcatacctacctcgtggggttgcagtgagcatgcatccttgagtataaaatgtatcctcagaatgattttcttttctgagtagacttgtattttcattgctttttattcatatacttactactcatgggcccaggtacttaggaaaaaatattccttctcctggaaaccaaacaagtgaagagcgagcattttccgtctcactttccccattccgcagccttgcccctgaatttcacttgagtgggcacgcaagagacttctcccaactttggcagcctggtgtcctgatgcttttttgtaaaccctttggagctgctgtcggcccctgctgtctcagaaatacatgcattctcaaggctgcctggaacattctttcccacattgcatttgattaaaaaaaaacaaaccctaataatctctctgttcctcattttgggatcattttctctggcatgcctaggtggatttgactgccccttctgccgtggcccttcctgcctgtgccagtgcctgccacaacgcagtgtgttccttgtccattgtccttagcacctggtcaaatttctttagggcagcaactagtacttagttttattttttttaatagtttccctctagcataaggctacttacacattaatctttccattaaataaataaacagccacttttcctttaaaaaactctcgctaaaaacaacaatatactagaattcagtaaaataagaaagaagagaattaaatttcaaagtagtgtttttgttgctttgtaaaatatttcaaaatattttttaaaattttgtttaaatttgtagaatacacaatattttggttacttttcaagtcttggaaaatttaaataatatctttttacctagagagagcatttcctattaatcttaactttagctatggactagtattgatacagttctgatattatccaactttttacaagttaggatatctgctaatatagcataacttttttagttccttttttagaagcattttctttgaagttttttataactcataagtaaagaaacgaacaacaataacaatgaatttcaattttattttagcaaaagcacctggaaattgaaagaactaccaaatggctgaaaatgctgaaaggatgggaaaaatacaagaacactgaaaaggtaatttaaaatcatgtttttccatatgaaactatataaactcaatgtggattttcatagtagaagttcttctttaattataagagtgttacattcatatttggttttgaaattttggtttaatttagcagtatgcctcgaattaggagtttttatattgtaagtaacgtaatacccgattcggattggtttcgacatttaagtctgtattgaatggttcagaggtgggatgggtttcaggagtgatttaattcagctgcttaatgaagttgcctgtgccatagtttcttccatctcttctctgccttctgcactgtcagccccatcttgaggttggcttccctttgaggtcagaatcactggagcagttccaggctttgtatccacagatcatactgctcagaaagagagagggctggcctctgaaagcattccctcaagcaggagcaatctcctttttcaaaagcttctagcaaacctcccctttaatgtttttgccttgcgttgagtttgtgctaagttagttagagaaaaatacatacatatattaatatcaccatgcgtctcatcagaaaagtctttaaacagtgagaagatgtcaagctcctggtggtagaagttttccaaagctgttaagttttatttgaaaggtcaaatatcatcagtggcaataaatactgtgtcagttatcttccttcaagtgacaggctcatttaagatatttttgagaaaatgtctgccagatacccagtgcttgagtggcagttgcttattctttcaagtaataacagtggtttgtgaaaatgttcatgattcaaagaatttcatcctaagcactttttcttgacacagtcattgcacttggttgtgcagcacagagctccgtatgcacttcccgtctcgtcactgctcgttacgttaataagacctctgtcaagggttgatatttaatcaagttaacactttttactgcttcatcgagggcattcttaagttaaactgactttttaaaacacagagtgaggaatcactaattccacagtacagcactactgctgccttgattagttccaagagccggtagttttaccaccatagcttttctatcatcagtgcaaaagtttcactatagcttttttatgatcggtgcaaaagtcagcactgtaaaaagaaatagttttattatgaaaatcgttttggtttcatgggccatattttgagaaccactgatgtctaagcctcagtttcctcatctgcagaatggagataatagtgtcccatttcaaagggatgaagatttcatgatttaatgcatgtaaagcacttagcattgtaccttacatagaacaagcattcagtaaatgttaactacccctattaatttcttgaaggaaggctgaacaataaaaacattttaaaggaaaaaaaggaaatctaacttagtcctactagcaaaacacaactgagttaactgttgggatttttgtccattcctcacacttttttcagtataatcctttcttttccctttttgtatagatacagattatcttatgtcaacatttgctgatgagaattccagggagcatgagtttcttgggttctactagttccacagaagcagtagtatagcctgatggtgaagaggcagattctagaggcagactatcatgggtcaaaccccagctctgccacttcctagccatatgaccttgggaaaggcatttaacttttttctgctgtactacctaccccattaggcttgttgtgaggattaaataagttagttgatgtaaagcatagaatagtgccaggcgtttagtatgcagtcagtatgtgttgcttattattaaatgaggaaagggctctctggttaaataaagttgggaaaacctgaactaaaaaaaaattaagcaagatttctttctttactgtaggattatttagtctttaatatgaggtatgaatttttaagagggatcttaaatcacatgaaaccgacttaaccatgggaatctttttgacatgggtatcttacagagctaatgagccttttctttttgagcatactaaatatccttaggctcttatattactttgttttcatcaggggtgagttcatttggggtggttgattttattaactgtctgttttagcattaggtttagaactcaggatgtttttaagaggacacacttcaaagtagaatattagttacaacatctgttctcttgtttaatattatgcagtctcagattggcctacatttgacaactactttacatctttgtggaaagattgctcaagtggtaattacagggtagatttcaatgcattgcacctatcctttaatctcacattcattctaataaaatatttgtagaatgaatattttgttattctgtggtctacatatgcctatgaaagtacgtaagcctctctaaaaacgaacaattctactgggctattattctgacagcaactctggctaatgcagttcccatttagtgagattttagcagtgccatgtctttgaagtataattttgaagcactctccgataactataatgctagaatcatttgatgatatatgtggcccaatttggtgtgaaacagaatgaaccttctaaaagaattactgctttcaattcacacctagttttaaattgcattcaagtaaaaaaactagcattttttttcttgtctttcaaggagaagtatgttttctctccacagattccttacttatatagtagtaatacagagaaattctaaaaatatttgaaataaaaatatagccctggtagggaatatttggatttttagaacccaagctttaatgaaaaaaaaaaaaaaattctgttaaggttgtttgtgttgcctctgttctcacagtgactgcctccctatgtacagtagtattgtaaatttttttgtttttttttgagagacacggtctctgttgcccaggctggggtgcagttgcgcaattatagttctctgcagcctgcaactcctgggcttaagtgattgtcctgcctcagcttcccaagtagctgggactgtaggcaagcaccaccatgcctgctaattaaaaaaaaaattttatttttctagagatagggtcttgctatgttgcccaggctggtctcgaattcctggtgtcaaatgattctcctgcctcagcctccaaaagcattgggattacaggcatgagccactgtgcccagcctgtattttaaaaatatagtctatgaagtgaagttatctctgttaagtggagaccattatgatttaactggtcatgatatacttgtgtctaagctatgtcacagcaaagtgccttctacaaatacacatatttttttgttggtcaaataattgaatggacctttcagaccatattaaccatttttttttaactgactggaaaatggaggcatattgcctagaaataaatttcttaaggtcacacagcttgttagcaacaagcaaaagaatgtccagacttagagctcatttaactgtaccatcttttatgccagctttcccttttggtgtctgtcagggaagtagaatgtagttataaaacacagtagggccttgtggatggtttaaaacttttttagatgcagatttgggagacctgttgctgtttgaaggcagaaacaaaggagccagtggagcagggatgatgagagaaaatggagaggcagtgaaaggcataagcagctcgagtgagcctctgtttcatggcgcacactcgcacaaaactcagccaggcttgctgggctgaaaagtttactcactggcagtcataatgatgtggattgcacacttgtcactgttttaatcaccaaggtttagaaaaaggtactgaaaacattagtcatttgttggaattttttttttaagtccatagatttttaaatgtttctgtgggactactgtagactttttaaagattttatgtatcatatctatgaaacaaatttgtagaagaatcttaaaggtgatacttttcaaattggaatactgaaatgttacaattcaatatgtagaagttctttatcatggttgttaagagtatggattctgaagtcagactcagactgaatttgagttcttataacacagtttcttttgagctagttacctaacctttctatgtcctaattttttcatttgtgaaatggatatgttaataatagtacctacctttttagggatgcagtaatattacaatgaatgaattaatttagaaacacatagcatagtgtcagctcataataaataatcagaaagtgttctttaacaattgtcattattactgttggactcatcattatccacatccttgctcccacccccacttttcccttcctggcacattcctattcagtattgagtttattgtcattttctctaaaggaactcctttccatctctcacacaggattagttcctcctttcttctgttatctctaagataagctcaggatgacagtccctgtgttggacccataagaagtgaccatcacagcagatgcatggcgctcaccccagcaactttgtccctaacccttttctagttctctcttagaattgtatgtatctttttgtagaagggctagccactccctgatagcttctctcacagatctcgacagtgtggtgcccaccatccttcttttaccactctggctcactggggagtctgtctctaccagcacctcccctgtcagggcatggtgctcagcactgttagcagctcatgtatgtgactgtgttttatgataaaggattctctgtttaagttataattatcagcttacgtatttctcttcccagtacgctgtgagctccacagatctttttcatgtttgtagccacagaacctcataagcgttggccacaaagcgggcattcattacaagttatcattttagaatgaatgaatgatgttcgtttatgagttgaggacaaccagctatcactttttactgataaattctgccactttaataaagcggtaatttttagaagacagtgtgatttggcagaaagtccccgaatttgtaataagaaggtagaactttttgacctagggcagatacttttcttctgtatcttgttttacttacattttaagtggaaaccacccgctgaacctacattatggggctgatgtagaaaagatgaaatgccactttgccagttgaaggattatcaacaactgtaaactggactactgttctggggaataagcaaatttcatccaaactgttgtgtttggaggtaattcccactttgttttatagagtttgtaaaacttctatgatagttaaaaatttgtgaagaaagatatgtaactgtaataagttagtctgtcatgtaacagtacaagtatttgaaaaacagcataattagaaaatttttattttagggtcttataatttaattctttttctgctatatgtgattttgtgttcatgttttgttttgtcacctcctactgcttggattccaaagacatcgtttttatattccttttaagtttttggtgtaattatattatcattattttagtgttttctgctcttgggctttcttgatactttcctgttcgctattccatgtattttagtaagtccagctgggcaaaaccatgggccgtggtcattgttttttacaaactgtaaaatcagtcatcttttataacatcttgtgcttgcttttgggcaagttatttaacctctttgtgattcacgttctacgttggtaaaattgagttgttggtataattaaagttatagaattgttagtataattaaatgaggtaaatatccataaatagcttaaagggaagggataaaataaaacagattaactaaatagtttcttatttaaatagttgctaagtagtttctaatagttgttaaatagttgcttaaaatagtttcttgtgcatggtaaatgctcagtaatttggattaattgttgccatggatgatgatagtgacactgtatcaatgtttcttaagctttcccatatgtacctgatttttaattttagctctgtactagtatggggaccattaattttttatttccacccccagatttcctactttttaatgtaatcacagccatttgatggagtttttttccctaaatgtagatttaactttaagataaatgatgtacagtaacttatgtacaattattgagtacagaattgagcaacagcaacaaaataatatctgaagacttttcaagtaatatagcttaagaaataagtgtcagagcgcttatgttactcattaaaaatgtcattattttacttgttcgggtccactgaagtcagtcatattacacgttcctattaaaattttacttttagcatttgcagtgatttctacactttctgttattcaaatcagttgcctgcagtacgacatctttactctagaaatttagaagataatttgaagtgactttttgtggatgatattactttaaaatcacagtttactataattgtgaagtggtatagatcataacttcctttgggaaaacaagtcttaaattcacttgtttttaaccacacatgcttgtcgagcatgtggcaaatgttgcgagtctagttttatggtcaacatgaagcctttctgtacatattcctccagttaaagtgatcgcatgggattaaaatttctatgactgtagtcactatctactgaaatttcaaatttgaggcatactatatttataccaaaagaacaaaacaaattttgtaagtcattatttgaatcaaccttacagtattcactgttttataataaaagttgttcatctttgtcactcaccttcaaccacatgatcgaagtttcttaaagctgctttatgacttagtcactaaagctttagtttaaaaaagtctcagtagtgtaatagttaaagccttgtgtactacttattgtagctcttcaatatttcaattattagaactggcatcttattttctgaaccataacattcaagtatattacgatgataataagagtactagttcttacctgaagggcttctgctataatttatttaattatttccctgtttggacatttatttttaagtttcaaagtgttaggcacaacattgtgatgaccgtaataggttttatgttattttgagtaattagacttgaggaaaaaattaattacaagaagacggagaggtgtattgaacttaagattcttagggcaatagcagtacactttcaaggatggagggagttgatgacacaaatgtttcttttttttttttttttgagatggagtctcactctgttgcccaggctggagtgcagtggcgcaatctcggctcactgcaagctctgcctcccgggttcacgccattctcctgcctcagcctcccgagtagctgggactacaggcacccaccaccatgcccggctaatttttttgtagttttagtagagacggggtttcactgtgttagccaggatggtctccatctcctgaccttgtgatctgctcacctcggcctcccaaagtgctgggattacaggcgtgagccactgcgcccagctgatgataccaatgtttcatgcctaatttcattcaaaagtgatgtcttcccttgatgaagatttatcgttgtttttgtcttatcagatagcatcaatgtcatttaagaaaaagaaaaaagttttcctgaagaaatagcaagaactgaaaagaggagagaaaagaaggagaaagggcaggggaggggaaatgagagtgagaaagagagaacactgaagatggccagtaggattaactggagttttcagatagatgaggagaagcttggtatcttctgagagaccagtgagaaggtggcaggaaagagattaggagtcagcactctacaatccatgaggatattttggggacaaggcaacctttttgctgtttggagcatcttttaggtgtgtgggataaaaggcagaaagtgtgtaagaagttaattataccatcagggaatgtgtaaatcagatgttcacacctttaaaaagagcactgactgcttttgtgccacttaagggacacttccgtaatggcctgaacatgctaatgcattgggcattcttaacaatttcttgttatactctctccttctttgtctgtatctccctgttagaatcttaaaaatagagatgacagtacctccatgtgccatgttgaaatgtattaattaattgccatagatgctttgaaaatacaatgctaacaaatattagcaagattaactgtagagactaatctaagtttttttcagtttgtaaccttcagtttctttttcttttaataagtttcataggcgaatttacaaaggaataccactccagctcagaggtgaagtctgggccctccttcttgagatccctaaaatgaaagaagaaacaagggacctgtatagtgtgagtagctaaagctaacttgttattttgaaattaaaaagtaaaatccatttcttttagcattcaaggtgacataagatattcatatgatcacttaaaattatattaaaattctatcgcattggaggttttggaggtctatttgttttcttgattgcaaaaatacttcttaaattttaaatagatacttcagtaaaaatgttattgtctgtatcaataagtatgaagtgcttttcaaatacataaatgatcaattaaagtaattagatgatcaatgttaggacgtggttgcatggaaaatggactaacacctaattatagctgcttgtttgccacatggtgttaatggagagatttgtggtatcactttgagagttcgtgggaaacagcagcagaattcagtttaaccaacacctgctgtgtatgattcttttcttctagcatgaaaaaaaagatgactttgccccaagattattagggtatctctaggttttattatttattaataaaaagttaaacttttgactgagtaataatttttttcttaaattaggtgctttaaatgtatctccttgtcatctcgtagctataccctttctgaacctaaattttctattaacctttgaaaggagtaagagatttacatctaagaatcttagacccatagattttgaaatatgttccttagaaaatatgtacaaaaaaattaatgtggaataaatgggaaaaaataaaaattgctgttttttttttcttcaacttttattttaagttcaggggtacacatgtgcaggacgtgcagatttgttacataggtaaatgtgtgccatgccatggtggtttgctgcatagatcatcccatcacctaggtattaagccttagcactcattggctattcttcctgatgctctccctcccacctccaccccttgctgacaggccccactatgttttgttcctcatcatgtgcccgtatagtctcattattcagctcccacttataagtgagaacatgcattatttggttttctgttcttgcgttagtttgctgaggataatggcttccaactccatccatgtcctggcaaaggacatgatgtctgagagaacataatatgaaatataaccccagcacctagtacagtgtgcctagcatatggtaggtgctctgttagtatttgtttaaataatgaaagtagaaaatgaaagaaaaagcactttatttacatgctgtattcatttagggctgctgtaaccaagtaccacaaactaagcggctcaaaacaacagaactctctctcacacagttcttgaggacagaagtccaaaattaaggtgtcagcaggacaacactttctctcagggctctagggaggcatcttcctggcctcctccagcctctggtggtggcctaccatccttagtgcattttggcatcgctccatccctgtcttccttatcacctggctatcctccctcctgtgaatgtgtgtctgtctttcctgatagggacaatagttattgcatgtagggtccaccctcatccaggatgacctcatcctaacttgattaccccggcagaggccccatttccagatgaggtcacagtcacaggttcttggtggacatgagttttggagggacactattcatcccagcttgcctgctaatagtactctaattttcagttatattttagactttttctatgtagaataaaattatcagatggccagttaatacaagagaaccatttagtaaaatctgacagcaactacaacaaaagaatgacttgcctgccagtaccttcaagcctatgattttcaacactgtcatcaatattatttttactatttgagtttcccccagcatcattatttagccaacttttttttcctttctcatccactctttctctctctctccacacatcctccacgaactggaacttcagtaggactaaaactacaaccttctcttaatctgccgagacttttctcagatgggtgaaattatttggacccagcatattatcagcattcagtccttcaagttcccctggtggcctgtttgtcctttcttgtccccataaagctctgtgggtggtattgaagaacgtatgaagatgaataggtacagtggcaagaatcttttcttctaggttggaggagacatggttgcatagaaatatttaataatagtctgtgataaatactctaaaagtaggagttgaaaagagggtaagaaaagaaatcacctttatggttcaggaagacttcatggagtaggaggtgtcttggtgggactttgtttcctacaggaaggaaaaagattggtgaatttcaaagcacattgcaaagaccttccctgatctcctccaatttggatctgattagttttaacttgaagcttcatattgccgtattttaaaataaagtacctactttaccatgaggagagctgacattgtttgaatacttttatgtctaagtgctctatgggaattacctcatttagttcctgcaaccatgccaagatgcaggttttgtccttattatatttatcttacacatgaggaaactgagcttagcgaggctaggtgacttttcaccccaaggttagcaagtggcaggggtaggatttactatccaagctgtcttggctgctcccatctaatatgttttcctcttctgttatctcatttttatttttctctcttgcatttagcagtgtaccttacagatggtataggatcagaccatagtggaaaacagcttcatccacagccttagtgtggctcagtaatctcgtaggccaaactcacaatgataatcctaattttttttttttttttttttttttttgagacagagtgtcactctgttgcccaggctggagtgcagtggtgtgatctcggctcactgcaacctccacctcctaggttcaagcagttctctgcttcagcctaccgagtagctgggattacaggtgcccgccaccatgcccggctaagttttctatttttagtagagatggggtttcaccatgctggccaggctagtcttgaactccctgacctcgtgatccacccgccttggcctcccaaagtgctgggattacaggcgtgagccactgtgcctggccaataatgccaattttttatctaaatgctttccactgtacttctgccctcaggtttatgggttcatttgatcccattttttaaaataaagtatttatttttatattactgtgacgctcatggatctcaacccacctaatctcaaaggtaactgtagaaattgtttacctcttttcattcaggagtaaaaaatatgtttgattcctgcattccatgcattagcttataaacattttaggacataaataatatttctgacctattattttttacatacttacccgggcttttcttccaccatgaggccttttttatgatggattttcttgtcctctggaggaactgatactatagatgcgtttgggtcttttctgccttcctattaacttttattttaaggcattttattttatcatgtcttgtcaaacattttcttcctgtgttttgacatctcatcttttacaaggaagcctgtagaacaacagttgaaacctctttacttgcccattatcttttttgttttttctttcttttttttttttttttgagactgagtctcactcttgttgcccaggctggagtgcagtggcgcgatcttggctcactgcaagctccgcctcccgggttcacaccattctcctgcctcagcctcctgagtagctgggactacaggtgcccgccaccatgcccggttattttttttcacatttttagtagagacggggtttcaccgtgttagccaagatggtctccatctcctgaccttgtgatccccccacctcacccttccaaagcgctgggattacaggcgtgagccactgtgcccggccttgcccattatcttaaaaaaaaaaaaaaaaaaagatggaagagaacaaatatgtacagatttatttttcaagctaaatttttataatatcttctgaaccacctttttcagaaataatatacaataatattttagtggccatatgaatctaatacaatactctaaatgtcttcctctgtcttgagaattctgaaacatactgtggctgttcttcctgttttaaaaagctgcagaagccccttctctgaccttcaatacacaaaaatacacagactcataaaacacttaacatacacatacttattctagacatgcccaaatagccttattctagacatgcccagatagccttataatagacatccccagataaccttctttccacttttagctgaagtcgggaacagttatgtttttatgtatatttattggaattgattcaagcagaagtccgtattaccagtacatggtaaataggtcaatataacatatgtatataaattcttatttatattaaacatggttaaattttaatctcccatctgtttaaacatgggagattcaacatactcatttagctccctttcccttgaaatgccactaaattgatagcagagtttttattataaaaaggcaaacccacagaaataagaaaatgggagatgcttaacagctaccagttttggaaaatgagaatgcagacagacatttagtaaacttagcaaacctgaggaagctaaatcctaggctggcagtgggaattggagaagcaacctgattagtagctcagaatctccgtaaggcttggtaattgccaactgcaggaacctctggaagtggaggtgaagctaaacacagaagtggttgaaagtctgtttcagaagcagttagagctccttagctccctcagtgctagcccaagactggaggtttgttatttggcgaggatgaaacagagggcctctggactagggaaaacgcagaccttgctgagggtgagctgctgtcatgaaagcagaggagttgagtagtttaaattttggacagtccagcctttttcctcaactcacctcccagatcactagcagccaggtgcttgtcttcctgacaggagattggaagagcgttctgtgggggatgtgatcagcataagaaaataaacccaaaggtactgacttcagggaaccccagtccaactgcttggccacatgcctccacgagcaggatcacagtcaggaagcctcacccaggcatgcagcttttttgtgtcccacttttaaacaaaagcagaaaacgaagttttgctgttcatttgaagaagggagctaacgtgaaagacaagtggaagcaaatgaagaaagcagcttgtaagaaacagattatagtgtaaagaagagaatctaaaaaactatttttaatatcttcagagaaaaatagatactgcatccataaaacaagtatagaatgctataaaaaggaacactcaaaaacaacagagcttatgaatataacaaatattagtaatgaaaaacttaattgaaaatgacaattgaagaaattcccagaatgtcagttataaaagcaaagagatgtaaaataatacagaaaaatacaagaaaattagatgatagcctaggagttcccagactgtaataataagagtttcagaaaaagaaaatgggaatggagggagggtgtgggcggcaagccatccaggtgctgaggcaagagaccgaggacacgagctgttccagtataataaaatataaaacaagaatagttataccagatgtagatcttagatatgattatatatgaatatcattaatcattagtttgtagcaattactctatattccaatattataataatcctcgctctataatcataacctaggaaaaaccaggccatacagagataggagctgaggggacacagtgagaagtgaccagaagacaagagtgcgaaccttctgttatgcccggacagggccaccagagggctccttggtctagcggtaacgccagcatctgggaagacgcccgttgccaggcggaccgaggtctagcagtagcgtaagtgtcaagggaaaacaccggctacttagcagagggaaagggagtctccctttccccgggggagtttagagaagactctgctcctccaccttttgtggagggcctgacattagtcaggctcgcctgcagttatccggaggcctaaccgtctccctgtgatgctgtgcttcggtggtcatgctcctagtccgccttcatgttccatcctgtacacctggctctgccttctagatagcagtagtcaattagtgaaagtactaaaagtctctaataagcagaaataatggcgtaagctgtctctctgtctccctctctctctctgcctcagctgccaggcaggaaagggccccctgtccagttgacacgtgacccacatgaccttacctatcactggagatgactcacactctttaccctgccccttttgctttgtatccaataaataacagtgcagccagacattcggggccactactgggctccgcgcattggtagtagtggtcccctgggcccagctgtcttttcttttatctctttgtcttgtgtctttatttctgcactctctcgtcgccacacacggggagaaactcaccgaccctatggggctggaccctacaggaagggaagatgaagaagttgacaaatgaattgttgaagatgtctgagagctgaaagatttgggtaggagtttttaagattggaaggattcactaagtacccaaccctgtggataaaaatagatccaaacccagtactgaaatgtgaagtttcaatacatggagagagaaactcctacaagcttctagagagaaaacgcagattgcacataaagaaacagaatagcaacactggaagccagaagacggtgaagctgtgccttttgagcaaaaatattttccaacttagaattctaaaacagccaaatagttaaataagagggtagaatgatcagatattcaaagtttcaaaaattttatcttccatatagcctttcacaggagctactaaagggtgtgttcctgcagagcaagggaagaacctgagaaaaaagataggagaccaggaaacagggggcccagcatgggagaaaaccaccccagcaggtggagaagggaggctccaagacctgagctgtgcagcaggcccagaggtcaggccgcacaggcaggagcaggcccagaggtcaggctgcacaggcaggagaaggcccagagatcaggccgtacaggcaggagcaggcccagaggtccggccgcacaggcaggaacaggcccagaggtccggccgcacaggcaggagcagcagacagcaagatgaagctggtggaacacctactctactggaacatcacctgaggagattataccatttatagtggagcttaggattgaattaggtgggaaacaaagcaaattgagaaacaaggcaatgattagcttcaaggaaaacaaaagcatcatcctggaaagaaacaagaaatcataacagactgcatggctcagccatgaagaactttcacatagttcagcagtgccaactctgaaaagttctctatcctaaattaaaattaactagatagacaggatggaagagaaggaaggtaggggaagagggagaagcaggcagtaggagaaatgggggaatggaggggagggaaagtttctattgtgtacctttttgtatatatagttttgattttttttaaccattgagtgatttttttaaaccaaaaactttttaatgagaattattatttgtcatagagttttcaacaactaatttccataaaaatctgttctgttctctctttctctcttcagaaattaaaacacagagcacggggctgttcacctgacatcagacaaatagacctggatgtcaaccgcacatttcgggaccacattatgtttagagacagatatggtgttaagtgagtaaagtttaatattatgaaatgttaatcgcatttataaatagtctttattaacttaaaattagaatgcctttatagactgtaatttcgatttaggtcctaaaggtttaagcttttgcagatcatttgcgtccatgttgtgtgaaacttaagatctaatttaacttaaattttttaacctttgatatagcacgtgctataaaattggtaaagactcattttataatctggggattcttagaaatgtagtagatacttttattagaagtcatagaagaatgacagtgtgtgtaaaaactttgtcagtgatcaatgtatctctataaccttgacccccatgcataaatgaaactttttttaaaaaagggacatgaaatgagaaattaatgaattgatacatcattgctatgacaacttataaatgaaaagtacagttttgctgatctctgtatcagtcagagagtctaatcaggaaacagaaaccaataggagatatatgttaggacatttcaaggtattggcttctccagctgtcggggctgattaggcaaggccaaaatccacagggcaggccatgggaaaggacagtctgggcctcggggatgagctgaagctgctggccacaggcagagtttcttcttcagggaaacctcaaatctgcccttaaggcctttcaacagattgaatgaggcctgcccaggtcttctaggataatctctcctacttaaagttaacagattatggatttttatcagtctacaaaatacgttcccagtgacacctagatcagtgttttgtatatctggggattgttgtttagccaagttgacacccaaagccaaccactgcagtccagccttgtcaacttggcactcacacacaccaccttaaacaatttccaagtaagatagtaaccaagtcatccttccatctaacatgataccattattctgctcacagctgaaatgtgctaattctttccccacgtgaggatgccaagtctttgggagatgatcacacttctgctttagtatcctgtaacttacacactgtggtataaagctgactgttattaagataccttatgttagatgataaggtaaaagagagggaagaagaaaatatttgttggtatatatacaagcacatttacaaaaaaataaggaagaaatactcataataattgcagcaatcccttctgtgactggtcatgtggtcacaggtggtgtttataatgccacgtttcactgcccattccatattccctttgccctcagcaagcactcagatggttgtggttctttacctagagggataactcaaacctttcttcctgaaaatctgaacctagcagttctgcctgaattggtagttttccattgactttcatcacagggctcagtgatactagtaagagatgccccaagtgttctcctgcattccagatgtactcctccttgtgtctgttgtgtcatagcaacccatgttccccttagtaatcaggataatccccccagcccacacagccacgtccttctttgcctgttggttcagaggcataaggagcccaaagtggttgggtggcagtttcagcttccaggtcagtggaatcactgttatgtctcatggtggaagcattcctccttttggaactaagatctctcgaccagcagaacccaagcttgcagggccaagaagcaaacgctttgctagtggatctctagagagaatgatgagtggagccactcctacttgcagcctttgaatcttggatccttgaatcctggctatgggaaaaacagcaccttgaattggagcctgatatggagcatattcagcatcccaaggacatcaccctttccctgcagggtattgtaccttgctggcaatgtcactgagccttcaaaaggccattccaccattctgtcaagccagctgcttctatcagaagggtctcaaagtgagatagatcagcaaaagaaggcaacaaattttaggaattttgaagtgttttgtgttttcttggtataaatcctttcagaatgaatattatctagtcttgaatttagactttttagagtgttgtttgaatttgaacttgggataatttattacattagtaattttatctggattatctgttttcagtcagtctttggtttatttttttaagtttgtaatttttaaaatatgtgaaattactaaattgtatttaatgtaaatttttttctctaggcaacaatccttattccatgtgcttgctgcctattctatttataacacggtaagttggggcctgcctgcccaaggtctttgagttgtattctgaggtactccctacttagcagggccctgtgggcacatttctgcatctcagagctaggtggtctccatggtctctttagctctgtggatctttttaagctgaaaccctgtgataaccctagggccttagaacagagctgattctgaagtggaagaacctaaatatgaccacagtatgccagtgagtctcaccttttctctctccctccatattgttttgctttgtaatgttttgtgttgttttgtttttatttttaagcagatatacagggtagaaggacaggaagtgggtggcttggttaatttttgcttgactttttataactctctttgctcttgggaggttacttttcacaatcacatttatctattaggtgaggtccaaacaagataactatgcccttactggctatccccaggaggaggctaaactcttcggtaatagacatgctcttcttaaggcattcagcattgttgggggagaagataatctgggatagattaatttgtgttggacttaatgtgggtgttaaatgaatacttgttgactaggtcccagggaggacctttgaaccttgggatgtataatttctattgtagttaaaacctttaaattataagaacagaaattcgctcaaactaggaaaagttaaaaaggggtttttaaagggacatctcataggaaggaagcactagttgggcctcaccggaattggagctggaaggtgggaagcgtctggtgagaaggaaagctgcaccttccatctctcccattctgggggccactcagtatctcagatgatctctgtgaactgttcagttcactgtttctctctccagattgcttcctttgcctactggccagttatactgcggctcagattgcacccacagattcattgtgagcattctgttccagtacgtacccccatctgattacagtctctggctttgttcacatttcatagagacagtgtctgatgagtcagtgcaaccaaataactgttcccctggggtcagctgtcctcttctggtccattagctgtggttcctgtggcacaagcatgaatccttaaggccacatcataagcagggactatggggagagtgggtatttcttagagaggaggcatagactgtgcatgggcatcccaagatgtgtctgcttaagggttcagaaatctagaggagacaagacagcatactgggtattgtagaaggggagactttgccagcaactgagcaaagaagaggaatagtgagctaagaatcatacataaagtgaaataaatattatcactctttaaagaaagtgtgacagtattgaagaccgagtccaataaaaatatgtagcaatttagactttgtacctgtgcatttattttttagcacaattttattctcttatgtggcataatactgtaaagagtatagtatttgtctctagaatggaccattaaatgatgtgtgtaggcattttctggtttttatagagtagctttttctctgtacatatgcatgtaattcgactgaactccccagcttctgtgttcccctttgctccccaggaagtcgggtattgtcaggggatgagccagatcacagctttactcctcatgtatatgaacgaggaagatgccttctgggccctggtcaaactcttctcaggccctaaacatgccatgcatggtaagaaaaccctgtgctttatctaaacaatcaaggtagggaaaaaagtagattaaaacaaaaccaaagatgcttgcaagagttacatacagcaaatttaatgtctcagggctcgttgagttcattagtatttgttactagtttcttctttcatttttcattattgaacttttctaaaacatttacatttattttcctttgtctttactccaaggtatattgttggcactttaaaattcttccttacttgcccttggtcaaaagaaactaatttaggtttggaggaatttaagaacaggtatattattgggagaaataaaagatgccttttaatcaaaacttttagatggtcatgaaattatcattttagtgaaatgtttaccattgactggatattgtgatatataacaacttgtcaaaaaaacagtaattgagaaatgacacttaggtttttaaagaaaaggtaataattaagtagttttatatttcaagtgtagtttttgttttttcacataaaattggttccactttaaataaaaggttgataacgtgttctaggcactcgattatttaatatctcagaacctgctgattttttggttttcaagttaacactgtttataataactgtttccttgtttttgccaaattaagcaataaactttatttcagagagtttagattacaactgttgagacagggtcttgctctgtcacccaggctggagtgcagtggtgtgactcattgcagtcttgacctgggatcaagccatcctcccgcctcattagcctctctagtatccggaaccacacaggcatgtgcctccatgcctggctaattttttaaattttttgtagagatgaggtctccttatgttgagtaggctggtctcagtctcctggactcaagtgaacctcccgcctcagcctcccaaaatactgggattacaggtgtgagccacagcccccgcccttagatcacaacttgtcttggaaataaaagtggcatttgttcatataatgcaaaattattttcccagtgccatcaaatttaaatgattttaacactagttattctaagtgttaatatcaaatttaaaataattttaacactagttattctaagaatggatcttccaagttcagtttgtgaataagctttgtgtggtgaggaacctgctatatatttaaagtactgttttaatattttcaaaattatgactttctatagcccattgtttgtgaagtctcacactctgaccatgtgaggatattgtgtgtgtgtggaagagtgaggggggtatgtatgtgtttgcatttgtctttctcccttagtgtttcttgccaattacttaacaaatatcatctgcatggtaactgggtctgggcgctttgcatctagtaaataggctctaaaagtaagacatgttattatattgagttgccatccagtaggcagtatcattccaaaaggcatcttgaagaaagccgctcttccctgtcagtctttattttgctttcccgtgggattgtgttgctgatctgtcttgaggtacaatagaatgcaaatttaactggtatgtaattgtgtccaagactgtccaattttaggaagtggtcatttcttttaaacctatttgatagcttaccttcagcaattattgtcactagactaatctataaaacaatattaattctactatcctaactacttagaatgtagtttggctcattattaagggtcagtttatacttagagatgtttgtttctatgtctgcctatgaaattttataactaaaggttactttctagtgtgaaggtggtttcacttataaatgtgtggaattgaagctaaggatgaaaatataaaatatgagatctggaacatcagtggaaaatgaagaactgttaggcttcttagcattcttgagctagttattactgaactgtattgacttttcgaaaattagacttttcttgaaaatttttcaacttccattcctatcaaattgactatgaaagtggcactgatagatacggattttttttttttaatgaaacaatttcactgaaaaatattactaaaggagaaatagaatttctgtctctggaaatttttacacacaccctagaaaactgagaactagttaagaaataattctgcccagtagattgtaaagcaccattgcccaatagcatgtgcctcaggtttttggtggaatagagtttcattttggggcagcagactttctggggggaaaatggactccaagatcacataagtgtgggagactgagtgaaagaaaaacaagtttcattaagtctaaaaggcaagaacattaataagctaaaatgcctcatgaatatctaagaaggatgtaaatgtgtcctctggtttctttttcaaaagcatagaacgtctgttaacatctttcagagttgcatggaacccaggttggatcctaatgtagaagaatcatcaagtctgttgagtggactttctttttaatggattgtatagaatatcatgaagaaaaatagatgtaaagttcaatgagttaaatacacaaaattaatgctaaccatttgtaatttgttacttcttagatatagattatattgtatagtcacttgggataaaataccattttggatataacattgatcatctagtgcctgtatttttagcagatgttaaatacagctttttaggaaaggattaaaaagcgatttaaaactttgggaactttatactaatgaaattcttagagtaagcctgaaaaaagtaataaattgttatttaacatattaagagtaaaacaaaatgactagtcagggttggaataatatattacaaatatatgcatttaagatatggcccaatatcttaaaagaacagataatcttgataaatgtcttcagtgtccttttttttttttttttaaggtttccctttaaattcaaaaatacaaagttatagaagatctttagcaaacaaatcctaggctaaaagtttcattacccaaagcttatatacagttttttcctaggtggggagaaaaaatattttggtaactactgaatgtttctttttatttttgacagttacaaatgaaatatgttgtgttttaagattggagggttttgttggtattgtttatgaaatgttgtttttatgtttgtattctaggcttttttgtccaaggttttcctaaactcttgaggtttcaagaacatcatgaaaaaatactgaacaaatttctgtccaagcttaagcaacacttggtaggtagatgtgccactgacttacacccacctacccaccccccaaaaaaagctgggataattaaattgtctttggtccaattaccttattaatttatagtgtcatccatttcatttactatgcagttataattcccagttgtttacaaaccattagatttgtaaaatttaatattgacaggctatcacagttcttactgagggatttgaacttctttgaagctaatgatacaaacaatgtgataatttaaagatatgggatctcccagttgttttggaggttttttcattgtacaaaaaatattttttcagggtcacagaaactcgttgttagtgaactatatatatgccttactataaaacacagtagtttagtaaaacaaagaaagctcactgtaaaatatattaaagagaatctaattgttgtattacagtcctaagaggaatttattcttggagtgattttgagaagtaaatgtgtttagctttgatagctgcatccaacagccttcctaacttagtattattttgttaaatttagtttgctacaatccataaattgtgagctctttgttttttcaggattctcaagaaatctacacaagtttttacacaatgaaatggttttttcagtgtttccttgatcgtgtaagtatttatttacaaaactcagtcataaaattataaatacaaggtgaggggaagctgttaaccctatttttgttttgttttgcttttaattgtagactccctttacactaaacctcagaatatgggatatctacatctttgaaggagaacgagttcttactgctatgtcttacaccatcttaaaattacacaaaagtaagaaaatgcttaaactcttaaaatttcattaaaaattgaggcttatttaaccttgatttctcattccccacccacttcaacttcattgtcttttaatagtggtttaaattttttttgaaaatcagtggagaaattatcatcaattggtaatgtacttttgtaagttctttctcatgactagaagcttacttcactgcaaaggtctttggttcttttctgtttatattagtgtcattttcacacttttatagaatgcagttagttggtttcactagtaatatttttcgttaagtatttgtttccactgggatcccttgtccttttcatcagtctgaatctcaagtttgcagtaagagaaggaagaccaaagaaaccaggccccttagttcaaaaggctggagagaacgttttctattactgtttccttcatccagggagaatagcacccagctgaactgtggttgggagcacacagacccacttctctacctcagtgcattatggcctctggggcaagttcagccagtgtctataggcagataaatggagcaagattaaaaaaaaaaaaaaactggagaatttttagtcttcagttgcaatatatttaagggctctataaatttgatatgttatgccttactttaaaataaagaaatgagattttttttcatgaagaaccttgttcatctttaaagtttcaattcagccttaaaaattctgtgacttctcttgtagctatgcagaaaagaaaatcattgaaagctctagagcttcatacgtacacgtacttctaatccaggtcataccacatagtttcatgttcattgtgcactcaactctcttaggttattcttgaatgatctgttgcgcttcccaactaaattataaactaattgagtgcacagggtcttgtttatagtttttctctctgctgtgcttggcattgttctaagtacatgttacggactttactataagattggttggttgcttacttgaaaagcatggactgcaggagtgccagattatccatactttagataggaatgaaaatgccctttaaaagcacttttgttatgtttagttttttcaagaaaaggactcagaattgttgtggttcacttcccttatactcagttcttctttccccaactaatgcaccagaacaaaacaattgactatgtgtcttccaggattcaagtctgtcatctgatctcgtgaaatctcttttccttcctccccgcaccggccccccaacactgccttttgcctccccaccccccacctctctccctccctccctacccctctcccccagtccctccccctctccccctccccctctccctccccttctccccccctctccccctcccccctccccctctctccctctcttcctctctccctgcctctctccctccctccctccctctctctctccctctctctcttctcctctccctctctccctctctccctcccctccccccccactttctttctggattgttaagggatcaaaatagagaacagaagtacagtttttattaagagacattagcttaatgttccctcaagaatgaggaagtagaaacatacttctttgtagctctcatctgcttcttaaattgttctacttatatgacccttgattaattttgacaagtaaaaagtttctttacccttgtaaataaatgttaagcatagcaactgctttacatgctaccgtatcattagactaaatgagctgtggacaaatctgctgctgtgtatttttcttggttagagacttacgtgaagttccgtctccaccatataaagcttccgaaatggaagggtggctgcgggatgggaggagatgctggttcaagtttcagttagacagtaggagtaagctctggagagctgtcatacagcatggtgactataatttataataatgtacagtatacttgaaaattgctgagagtacatcttaaatgttctcactatggacagataagtatgtgaggtaatgatgtgtcaattagcttgacttagtcattccacagtgtatacatatatcaaaacattgtctaccacagatatatacaatttgtcattagccaattaaaaaaaagaaaaactctttctgggcatattaaccaatagttagctaaagctcataagaaattttttcctttttcttttttttcttactgattgtcttaaaaatacgttgttactggaggttcatcacacagtggttttaaataataaaaaatcaaaaaccacctaaatgaccattaatagaagactgtttaagtaaattacaatgcttacatatagtacacatcatatttgttgaaatgagagatatcagtgatacattagtgaatggggaaaaaagcaaaaaggggaataacttgaaaagtataatttggattcttcaattgatatacataaacacttgtaaatacctggatctacctgtagggtgttatgtaatgaggtgtattatgtagggtattatgtaatgagcagatttttactttctgctttgtgttcatatttaatttgaatgtctttttccaagaaaatgaatttcataaatagaaataaaactcacaaaattaataatccagatgttctgggaaattctgaaacagtaagaaatacagacttaaaatggggcttcttggagctccgtatcaataaaagagaaaggcctcatgccggctgaggtagtctttctgtgtctgtctctaagaagctcttgctctggggtaatactaatgcctaggtgtggttattccaatgaggaagtattaggcagtattctcctcccatcctttctcccagtaaactttcctgcttttctctgtggctgctttaatatcaggcaatatttttgtcttactgagttttaatgatgtcctcaatgccatatgtaagttgtatgctgcttgcgccctttttaatgcccttttacactacacctgaatataatagaatatcttcctacctaaagtagctattgacttggcattttcatttctcttatcctttcttagaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaagaattaccccaatactttatatctacgttataattaagattggaagacatggcataattaacatgggctgtttcttgcccacagcgtaagcattatacttgtgatgacataatgtggatgaatgccttaccagctcagctgctttggctttttccttattttagggaaaggcaaataaacatattaattaaatctgcctctcctaatagatgactgtactattcctgcttacatttagaagtttggttggcaaatactgttgttcaacagaagtagccatggtgctttaaacgagcataacaataagcttttttttgctttcttcatctcattttgtgaaaccgtatacaatagtaagtacagcaatagtaagtacagtaaaagccccatcttatagatgaggaaattgatactttagtgcctaagtggcttaaatatgaagccacagaaccacaaatagcattactgagactgcaggccagtttttctgactactagcccagggctctttgtagtatgctacagtatagataatatattttattcacttattgtaagacatttttcagcacctactaataggttttctgctaggtactactttgctggggatttaagaactgaagagaaagatgagaagctctcagggtgtgcactggagagctagaatatacgagaatgataacagagggtgaatggggcattactagagctagccgcagggtaaatgggagaggagcagaagaaggggagtgcaggaagggagggaagaaaatgaaaatgtcgaaagatcacaggaggaataactttcaaagtttctaccagatagtacttgaccatgtatgtcttgagaaaaagttactttcgcttttcttctttcttacctttgttgcagtggatgggtgtagtaagaggctagggaagtggaaggtcatgggcaagagatgaaaagtaaagaaagtcagttatgtatgccctcatgcagaggtgaatttggcgtttccccatcagtgtgtcatgttggctgtgtctgtacagaaggacaagcagtacttccatggaaaatacatttttccttttggtaaaaaccaagatgtttgcttttatttacttaattgagaagggtctaatcagcactgctccaaggtttgctcaaggtcatccaggctcctaggaagcaaccctcacagcagtaatggggtgtgggccttggccttgtggagccgttgcctttgttaagtgaggtcagccctctcctgttcagtgtaatgacttctgttttctactatcatttatttttatttattttattctactatcatttatttttaaataccttgcctccttctataaaaagaggtcaaggcaaattttagtaaaagtcaaatatagaggaaaaaatatagaactatttaaacgtgagataattcaaaacctgtgtcatggattgcgatggtggtgacttagcatctaattagcagctaatatttattgggtgtttactgtgtgccacgtaccacaggtgctgtctcatttaatctctaaaaataactcataaaagtgctcatctacattgtgcagatagggaaacctagtagcagtagtctgtaagatcgttttaccaggaaatgatagaatggggacagagaatggggcaggggagaaaaggggaggaataaatgatagcagaatcatgctctgatcatactggcagtgaaggtagaatggattaggcatctctgcgttttctagcacgaccatctgcctttcatcgcctgcctgtcattctttttaaattgttgtgaactgtatatggaacactaagataattaaatgaacctcataccaagaaaattccatgtcacatctgtccttttaaaaacctccatgaggctgggcacagtggctcacccctgtaatcccagcacttcaggaggccgaggagggcagatcacgaggtcaggagaccgagaccatcctggctaacacggtgaaaccccgtttctactaaaaatacaacaaattagtcgggcatagtggcaggcccctgtagtcccagttactcgggaagttgaggcaggagaatggcatgaacccgggaggtggagctttcagtgagctgagatcgcgtcactgcgctccaacctgggcgacaaagtgagactccgactcaaaaaaaaaaaaccaaaaaaaaaaaaaacacctacatgaacatgccacttccttttgactccttacataatgtggcagtgtgaactcccccgagtcatgtgcaatgaggcctgttttcctaggcccacatgaaaacatggtgctgttacattttaaaatgtttactgattggatagagtcttccattgttgttctgattggtagttctttgagtatctttcttagatatctttggggcacccttctttctttttctgtgaacttccctgttcatctgttgcccatttttctattggtctgttcatacaggttcttgttaaggaggctagccagtttattatgtgttgcagacaccttccatacagctttccctatggcttcttgcttttgtgttttttgtaaagaattttccacatgctggatgaagtgttttttcttaagtacccatatttctcttctaacatttatatgttttcagtgcttatgggtacaacttcattgagatataattgagtatgatgaaatcttcagctcatctagaatttactttttgttatggaataagaactcagctctgcttattttccaaaccattagtcatgtggattagtggcatttattacattacattttggcactctattctgttccattgctctctgcttttccagttacactttttaaacatgagacagggtctcactctgttgcctaggctggagtgtgatggctcaatcatggctcagtgcagccttgacctccccggctcaagtgatcctcccacctcagtctcaccaggtagctgggactacaggtgcatgccaccactcctgggtaattttagtattttttgtagaggcagggttctgccatgttgcccaggctggtctcagactcctggactcaagcaatctgcccacctcagcctcccaaagtgctaggataacaggagtatccggcctccagttacactttgcatatctattagggcaaatgtcccctcattattttatattattttgtcaagttacaaaaaagaatccactagtattttagtggtattcagatacagtattttattaatattgagattgcactgacattaaggatttttgagagaaaattgatattttaaaaattgagtttttctaagtaaaagcttttattttacagtcgttgaggtttgttttcttcatgtgactgtgaagacatttctggtctcacattccatcccccactcgtgtaccatatgaaacgtggctgtcagcaggtggtcactggacaaccacaggtgtgctacagaactgccatttctccacagcctcaggtgtgtggacgtcgctgctgccactggcgttggagcctaagcaggggctctgcagaggagacccaaacagagtcaaagcaggggtgccacgtcctatgggggatagttgtatcttttattgctattgcaagttgaagattttcttccatttctttctaactggttaggaaaactcttggtatccttttaataatatttttgtagccaatatatttgatcagttatcttaggttttctaagatttaagatacaaaatcttatcttcaacaaataatagttcttcctcttccttttcagtattcatgcatcctatctgttttttagaaaatagctagaaagtattcatctattactgtttttaagttttcttgaaaaatcaaagtgcttgctcagtttttttgagtgccttttgaacacaaataatcatttttttccctttaaaaccttttcacattaataattttgttaatgtacctcctagtggtgaatgattcattgcaattcttggataaactttacttggttgttataaattattcctttatagtactgctgatttatactgtctaacattttacttaacattttgaatggttattcctgagatttcattgcagttaaccaaaacgtctgtgtgttgtcaggttatactgtcctcataatttggaagccttccttctttctctgtgttctggaacttttacatagtattaaaattattccttaacagctcgaaaatatatttgtgaaactatttccgtctgatataattgttttgggggttaatgttttgatttatcttctaaggtcaatgtgggtcatttggtcatttatattttcctagaaagctattcatttctagtttcttaatatatttatgtaaggttttgcaaagcaatctcttacggttctttttatatctgtaacaatcctacattttcatttctcactttctttgtaccttctcctgctctttgataaaattatccagaatttagtctttattaattggcttgtatcaagaatcagctcttgaattagttaattctgattttcttagtttatttcttcttttttccataaagtcgaattcttggctgggtacagtggctcacgcctgtaatcccaacactttggaaggccaaggcgggcagatcacttgaggttaggagctcaagaccaggctggccaacgtgatgaaaccctgtctctactaaaaataaaaaaatcagcggggcgtggtggcaggtgcctgtaatcccaactactcgggaggctgaggcaggaggattgcttgaacctgggaggcggaggttgcagtgagtcaagatcgcaccactgcacttcagcctgggtgacagagcaagactccgtcttgaaaaaataataataataaaaaaagtcaaatgcttgatttatttatttcatagtatgggggtggtttgtaaaagtgttgaaaggcatgtcttcttttgctgtattcatgtctatgtttttttgacatgtagttttttatcattgttataatctacatacactgtctaccatttaaatttttggttttcattgactagatttgtgtgaagaggagttttgtgggggtttttgtgtgtgggtttggcatcttttattttacttatgaaaactatcaaaaatacagagaaatatgatgtaaaaattaaaaatgatcacccatatgcccacctcatagatttaactattgttagcatttttgtacctttattttatttctgtatgttttgtagttgctgttgaaacattttttgaaacttttttattgtgaaacttttcaaacatattcagaagtaaggaaatgtataatgacttcctcccaggtacccattgcccagcttatttgaacaattttaaagtgaaaataaggacatcaggatacttcacctcaaatacttgtctctgtagccaagaaacaaggaccttcccccagccaaccacaatgccattgctacactaacaagtgtaacagtgtgactacagtgtgactcctcagcatcatctcaggccagctccatgtgggaagatttccagttgtcccttaggctgcctgttaagctgtttttctcaccagcacttagtcagggctacattttgtatttgttatgggcttaagtcgcttgacagggagcagtacacctttcctcttcccccctcttcaccccaccttttgttttcctctgaatgacactgagctgctgaagagcacagtcccactattctgtggaatgtcgcacactcaggagttgtctggtttttctttcctggtgttctgtgtagtttcagcaaactagaagctagatgtagcagtttaataagatttagattagacaggagtcccacagtgactactgttttcttaatactggagatgctgagtttgctgacgataatcatatctttttgttttaaaataaaagtttttttaattaaaaaaaaatcttttcagttagcagataatctgtggatgatgtcttgacactgtatggagatgtccagtttccctttaacgctctccctcatgcttttggcttccattgataatccttgcctatatcaaatttcttcagaggttgcaaaatagtgattttcaaattcagtgatttcttttacttttttttttttttttttttttttgcgacagagttttgctcttgtttcccaggctggagtgcaatggcacgatctcggctcactgcaacctttgcctcccaggttcaagtgattctcctgcctcagcctcccaaatagctgggattataggcatatgccaccacgcccggctaattttgtaattttttttagtagagatggggtttctccatgttggtcagactggtctcgaactcctgaccctcaggtgatccctaagtgctgggattacaggcgtgagccaccgcacccagcctcttttacatttttttttttttttggcaaactttcttctgtagcaaagagtttttcctcccttatcaagagagttaccttaaatgtaactctttggttaccttaaaatgtagttagtactgaaaaggcagagtaaatgcttcctagttttctgtttactggttttcccccatgctgtcttctattcagatgaagccatttggcagcacttttgtcaattaacggaagtcattctggttagaaagcctatgttaatccactatgactgccaatttagccagatttatagtttatgacctagatagaagaatcaaagatttttctcagaatagttgacagagccattttagtcttggtaaatggccatagccttcggggtacttcagtgcttacgggagaacatccacactccttagtgtaaggtatagcacttttctgtccgcagcttccacacttcacatcccacctccccggccgcttttgagtcacatagtagtaatgataacagcaaactgagtcttctatgatagattttttgctaaatgctttgaattcacatattaacttaattttttccagcagccctttgcagtagtcatttgttgatgcaagttttttttaaaaaaaatcattaattcaaggacaaattttctatgcacaggattatttagattttaaaaattagtatttattaaactcacaaatttagaaacgtatttcttccttacatttaattcagtttacaaaagttagtatagtattttaaaatctggcaaattttaacattctcgtctaatggaactttaatgtttggttccacttataaacataaattcctacaaacgtttttaattgcctttataaatgtaatatccagtttcctttcaatgtatcaaatttcaatttaaataaaatgtgtcctagttctaaaaaacttacaaatctaattaattcaaccttaagaatatcctgaaccttaagtcttttgtttcagtatactctttataagtttaaaatctaaagttcaaatcagtgactcatttgcatatttttaaattggcataagaaggccaacttggccaaattctctgaaatataaatatataaaacacagaaaattctaaatacaaacagattccttaatgcaaaaaactacagaattaatcacctttgattctcttaaactttgccatttagttctggatcttcaggaattaagacttttttcccaggtaaacttggggtgtactttctcagtcagctgaagcatgagctggaactccaggtgagttccatcgggtggcaccgcctttattatctcgaaggtggtgcctgcgagatggctttgtcacatagtctggattccttagaccctcgtcgcccaccacctcattcttccttctcctcagggtctgcccctttccacccagaagatcttgactttttacctttagaaatctttgaacctgatggaatcctctgttcttttcatttgttcctaatttggtagggcaataatttgtaattaactgacatttattttaattttgaatagttttcatggggagtttgcgatcagtattattattagtagcttaccaaggaggaaacttgggcttcaaggttaagtacctgcccgaggtcagacagttggtaatgagagttctgtcagttgactccagagctgtgcattacacccacctggccctgcgccttgcagctcacagctctaatcggcctgctctttcaaggcactttgccttggaatacgctcctcctccaagaatgctcccgaccattccccagatgcctctgtcctcatcctttctgccaagtttcacgacttggtttaagcatcgcctgaagccttctcagccggtgcctggcctccccaaacccacagaacttgatcacctgcacctgtgttttgtgcctgacccgtccactacacatgcttttgtcctcacacttccagtgcctctgtcagtcatgtctctattagacagaaagttccctgggacagtaaccggctcctgcctcaccagcacctaatacactgcggggctgtggctgtggctgtatttgttacttttattgaataaatgaaatcctaatgtattttttagataataaaaaaactactgtttataaaaggttagcctgaggcagtttttgggggtagtgaaaccattctctagcttgactgcacatacatagaaacgaagccattttattgtatgtcagtttagaaattgccccactttttgaggattggagtgggttttcacttttatttattcatataatgtaaaatgatgttacatttaaccatttttacatgtgtataaaaattgaaactctaggagacaaagtgtaggtttttaaagttacttaacaaagacctcttgaatttatgtggcattaaataggtttatagtgagagatgtgtttacataatagtctctttttcctttaactttcaagtttaatctgctgggaaaaaaagtcaagcctatgaacccaactataaaaattttttgaactttaaaaaaattatagccatactttagaaagcaaattctatttcttttcatcatgttattgaaagctacaagtgtttgaattgtatattttggctaatattacattaaatataaagtcatttgatttttcagatagtatatttgaagtcagcaatatttaaaaatacaattggacttactgtttgatctggaaggggataactctttcctagaatagtagaattattttcctgatagtggccccccaccgattcttcccgaaaactgttagaacagtcagagtgtgtgtattcttctattgaaagtgtaaaggtagaatgctgctcacagagcgagcacttagagcgctttgctgcaatgatgcgcctcttgtcaggtgcaaaaacctgctaaggcctcagaggccgttgatgggcgaggcttgtagttgagtgtggcgtccactggggggtgacagagaccagagtaagatcaagcagggacaagcctgaagggcctgagagggactcttccttgctttttagggactgttagaatattattttgttggcttcttttttaagaaaaaaagttacttaagaagaaaataataaacatttttgcttttttctaaaatgtatcaagttacattcctttttgttgaagcgattattctaattgttagcactgccgtaaaaataccacttaggcaaacaccaatgagaaatataaaaaatgtggtattttcacaaaagcatcccctactgtatctgtgaggagttgtggtgcctccttaccctttaaggagtagggcagtaagtctttttttttttttttaagttttagggtacatgtgcacaatgtgcaggtttgttacatatgtatacatgtgccatgttggtgtgctgcacccattaactcgtcatttacattaggtatatctcctaataatgctgtccccccctccccccaccccacaacaggcctcggtgtgtgatgttcccctccctgtgtccaagtgttttcattgttcagttcccacctgtgagtgagaacatgcagtatttggtattttgtccttgcaatagtttgctgagaatgatggtttccagcttcatccatgtccctacaaaggacatgaactcattattttttatggctgcatagtattccgtggtgtatatgtgccacattttcttaatccagtctatcattgttggacatttgggttagttccaagtctttgctattgtgaatagtgccacagtaaacatacgtgtgcatgtgtctttatagcagcatgatttataatcctttgggtatatatccagtaatgggatggctgggtcaaatggtatttctaattctagatccttgaggaatcgccacactgacttccacaatggttgaactagtttacagccccaccaacagtgtaaaagtgttcctatttctccacatcctctccagcacctgttgtttcctgacttttgaatgattgccattctaactggtgtgagatggtatctcatagtggttggcagtaagtctttattccaattcctatgtgggtgttttttgttgttggtggtgttttttttgtttgtttgtttgtttttgagacaagagtctcactctgtcgcccaggctggagtgcagtggcgttctcggctcactgcaagctccgcctcctgggttcacgccattcttctgcctcagcctctcaagtagctgggactacaggtgcctgccaccacgcccagctaattttttgtgtttttagtagagactgggtttcaccatgttggccgggatggtctccatctcctgacctcgtgatccgcccacctcggcctcccaaagtgctgggattacaggcgtgagccaccacgccaggcctccaattcctgtgtttttagggagaggaaagggaaaataaaattttaggcatgagactgtagtggagtgagcaaaaacatgattctgtctattgaaaagaagcccagaatgcaagcgtggataataaataggaatgcttattgcctatatatagttttctgttttgacatcaattatgtgtgaatgttttagttacagttagttgcttaggggtgaaaggagatatttaaaccaaagacaagtagagcagtgtttgtgtggtggggttaggggtggtagttcaagcaggctgagatagctctgaaaatagatcacaccaaaatgttgaatgctttatttggacctacttctgtgaagaagggtagagaatactaattggcatataaaaatgttactggtgatggcattcgtccttcttacagggtctgcatgatgtgttttcagttcagtggaggttgaataattaatctctagaaaggaaccgcctctgtaatgaagtcaaggagattttcctcttcatcatagtagaggccagatcctggcatggcgtccttgggttccgtattgctggtggagccgaggcctctgtccctacagaggctgtgaaaagccagcgagtccccgcgggccctccatgaggttccctgcggctgcctccatcctccaccttctccatcctcatgccctctgcgctgctggctgcttctctggtcctctccattacttgccttccgtgacctccccgccacgtcttccttcttcctcacctctccttcactgtctccgccccttcttgcttctcctcctcatgagaggcacagcgttactacctccacagcgctgccccgggggcctgagggcctccctggaaacgtaagctgtatatacactgctcattgtggaatttctgagaatattacactattcagaggtgttaggcagctgtgggagaaatgtgtagatggcataatcgcagcgttagcatcagcaaatgttcatgggagatggacgttggtgcaggtatcatgagcgtgcacgggctatacttgttagtatttagcctgctccctggccatggatcactctagaaagcaggagtgagctggcactgtttaaagtgaagcaaaccccagccctgtagtctgatctgggcacttgggaatgcccatcccccactgtgcggggcctccagcctcacttggtttattgtctttaaaatgtggaggaatgggtttttcagcacctgtatttgaaaggctttcttatatccctgtctcctgccttttgcatccttattgaaaatctctgcagagcaaagaggccataacctctaaatgtttttctacagttgaggtatttgccatattcctcttaaacagtagttcctaaagagaggttatcatttaggaatggattagaggcagcgtcattttgtctgtactggatttcttcccccccgaaccctgctacatctaatttcttagcaatatggatcttggatatttataaccctcaggtttctgcctgtgtatatggacagtgtgtcattactctaactcatatgaatagttgagtgaacgaacattgtcaacaccttccttgtgattgtattatgcttttagatactatgggaaggaatacaaaagaagtaagtaggttatagcctactagggggagggaaaagatattaggggctgccatgaaagaactttaagatgctgctttttggacattgcagaacagccacagattgtttttccccagtgtgcattttggcctcttgtccattcaataaatggaacgtgttaaacttttcctttaattctaatatgatgcatagatgtgtgatgtgtagactattaggccctcttccttagagagagacatttctgtgtttactggaatataaagtagaattaattataaggtaaatatttttcttactccttatattaaaaaattaaatctcctacgtatgtatgacacatacctttgcattttgttttgtgcctgaaattaccacctcagtccttccattacttctcaattggttttttctttctcctaagaaacacatgccttatattggtaattctacattttactatgtgtccagctcagtctttactgatatgtgcctcctctgtggctaaaggattccagaatgaaaatctgtgaatatcacaacataggaatagaccatgccatggcaacattttcctcaaaggtgttccgcatttttcccacacctcctcccctccactcccacgctacagtttattgtttcctgcaccacactggtgttttatgaaaccatcttgctgctgtccttgacctctcttccctaccctgtccttgtaactaacgccagccaagggcctctgtgtatttgaatgagaactaggggaaggacaggaccactcctctgagtgaggggtgtaggcagtagtccagtagtgtttcgcttccatgttttcagtgaaaaagaggttttagaatgagaacatttgaataaatattgataggaggaacttgaagccaagtgcggccaagctgtgactaagagaccctggaacataccattcgactgagtgaactgtgattgacagtcatctgggaaaggatgtggagccaagcaggtgtttgaagggcagcgataagaaaaatgtagttccactttttacagaggattaaagttgaataatgtaaatcacagacaagtaaacatgatgcctgtctgaggcaagaatcaataaatggattaattaaaaatggatttttgatcactcagaaagcaaagaaggtgatcactcatcatgactccatcaagcgatgccatacttgattaatctgactttgttttttggtaagattgctcatttaatgaattggaagaatgccatcaacaaaagtaaagtgtctggcaaagtcttaaaatacttttttggataagctaaaaatattttttacaagtcatacaccaaaactgcagatttatgtcatcctacctgtagaacagtattctgtgcttttaaacttcatacttctctgttactcagattaatacatgtttacagcagaaaaaatatgtagtacttaaggaaaaataatcattcaatctaagagcatttaaaaactatattaatgactactagcgtttatttctttcagtcatttttgtagacatatgtattgatttatgcctgtatgtcattcatagtaaatgagattatactacacatattgtctataactttctttttaactagttagtgttaaaaatacattaatatggcagtaggctgctacaagtttctataccttatttcaccatatttttgtttcataattgttactgaatttcacaaatcctctatgctgaggatataagttttctaaaagaatgcagttttgaacatccttatagcaaatattttgcatatcccttaattgtcttaggataaattctcagaggtggaattcctagatcaaacatttcaatatgcattgtcaaattggagaatttgtttctccaagcccacagtagtgagatataccaatttagaagtattttaatttgcatttttctgataacttgtgatatatttacctgctcttttcttctttgagtttcctgttcatattctttatttaatttttctatatagggcatcctccatttcctttgagagttctttaccttttagagaagttagggtgctccatttttgttcttactcagttcagtacttgttaccagtcacttggatgaaagcattggtagcgtggtgttcagatttgtggatggcgtcacatggggaggtataattaatgtaaaattccagggagatcccagattgaaatgatgagtctaagtaagataaattgagataggaatcaatgtaaagcactttgaacctgtctaaaaacagctaccctcatgagctccttaatgaactttcggtcaacagtggactgcatatagaatgctggccctgtgagccgaaaatagcgtattttcactgtcccatttctatctttagattcacaaatacctaccactgtgttccagtgaccctgcagtattgagtacagtaacatgctgtatgtgtttgtagctgaggagtagtaggctgtatcatagagcctcggtgtgcagtaggctgtgccatctaggtttgtattagtgcactctgatgttcacacggtgatgaaattgcctgacaacttatttctcagaacatatgcctgtcattaagtgatgcatgactgtatagagtaatagcaactaccagttcctaagcatcttctatatgtcgggaaatatgctaggtttttctttatatattaactcttatcctcatagcggatctataaaatagatattgccgttttcatttatggatgagaattctgagactcccaagttcacacagcttattgtggcagattcaaattcaggtcacttgttcctgttgaccctgctgttcccactgtgccttggagacacacagcttaacaacatttgggaaacattgtctctaaagggagggcagtacagtgtgaccgccagatagctgatacactctccactacagtgttcaggatgagggaagtaatcgcccatcttagttcaaacctagaatattgcttaaattctgggttaccacacttaaaaggggtatgattttacttgattatcatcaataaatagtgatagctgagtgtctagggaaaacactttggaagccgaacccatgttaaccattctcaggaataaattggtgaccacaagacatagaaaattgcatacagaaatctgcaaagtattggaactctaaatgcccctatagggttgttactgcctgtgtctaccttccacatttgctttgcccagttgtttttttgatggggttgtataaaatacattttattataatcactgtagtttgtttcattacattgttgacactgaaaatgtgctaggaccatacaagcaaattatcacaaataatgaagtaggtgactttttgctaacagaaaaaggcagtccctaaaatttatttaaaacaatccagttttgagattggggatatagagctaagggtagctgcccttagaaacgcctcatgtcaggtgaattgagttttcattaattgagaattgagaattgatgcagactgaaacatggaactcagaatctgggcacctccaggcagcactgagagcagcttgggtgcttccgctgccagtacggtgtggggagagcacgtacaggcacagcagcagtagcagcagcagcagcagcagaccagctggaaatctattccttttttggttttgtttgttttttaaatactgctatggagaatcttaaaagacattttaaattatttcatgtgagctaaaaagttggtggctctctgcaggccagtgagtggtggagaagtgaggcagcttccagggctcagtgtgacagtctctgcagcgaatccagttttgcccctgtgacagtgcatcttcaggcatgcattcaccactctgggcgtcacagttttccttttctttaatggttatgtttttcatcaggtttcttcttgctaacctgaaaaggatgttttgatgattggctgatattgctgtctgatggaatatcagccagccactgaattagccaatcagattactgggttctgcccttagaaaactgtcagacagtgaggactaaaggaaagtttataaattcagtctttctattattcatgtctttatatcttcttgataaattgtgtttgttgggattatttgcctacagggaagaaggcattcatatatttatctgggactaaatggatgactacctatttgtagagctgatagaaaaaaacttttggaggaatctggataggttttaattttatttttattgctactttttaacctgatgtgctgaataactacttgaagtattcttgacttgctagtatttaaagtctactttctccattcctggcatttcaaggttatttcacatacacattcataaaacaaagaaaacttttctgaattacaagcattttaaagtttgggttgccaattgaaataattggtccacatattataaaatatatttcttaccaaaaggtataagaacaacgtgggttctgccagctgttccagaataggatttgcctgtggctgtctcaggccaggagttatgctatgcgctgcttgctctttcacagttcacatctaacacattgagcaggtgtgcagatactgccttaacaattacccaggaagcaacttcttctcactgcctccacggtggtatagtggaggaggaggatcaaaggctctggaatcagcttagggtttgaattctggacctgtgacttgctagtggtgagcctttgggcaggttagtttctgcctccattttccatcaaaatgtgggaaaatagtagagccctgcactgtctgcctatcgcaggccttacaggtacagctttctgagcagtggccagcgcgcagtgactgcctagtgagtaccagccattagtgtcacatcattcagtagtaccacaatcgaaatcccggccaccattaaagttatttttctaagatagacatgaggtcgtgtaattcttctgctgaaaagcctctagtattttatagttaacttggaataaaatccagattccttgccgcactcttcaaggctgcatgtgtgcctgcctgtccccgactcaaggcccatgctcagaggaccgcctccttgctggcactctcctgctctgtacatttggcctaattgtgagtgttggtatgttttagtatcagtctctaaaaaacacctctcatcagctaccaactttctgtggtataaacagtgtgtgtaagtggtataaacagtgtgttgtatgacagtgtgttgtatgtcagcgtgtatctgtgcacagatgaaaagcatgccattgttactaatggattgcttcaactggctactgtttactcgtgtattatcttacttagcctttctctttcttttcaggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcctagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtaataagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatatatatatatgcaaaaaatatatatatacacacaagcactattttcttatgtcatttatgacattttttatctgtatacttttttgatgtgattgttttttaacatgctaaaagtaataagtatattttgtgtcttttatgtgcatttttttcatacggcaaaaatggtgcaccccctgatgctttgaaggcta

SEQ ID NO: 13882 - DNA, 42610 bp, Human
tggtagttttgtttttgttttaaagatggggattttgctatgttacccaggctagactcaaacttctgggctcaagtgatccgcctgcctcagcctcccaagtagctgggactataggtgcatcccattgtgcctggctaccatggtaggttttttttttttttttttttgaggcggagtcttgctctgtcacccaggctggagtgcagtggcacaatttcagctcactgcaagctctgcctcccagtttcacgccattatcctgcctcagcctcctgagtagctgggactacaggcacccgccaccacgcccagctaattttttgtatttttagtagagatggggtttcaccgtgttagccaggatggtctcgatctcctgacctcatgatccgcccacctcggcctcccaaagtgctgggattacaggcttgagccactgcgcccggcctaccatggtagttttaatttgtgtttcattacgagtgtggttagcttccttccaaatgctgtgggttggttgtgggttgcttttttttttgagacagagcttcactctgtcaccgaggctggtttacaggcatgatcttggctcactgcaatctctgcctcctgagttcaagcgattctcgtgccccagcctcccaagtagctgggattataagcatgcacctccacacctggctagtttttgtattttttaatagaaatggggtttcaccatgttgctcaggctggtctcgaactcctggcctcatgtgatctgcctgactcagcctacctaagtgccaagattacaggcgtgagccaccatgcctggcccttccaaatgtttaacagtcatttagattgccttttctatgaactttctcttcctagtcttctcccatttttctattgggctattggtcttcttttttatttgtgggagctctttacatatgaaggagattagctccttgtgatatgaatcacaaatgttcccctaatctgtcacgtgtcttttgattgtgcttttggtaatttttaccatgtatattttgttttttcatgtaactgaacttatcagtctcttctttatggcttttgggttttgtgtcaggataaaaaggccatattcactacagcatcatatgagaattctcccatagtttcttgctctctttggaaataatcctggtataagttgtgaatccagcttgcttgctgtcttgtggatgctgcctttctaaacagaatactagcagcctaagagttaagactcaaatgcacatctttcctgtccccttcaggacagtggttactctgggttgcatctgtccatgggcccgtgaaatggatctctctctctctctcttttttttttttttggcagagcctcactctgttgcccaggctggagtacagtggtgcaatcccatctcactgcaacctctgcctcccgagttcaagtgattctcatgcctcagcctcgcgagtagctgggactataggcacgcaccaccaccttgggctcatttttctatttttagtggagacagggtttcaccatgttggccaggctggtctcgaactcctggcctcaagctatccacctgccttggcctcccaaagtgctgggattacaggtgtgagccaccgtgccaggtctatggagctcttcttgtacctcccagccccattcatgtcttgctgtcactgctggacccactgtcagggtggggccctaggcaatgtgggaagtcagccagcaccctcttgtcctgggcaggacgagaaccacgtgaggtcccccatggccagctggacttcccctttctgttcttccttatcaagggaaaagggatcagaaatctgttaaatgtgggcgtgaaagtgtttcccttctgaagggggaagctagtgagggcagtgcttaaagaaatgaatcactaattgaatttcaagcaagagtgaggaaaaagtagggctatttctccaacaggggagcctggttgattgcttagttgataaacactgttgcctgaacacccgctgtgtgcagagacctagcagataccctggttggggcagtgctaaggattctgccttctgggagctcatttcctgagcagaattccctcttggtacctggcctggcacctggtgcacagaaggcatgagtgcacatctgctgaaggtatgcatggacgaactctccctgggcagtcactaactagcattagaatgggcatgagacatagtggacctggattcattatcattggcagctggagccttgggggtgcattttaaaggggagattgatcagggtaatgcttaaccaaatgaatgaagtggaggggaggatttcaggaacaaagaacactttttttttcctttttttgttgtgtctctggcagtttttggtaacaagatgatgctggcctcatagaatgagttagggaggagtccctcttcctcaatttttttgaatagtttctgtgggaatggtactagctcttcttcgtatatctggtagaattcagctgtgaatccatcaggtcctggccttttattggtaggctatttattactaattcaatttaggagctcattattgatctgttcagggaatcagtttcttcctggctcagtcatgggaggattgtgtgtccaggaatttatccatctcttaggttttctagtttttgtgtgtagaggtgtttgtagtagtttctgatggttgttttttatttctgtggggtcattagtaacattcctgtagtcatttctaattgtgtttatctggatcttttctcttttcttctttattagtttagctagtggcctattttattaattttttcaaaaaaaaaaaaaacaactcctggattcgttgatcttttgaatggttttttgtgtcttgattttcttcagttcagctctgatttttgtcatttcttgtcttctgctaggcttggggttgatttgtttttgcttctctagttctttcagttgtgaagttaggttgttaatttgagatctttctaagtttttgattcggacatttagtgctatgaatttccctcttaacactaccctagctgtgtcccaaagaatcaaagaacaactttctacccatccctagaagtagctctctggggccaggtgagaacatcagccttttccctcagtttttctccagttgcctatccttttcattaactgattcagcctccacccccagcccagtcccaactaggccagagctggcctcagaggtctgacacagcccctcctttgcaagaggggaaactaaggcacaggtcaggcaagagacttgtttagggtcacagagcaggttggtggctaagctgggactggaatgcaggtttctggtccccaagactgatcagcagcctgtgccctgggagtgggaacaaagtcagcctgggggtgcttgggggctatggagggggagcagggttggctgggggctcatgccgttggggaatttcagtctttgcccctgctcggcaactttgcaggctgttaggagatgcggtggggggcctgcccactctgcacctgcctctccctggaccccatggttgggctctgaccctgcagggcttcctctgacactaagcgtgccttcttggccatttgccaatttgtcttgcaagcttggcctgttggacatcatgacctgtgcagacaacctggttatcagcacccccagtttactgatgaggaaactgaggccagagtgtgcaggcgactgctattcacaggccattggtagcagagctgggattgggtgcaggcatcctcccagaggccaagcgtagctgggagaggtgtgctgtggcaggtaaggcaggtgcggcaggtgcagcaggtgcttcccgatcttgagggaggccctttcttcatctgccctcatcctttggctgtggcgccctcctccctcacccatgccactctgcgtgcttccccaccctgggcctggtgcaggattctggctggctaccctgctcggccattcacgtcacaggtgtttgccaggaccagctgcgggacacacacacacagatcccaccacgacagtttggcaagtcaggggccgggatattggacccacactgggaaggcctcttggtacgggaggtgcctgggagagcagggcatgggggccacagggctctggggacagagagggctgggcttggggggatgggaccttgaataccagcaacattgaatccctgggtcccacgaggtttactgggggcctcttaggtcaggcttgcactgggcagagcagctgctggcttcatggagctcagggtctcttgagagagttcgcgttaatatgagattcccttggcaaatgaaaaatctgcctgagacccagcctaccaggggagccgagagccggcaggaccgggggcgcgagacggagcatgcaggttttttgtctggagctgcgtggcgtcccaggcagggtgtgggcccaggggcctgagcggggcctcttccctggaggcttccatgcccccctcactccaaggtccccacttcccctttttgaggccaacagggccccaaagcagccctgagcctgctgaggctcggccggaggaagccaggctgtggtttctgccaacagtggccgggtgaggaagtgggtgtcctgtctgcatctgtgaaagctgggggtttctagaacatactccctgcaagggctgtggttgtgctggggacgctgccagatcagctggactggggaaggattttccgagcacccagggacctggccctgcagttgcagtatggagtcccagcctcttgcttccagcaggtcttctggctggagaacctggacccagccagccagtatttgataaggagaccacagtcctgccttagttgcagggaagggataagggggtgtgtgtggggttgctcagcaggcttcctggaggaggaggccctcctggagttcgctggcctgaacttgctcctgcaaggcagagggaagtaattcgatggggtcccctgagctccccacctcttggtcatagctctgtcctgggccttgtttgtagggaagaggttggtgttttgggatattatgggatttctggatgccagccccatgagggtgatagggaccccggatatcctgtgtttaaatcccagctttttttttttttccagacaggattctgctctatcacccaggcaggagtgcagtggcatgatcatagttcagtgaatgtagccttgacctcctgggttcaagcaattctcctgcctcagcctctcaagtagcttggactacaagtgtatgccaccaagcctggctaattaaaaaaaaaataaacaactttttatagcgatggggtctcattatattgcccaggctggtcttaaactcctgaactcctggctggggctgggctgtggagcctggaaagtgtgatggagggatgagcggggctgtcccctccaagacccagctcctttctggaggactggctgtgtctgcaggggcacactcttacctctgtgctgactgagacccttccagttgactctgaacccactgaggggccacgggtgcttgttagacgcaacaaactgggtccagaagcctgatgtggactttgagactcttggttgcgagtgacagaagctcaaactggctgaagctgaaaggggcattgcttgtcccatgtggttaaatatctagaggttgcgtaagcttcaggcacagctggctcctgtgaccccaggaggtgttgccaggcccctgtcttgtgccagttctccatgttggtgtcagtttcaggtgggctctctccttgtggtggctcgggtgtctgctgacagtgtcaggtcaccgacaaaagagaacgcctctttccctgggtcagcagaagtccaaagagagccttcacttcccaggcctgtggcattagggcttgagagggactttgctgattggccacactggggtcatgtggcccatgaaccagggtactgagggtcgggagaagggacattgcacagcagaagcatgaaataccctcctcccatgtggacaccttccccacaggggagtcccctcttctttaaaatggggctgctcaccctgctctaccactggggtggtcgtgaggtgagagtaagtaagggaccccctgggactgcagtctcctcaggaagaggggacgtgatacctctgctcttggtggctttggagttcagacaggacccatgcggtgtgggtgagggagtgacagggaggcagggcttgccttgagctaagggaggactcagggccagaaaaagtgcccagtgatggaggagactgccctgagaggtggtgagcccccccgtcatggaggtgtgcaagctaacagcagggtcattcaatccgggagccctggattggatgtgtctcagacatggcagaaggattcctttatccagggccttgtggggaggccctccctgttgccaactgagtcgagggctggtggaagaactggtgattggacaggaggccttgaaaacttcccgggcagggggtgcctctgggtctggctttggcggggtggctcctagggaggagctggcctggggacatgccactggtggtgggttcctgggccccctctggagatgtgatcagtgagttcattccccccaggcctcacggtgcccggcttgttccaggagctggccaaggtccctggatgggctgaagtccttgtgcccatgttgtccactgtccacctgcgcctgcctgccgttgcccagaaagtggcctaatgagttccttgagaggcgtgtttaccaggcctgtgttcccacgggcccttgggactctctcagctggttcctccctttcctcgtggtggcccagcctggctttgtgtgcctggagcgggtgtgtccacacactctcacacttgcactttcatgcacgtgtctggccgcctcagctctggtctgggggctttgcctgggagatggagcagttgtggggagtggcctcagccctctggtgtttggagcttctcagcctggctgtcctggtgcactggtgtttggcagcaggccaggggtcaggtgggtttgctgtttgtgtgctgtggcatctggctcagtcccccgggatgtcagtgggcaagcctgggctgaggagccctggtttgggagctggcagacctgggtttgcatcccagcctatctgtccaccagctccagcagtgtgatcttaggcaaccactctgcctctctgggctcagttctgcatctgtgagacggtggtgccaccttggcctttgccggttgtgaagatgagagtgaatgtgtgtgcaggtgccgggggtgacaggaactgctgctgttattactgcaaagggctattttggggtggggggtgctgaattgaatgtatctcaggcagggaccttatcttgtttggcaacccccacagcacagggttggatgtatatggttagcacacagtaaatgcctcttgtggaatacagactgattagtttagatttagaggttgtaaactagtgggctgcaaatattgaaaaatttgaaatcagctgccaacatttaaaaatcatcatttcacgtagaaatcagatttgtagcctgtctgagcactttgggcactttgacagctcttggccacatccctgaagggttgcccctcgttgaacaggtgccaaggcctgtagacacctgcccaggcactgaaggggatggggcccccagcaaatgaccccttcctccttccccaaatatgtggttttaccattttgttcctggtgtgtggtgatggaataggaacttccagaggaaatagagcctgaggtggctcctggaattgaggtggccccagggatctcatactagcaggtgctggttggggacttggggaccctggatatcctgctttttgcctttgggggctgggggctcacctggccatcttccctccgctggaccagctgtcctttgaagcttctgctggcggctggccatttgtgccctgtgactgctctgagctgtcccgtgtctcacagcctccctgccctctgcctctggccctgtcctggttccaatctgaggcaggcctggaggacactgggggcctggactcttggtccagggttgcccccttcatgcaaggttcctgctgggaatatggcagctgtccccaagtccccattgctgtgtgagggattgcacaattttggtaattttccttcctttggagactgatggggatccctggggagagagagcccagactagcacacaggagatataagggctggcaggcgtaggtgtgattcacaagcctttttggaatcaatgaatatgctaaggaatgaatggtgctggggaaagaaggaacccatatgggctgagcatggcaagtgtggggtcagctcacagtgttgtcacaaaggggccactgtgtccctctctgagactcagctcccttttctgtgaagcacggcttgcagacatctgaaatttgtatcagtgggctatttaaaaaaataaacaagatttttgctgggtacagtgcctgaaagcttaacacttcggaggctgaggagggtagattgcttgagcttaggagttcaagactagcctgggcaacatggcaaaaccccatctctacaaaaaatacatggcctactgcagcctaagtctccccaggctcaggtaattctcccaccttagcctcctgcatagctgaggtcccagctacgcaggagtctgaggtgggaggattgcctgagccctgggaggttgaggctgcagcgggctatgatcacaccacttcactccagcctgggtgacagagtgagaccccatctcaaaaaaaaaaaaaaaaagagagaaagaaaatgcagttttatgtggagcttactgtaacacagatgcagggggctaccctggctgaagcaggcatgggggcctgagcctatgcccccccaccttcccttcccattgggggcctgatgcatgtccccaaatctcagggctcctaggatcacagcttggaaccctctgtgcctggaggcatgagactcactggaaaatgaagtgaatgtggtgattgcaccaggaccatggggacagagcagagcctggaaacagacaccatctgtgtgtgatcacctgacttatgacagaggtggctccactgaaattcagagagaggatggccggttcactgaacactgctgggataattcaatatccatatggaaaaaagaagtgaaccttgatccctacctcacaccatacccagagtgaatcgaaatggatcagagacctttgtgtgaaagcaaaacagtgaaacatgcagagcagagctggcctgtagaagcttctgtgatgatagacattctctgtttatctgtgctgtccagtacagcagctgcatgtagccattgggtatttgatttttttttttttttgagatggagtctcactctgttgcccaggctggatgcaatggcacgatctcagcttactgcaaaatttgcctcccaggttcaagccattctcctgcctcagcttcccgagtagctgggattacaggcacacgtcaccatgtccggctaatttttgtatttttagtggaggggggttttaccacgtgggccaggctggtctcgaactcctgacctcaggtgatctgcctgcctcgacctctcaaagtgctgggattacaggcatgagccaccatgcctggctggctgttgagtatttgaaatgtggctagtgtgactgagggactgaatttctaattttattttaaattaatttaaatttaatttaaaatagtggctgggcatggtggctcatgcctgtaatcccagcactttgggaggctgaggcaggaggattgcttgagcccacgagttcaaaaccaccctgggcagcagggggagacgcccatctctacaaaagagaatttaaaaattagctgcacacctgtagtcccagctacgtaggaggctgaggtgggagaatcacttgagcccgggagtttgaggctgcagtgagctatgatcgtgccactgcactccagcctgggcaacagagtgaggccctgtcttgaaaaaaaaaaaaaaaagcagccacatgtggctagtggctactatcttggacagtgcagtcctagaagacacaggggactagctttacgacaacaggacataaaagttaggttagggttaagatggataaatcagacttggtgctgtgaggcctgggccccgctctccctgatgctagccctcccctgacttggaccattaggtcaagttcctgtctgcttcgtctccgcagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggtgagtgagggcagcccctgggcttcacgtctcggccccaaccttggccaagctgctatcttctcttagcctcttctgtaaaatgcttatcttctgtaaaatgctatgcttttttgtttgttttgttttgtttttgggtttttttgagacagagtctcactctgtcacccaggctggagtacagtggcatgatctcggctcactgcaacctccatctcctgggctcaagcaattctcctgcctcagccttccgagtagctaggatgacaggtgcatgccaccatgcccagctaatttttgtatttttagtagagatgggctttcaccatgttggccaggctggtctcgaactcccaacctcaggtgatccacctgcttcggccccccaaagtgctgggattatagacgtgagccaccatgcccggccaatgctctgtcttttacagcacatttagactggtagaagacaagtttctaatttaaaaaaattttttttgagactgggccttgttttgttgcccaggttggccttgaactcctgggttcaagtaatcatcctggcttatcctcctgagtagctgggagtacaagcatgcacgaccatgcccagcctctctaactttaattcagttttgaagtctggagtggtttcagacattacattaacttgtccagataaactactctcatttttctccatgatgaaattcgattctactgaagacctgggtcagggatggcctgtgtatcactgccctcacttcctgtacccatgcagacatcattaatcaatccctacattccacactgagcctgtctacattctcagaatcctccttttgttttttttttgtttgtttgtttttgtagagacatggcctcgctatgttgcccaggctggtcttgaactcctggcctcaagtaatcctcctgccttggcctcccaaagtgttgggattacaggtgtgaaccactgtgcccggcctcagaatcctttttaacacagctctccaggctggcaccacctatgtcatttccggcccaggcacttgccttggtacagccactagctgtgtttagctattgagcatttaaaaagtgggtaatgtgactgaggaactgcatttttcaaaaaaaagagttttgctcttattgcccaggctggagtgcaatggcaccaacttggctcgctgcagcctccacctcctaggttcaagtgattctcctgcctcagcctcccgagtagctgggattacaggcccatgccaccacgcctggctaatttttgtatttttagtaaagacagggtttcaccatgttggccaggctggtctcaaattcctgacctcagctgatccacctgcctcggcctcccaaagtgctgggattataggcgtgagccaccatgcccagcccattttctttttagtgaatgtaaatttgattagctgagttctagaagaacactcagaaactccagggtgtttatgtgagtgaagtggccaggacctagcagctgccagtgcagcctggatccatgtggctaccaaccacaggatgcttgctactgtgtgccagcccccagatcaggcctctgcccccacggacctcccggatgctgtgcccgtcctgtcccacctctgtgccattgccccagctcctcccctgtgggatgacttttcctggtatccctcaccagcctctgctcactcactgagggccaggcgcagtgtcctctttgggcggctttacaaggctctgcctgtgaatgagtcctgccctgtgcttgtggtatcacctgcggctgtgcacagagcaccgtgggaacccagagaggaggcagaggcagatggagagtgatggcatcatgggcggggctgtgggtgatgctctggttcccgagatgatgggaagggggtggttgaggcagccttggcagaggtgacaaaggccagaaggtgagtgggaaccaggtgtgggagggtgcatccacacccttcacgtggaggaagctgtaagtgaggcagccggcccggcaggctttctggaggaggtggctctgcactggggaaagccgaggcattcctgtctgtttgctccacccaggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtaacaggaactctggactccctgccagctgcgccttcagcagctcccatccccgtggttggtgggcatgccacaggcccttcgtgccccacgcttggctgtgtgtctaggatggccccaggctggttttgtccctgtgagttctctgcattgacagggctgaggtggggagagcatccactcggacgctgggctgcagcacttttgggtggctccagtttggttggagatgacagaacttcagctcaaagaggcaaaaaggcacaaactggttcctgtgtcaggaaaggccaaggggtcagtgctgggctccagtgggtaactggaactggggcctctggacagcttcggccccgggcacgctgtccccaggtgggggcagagaagttcacagcggctccaggctgcccaccccagttgagagagagggccctttctcaaccagctcgacctgcaggcttgagccacactggcctggctgtggtcatgggcccagtcccagagaggctgtcaccaagcggtagcacactctgaccagtgggcctgggtcctatgacagctcctgtggctggggcagggtggggtgaggcccaaggaaaccatgtggactgaaggggagggagagggcagcactcccagaggggtggacgcaggaccagccggtggggatggtggggcagctctgggggtggagggagggcgggtggggccgcattgctggaggcagctggtgagagggtgcctcagcctcccggtaatcatttctgctgagcgagaaccacgtggcaggggcaccaggtgggggctccctggatcacgcggggcatggagcctcccacctagggtggccacaggcagtggatcagcacaggaaaccatgaaccttgtggccgggcccaccctagaaacacattatggcttttcttgttcccttgtatgtctgcccacgcagggggtggcgagggagccaacctaaggatacgcactgggtgggctgctgtggtgcagggttccgggggctgtacggcctggggcagcatcttggggcaccgggctcaccaggctgcatccacaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcaggtgagggatgggctaaggcctctgggggaggttttgtggtctgggtctaagggcagatgggggggccccctctgggtgaatcagacccgaaggccccggagccgtgtttgcagacagcccgctccaaggccgggccctctccacgtctgctcggaagctgggctccaggcgtggccctgccctctggcctttgctttgctggcctagggctcccctgtggctcagccctcagggtcgtgacctcaggccttgcctcccggttcagggacactgtcgtggggtgagtcccattgccgaagtttcccctcgaaggccctgtcctggcggggcttgggggagtaccccagggcactgccttgtgtctttgtgttgaatgagtgaatcttctgttcataattattgggtgtttagagaagtgttttccctctgaccaggcctggtgtcctctccaggcagaggctggccctccacacagccagctgggcgctgtgccctctgggactgcccttagcacgcatgcccctcgggccctgggctctgtgaggtggtctcttctgcctccctgggtgtcctggtcttgcagtcctagtgactcactaggagactagctcctgtctgggcctcagtttccctgtctgccccaggaagagtgccattctcagtgggttgaaggtcagggaatgggaagaggtgccatcactagtccgcctaggggtctggtgcctcgggagggcatgggccaggccacataatgagccaaacccctgtctacccgcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggtgggacccggcccccactcctcaccctgtacacccctgtcctcttcctctttctgttggacatgagacactcatgctgccatgtgcatgaggtgcatggccagacacccatgcaggtctcacctcggtgagtcctgggctccagcagggtaaccatagcctgctgacccttgactctgccttcctctgtgtggtttcagtcctgggcacgcagtccccaggtggcggcagagaaggccgtagtggctccaggctgctcacccatcagcttagcctccccagctgaaagagccctttctcagtcaccctgagtcccgggggctgctgggtacatgggaggtagatgctcagttgggttggtggaggacaagagcagagatggggacattgtgggcagggcaggcaggcagggaggatgggggccaaggaggccaggtctgggacctgatgctaccctgcctgtcccccgctggtccctccgccggtcgctttgctggtccctctgctggtctgcccacccacacccaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcaggtgggcggtgagacgtgtgattagcatatcccggggactgggcccaccgttccaccggcccccaggcggcctccccgccctatctggaggctcagacccctgcccatatagggattgggagagggccccatggttccaggtcaatctggggccctccctgggtctcagaacccccacttgtgggcaggatcagatcagggctcttaaattagagaatttagattggtattgaaagatctagcacacccccaaaactgtaaaactgtgtgagcaaacatagcttttgtgaaggaaggggtcctttcagatggttctcaagggagcacaggacccccagaatgaggtaaagccccccggccttggtgcccaagagtgccccggttctgacacctgtctttggctgatttgcagggaaccacaaagttttacttgaatgcactgacctgagtttgtcaagtgtcgatgtgggtgctgggtgccgttgagtgtagatgtgggtcccaggagaccccctgggtcctctgcctgcagcgccagcattacatccaaggctggcccgctgccttttctctgggctgtggatggtccatgagcttaaggactttggagcagggagaactggtgcagatgccagctcttggcttcccagcaagtctcaatgtcctggagcctcagtttgtgcatctgtagaacgggagttcggcaagggctgtgtgaggactcgatgcctgtaaagtgctgggtgtggaggttggcttgagggagcatggagctgcctctcaccagggagttctgaagtctgtgctgtggtgaacattggatgggaaaggggaaggctccgggctgcctgcaggagtgcccttcggctgtctgcagtgatagggcctggggtggggccgagggctcctgtaggctctgaattttgctcccttctgctttaacgtgaagcccctggaactttaatctgtctctatggctgggcgcgactctcccatccctatggaggctgaggaaggacgggggtgaatgggctcaggcctggcaggctcctggggctccagacagtcctgcgtgctcctgctgctgctgtctaggagcctggctctgacactccctcccaccctgccccatccccagcatcctctatgcggacatcgtgggcttcacgcagctggccagcgactgttctcccaaggagctggtggtggtgctgaatgagctctttggcaagttcgaccagatcgccaaggtgagcccgctggcctacaatgggcaaagccaggcccctcccctgcctattacaccccaggggtgtcctgtgttcagtgccctgctggaattgggatggggaggcgtggctgaattttagcatccagccagcaaacacaagcgccccatggtaaaggtgggggtgagtggtggccacggcagccaggatcctgtgcccccagagtgacaggccagtggggagactgacagtgcacactgggcgatatactggggctctggagctcagatgggggctcaggaggaggagatggctccatcctcactggcaaggctagcagcctccactcacctggtagctcaggaggactgtggaatgcccagcctcacccagaagctgcttttcacaggatctgaggtgaatcatgtgcacattaaacttttacgttttgtttgtttgtttttgtgagatggagtctcattctgtcatgaaggctggagtgcagtggtgccatcactgctcactgcagcctcgacctgccaggctcaagtgattctcatgcctcagcctcctgagtagctgggactacaggcatgcaccaccacgcctggctaattttttttttttttttttttttttttttttgtagcaatggggtttcgccatgtaggccaggctggtctcgaactcctgacctcaagtgatcatcccctcttggcctcccaagtgctgggattacagccgtgggccaccactcctggcccaccttaaagtctgagatacttgaaaaaatatctgaggaggaaagggaacagtgttcttagcagggggaacagcatagacaaagcctggagtagaaagaaagccccgtgtgtccatggggtgaacgtgctcagtgtgcgtgtgaggtgtgagggggacaagggcacaaggtctgacatgcaaggacatgagggctgaggcgaggaccaggatgctgaggagctcgacacgtgccaggcagggagggggtaaggcaagcaacatttccattaatggaccaaatggtcctgagagagggtaagtgccaggccctgagtctgggtggggccttgggcctacatggtatgtgctttgaagaagagaagtgtgggggccaggaagcctggggagcacctagcccagcctcaggtgatcagggcaggcttcctggaagtggtggccattaaatagagactgaagtgtaagatttaaggtggtggctccctatcctggctgtacatgcaaatcacatggaaagcttaaataaaacaccagtgcccatgtccacacccatcagagttctgttttgttttgtttttgagacagagtcttgctctgtcacctagcgtgaagtgcaatggcataatcatggctcacagcagcctcaacctgcctgggctcaggcgtcctcccacttcagcctcccgagcagctgtgactacaggtgtgcaccacaaccccaggctaatttttttgtattttgtggagatggggttttgctacattgtctaggctggtcttgaattcctacgctcaagtgatccacccacctcagcctcccaaagtgctaggattacaggcatgcaccatcatgccctgccccatcagaattttttttttttttttgagacggagtcttgctctgttgcccaggctggagtgcagtggtgtgatctctgctcactgcaagctccgcctcccgggttcacaccattctgcctcaccctcctgagtagctgggactacaggcgcctgccaccacgcctggctaattttttgtatttttagtagagacggggtttcaccatgttagccaggatggtcttgatttcctgaccttgtgatccgcctgcctcgacctctcaaagtgctgggattacaggtgtgagccactgcgcctggccagaatttgtaagagccccgcaggtgtctctgtgggcagagaatcaatggtctagaacttgatgggaggcaagttatgacttcacactgggaagaatttttcatgatcagagctactcaatcccaggagggactggaagtgggctccctgttgcagggggtaaccaagcttctacaggattgcactggtcagggatgctctggaaaactgtcccatcctggggattgtggactgagtgactcagagggcctgtctagcctggaaccttccttcaggatctgcatggcttctgaaccagcagctgggagccccagaggttgggcctcatgtgaggcaggggccctgggctcgggccacagctggccctttccttaccataaagcccacacagagggtcccttgcccttggacacagtcttccctctccagcaggcccaggaggcgtggccctattgcacagatggggaaagggaggccatggcaggtgccagcttcccagtcagagcatctaatctctgggcagagttgggcagggctggtcccagccttttctcctatcaacaatcagattccagaagtgtaagctctttccaagagccagggcctcctctctcagaggcatacaagtcacacctccgcacaagacccagctccccaactccaagtgtcagagacacaggggactgtcagccggtggagcagccgggggaatgtggcctctcctacatccccgagagctgggctgggtccatgggcagtcctgtgcctggtccgagaggagatcagggtagctggagcctagtatccaggtctgccaagattgcctgctttctaggaaagccactgtcctcttgtccttgcagtcactcagaactcactcagcatgtgccagatggggcccagcaggaaacatctggcacacgctgaaactgagtaattggcggagggcacaggccagggatggttcccaggctgggcaggtgcaggggacctggaggcagggctggtgctgtgtctggggcctgggtctgtgatggctgatgggcacagagtagggacgaggacaggataggctcgagtcctggagacagatggtgttccaggagcaggcctagccctcgtgagcctgcaggacagagccctcttagctccctcctggccagaagccagagcacagggccacctgctggggcgtccagtccgagggtcagctgagtggggtagagggtggggaggggagagcagaggcagatggcgctccttcttcagctcccctaaagccccacccatgaggcctcggtgcatgtggccacccttgctgagggcttaaggagggtctggtgacgcagcagtgcctcagatgaacctcagagggctctcgggggtccccttctctccctgggccttttcctatgagtccccaccctcgccgctctcctactctgccctccccattccctctttcctctctgcattgatatctttcctccccacccctaagccctgtcagcacagccactgcttgggtgaccttgaaacctgctgatcccttggtgtgtacacctgtgacctctgtcctcaccccccactcctgcagcctcctggctacctcgcagtctcttccccagctttgtggccccagggctcctgtgagtccttgagtactcttcctgcagagactggcatggccggctctctcggttcctcggggtcttagctcaaatgtttctgattccaactctgagaggtcttcgctggcctcctgggaacatcacttccctcctgtgccttggttttctccttagcccccatcacagctgggcacactgttttgtttttgtctttctagtttagtgcccacccctcctgcctacgtgcaagctccgtggctgcagagatttgcatctattttgttcactgctgtgtccccttgcctggcctggggccgggtactcagtaggcactcaaacattacctgggcaaatgaaaccaaggcagacccctccccgaggcccttaggaacactcgtgttcacctctggtgcttgcctgggggttcctcctggggaggcccccatgtcgctaagccttttgccaggcccagaagtggctcctggtgactggaccccaggaggcaagcccccagccaggagagagccgggtgcaccctggagggtggggggaggcggctgtcgtgagaggtcccagccccacatcttccagtgaccaggcccttccctcaccctgcaggccaacgagtgcatgcgaatcaagatcctcggcgactgctactactgtgtatcgggcctgcccgtgtcgctgcctacccacgcccggaactgcgtgaagatggggctggacatgtgccaggccatcaagtaggtcctgggcgggcccaggccctgggtcctgccctgtggcggaccctcctgggcatggtaggggatgtgtcattctcatgtcacagatggggaaactgaggctcggggggttgggggtgaaagcagcttgcctggaccacccagcctgctggaggattcagacttcatctgtttgcgtccctccctgtggtgctgcctgtgactctgagtcccagaaagcatctccggagctcagagctgggtgatgtgaggtcagggcggtgggctccgctcccctcaaggatggggtcttagcaacagcaggaggcttcagggtaggcagccgggggacctttccgacccaggggtcgactccaaggctccatctgcttcctgctccccagtgaagatcctggagtcaggcttggtcctgaggctgcggggagaccccccgctcccctctaggtcccctgtggctctgagcagctggggtctgtgggaggaatttgccgagagggctgtatggggagagggccaggcaggcccagccaggctgaccagtgtggggcagagcagggcccggtggggctgcccgtcctggatatcaggccgtgttccagcctgtccttctcctgaagtcctgccataggtggctggtgttgccagaaagaagcctgggcagagctggaggggcctggcctgcaccactgcctgtgtgacctcaggctggcccctgccctgtaacaggcggaggttgtacaggccctcgtgcacctctggttccgaccctggaaggcttggtcagtgcccagccttgttggtggacacgtggtgccgcttgtcatggggactcaggctctgttcctgtcttgggcgtcccctgtgccccaaggaagctctcccgtggggctctgctcctgtgctcagtggtgctaacaactcccagggcccctgcttcccagggattgggggggcatagaaggtgcccatggtctgggcccctgtgttccttgtctatgctaggttttgggtggttcctggaccccctctgtagacgccagtaaactttatttatttatttatttatttgagatggagtctcgctgtgttgcccagagcgtatctcggttcaccacaacctctgcctcctgggttcaagcgattctcctgtctcagcctcccaagtagctgggactacaggcgcctgctaccatgcccggctaatttttatatttttagtagagtcagggttttgccatattggccagggtggtctcaaaactcctgacctcaggtgatctgcctgcctcagcctcccacagtgctgggattacaggcatgagccaccacgcccggcccccagtaaacttttaaaacccagccggtgctgctgggcagggaaaacacccagtgatggtattttaggtccatcaacatgggctgtagtgactagttggaattcctcctccctcctacctagtccttgaggtcagctgtggccacacctacttgtatgctcctggggatggggcactcagctcttcctgaagaggcagccccatcaggctgagaacattctctcccgtgggctgagcgcctgccctgttcccacatgctgccctgtacccaccccacacctgggagcttcagcctgtcccagggcttaggcagggctggggtgactgggccactctgccccaggcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccgggtgaggctgggctgggtagccgcagggacagaggcctggggctggctgtggatggagggttctgcggttgggggtgggggtcaggtgtggagggagagatgaatgtagaaaagctggcctggggcccaggcctgcctgctgtgcatccctgggtggatgccagccctctctgggccccaaggctctgcctgacttgggtctcccgtagccgggtgcacatcacggaggccacgctaaagcacctggacaaggcgtacgaggtggaggatgggcacgggcagcagcgggacccctacctcaaggagatgaacatccgcacctacctggtcatcgacccccgggtacgagggctcagaggccgcagctgggggggacccggagggactggaggggccctggagagcctggcccgcaccttggaggaaacccccatgtggagggagaggtggggaagggccctgcctgggcaggagtgagctccctgttcccaggcacattctaggcaccgagtagccactccctgggcctccattcttttctatgtgatgggaaaacagcgcctgcctcaccagaaggagctaatccgagcgaggccttcacagtgcgcctggcacgtcacagcattctatgtattctcgtcactcttggtttattttccatgaggtggttattaatctcccagatttccgagagacacactttcaaaacaagctttggatgaaactcaggaaagcagggagtggcctgggagccactgggcaggagcctctgagtgtcctgggtgctgactgcaggtcccctggtggctccaggaccccacggtggaggaggcagttccactgccctggccaggtggggcccgccttggcctgtctgctgcccgaccctggcctgcttcagggagtccggcacgtctggccacttctctgtgaatcatccatgaggcttgctcaagaatgtcggcccagccagcgagtggctcctttcactctggtcctcgctatgccttggggctggcccgactgccagaccctgggggaccaagggctggcctgtgagcctccctacacatctgctggcctcactctgcccccagcacccccagtgctgcaccatccatactgagccagcatctgggaaaacccctgccggtacctgtgtcccattccaccaccctcctagaatagggccctgatcctcgccctgtaccccggccctggccccgcccctccaagccccttcccctgctctcctgtccccctcaccccacctggtctcctcctgcccttccactaccagggtggtggcacccgcaggtccctgcactcaaaacactcctccctccgtccctaatgcccttgcttgtttatccattttccttgtctgttgtcagcatgagtgccatgccggggggctcctcctctccaggctgcagccccccaccccgtgctgagatggatgcccggctcgaagctagtgctcagatagcccttgaatgagtgaagcagagctcctcacccaggaggctccaaaatccacccccgcaggctgccaggttgagcagggaaaactgcaggctgcctgggccgacttgaatttcagataactgtaaatcatgtttcgcataagtgttgcacgcagtactcaactggacagttgtatttatttggcggccccaccttccccccaccccaccctaccccaccctcttttttgtttaacttcatttatccacgcagttgaaagttcaaaaggtgtgaagggcgtgttgtagaaagactccttgtccccagccggcacatctcagaggggacctgtgcagtgagtttcttgtattccctccacagggattttcacggacaccgagtgaactgcgagtccccccacccttcttgctaaggtggcagtggcgggccccatggtcgcgcaccctgcatttttcctaccttggggacatccctcctgtgtgcagggtgctcgtctgtagctcctgtttttgacatggaggtggattttctgcactggcttctatgggctctgccttacgccattgctgtgtggcctggctggggcaaggtgggctcctgtggactggatggtggctgcagctgcccccgtggggctcataccaatgccatgcccattccgagtaggcatgtgtttgctcagaactgaggaatctgatttttgtttctgctttttatttgtttctcagggggctggggtgtctggattctctgctaagtgccagtgaccttgaacttgagtggctaggtgctgtgtaggcagagttgtcacaatggaggaggggacagagaaacgcatccacccccaccaggttgctcaccacagggccagcgcgctcttcctgctctgggacactcaccgaggctgaattccacgtggctcccgtggctaggcagatagatgcagctaagggcttaaaaatgtttctatcccaaaaggaggtgagaggtttccaggaaagttgcgctgtggcttatcgagtgcttgtagctgtggaggcttgtccatggggtgtttgtggggccctaggagacaggacttccggaggcagaggaatgtttcaggggctaaggagagactcagcagacctggagcccgcttaagctcatctctggtggccttgtgggtctttctcttccctgtcccttttccagtcctgtctggccaccccaactggcgaaggcctcaggcatgtgttcttggatcggggtgggggtctcaggtctgtggcatgagtgggggcgggtagggctggccgtgcattcagggcctggctgaactactgagtgtccagcatgaggctgggtctcgcaggcacgtggcaggtcatggccctgtgccatctgcggttgggggccacacaagtggaactccctggatcgctgccctgggggttggctggcctctggcttggccatttctcggggcggctagcacccctcttcctcctggctgcttctcacaggaaggagcgaatgcgtgccggccacacgtgggagggcagggtaggatgcctgtggctttcccaggcgcctcctggggaggagctgatgggtgctcaggccccagggactctctggttccaaggagcctcaagggcagtggggcctcgggcttgggacccaagccctgcctctctccctggggaggcagagcagggtatggggttgggtacagtggtgggtacttgctagcctcttctcggcctggggaaaggccagggcaccgagctgggaccccatatggcctggcctcagagtgcaccaggctttggctggctagtccccaagggcagccgctctccaaggggactgcgggttgagcaacttctttgctgtttattttttcacgggctcagggcggcgtcacacttcagggagagctggatggggatggcggccccttcctgggccgagaggggaggaggtggcacaggcccatgtccatgtctgcccgcagagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaaggtaggtccccctcccacccagaaagccagggattggggccccaagccaggagcaggagagtgagtgctgaagatctcctgccctctcagcctcactgtccccatctgtaaaatggccacagcctctgccccacctcctggggctggagaggaagcaaagacatttggagaatactccgggatggccaggaacatccctgtcctccttgatgcctggaccacgctcagctatagtcaggatgtctgtggcttggacgaccccgacaccttgtcctgtgtatcaagtgccggaggggctgaacctggcccagcagtggccttcagggcccagtgttctggggaatgactgtatcctttcctcccttccctttcagagcgttccccagcgccaccgccggaccccagacaggtgcgtgccctgccctcctggccaagtcctgctgcagccacctcctccaagcaggctgccctgagcagcctctgtccagtgggcagctccgcaaggcccagcccaggacctctgtgaagttggccagggcttgggtcaaagcatttctaggaaccagagtttcctggcccctggcccttctgcatggccacatgatggagcacctgttgtatggtgccctggcggggtcagtggagtcggtggaagggaaggagatgactgtgggtgtcctggtccccatgccaatcccgggggtgtagccgaagatgccttagactggggctcgggtctgccctctgcctctggcttggctgctggccagctgggccatgctgggccatgctgggtcctcactcgccctctctgggcctcagtgggacccacccattccttcaccatcccacctgaggttctgggaccccactggtgtctacgtccacaccctcctctgggagagttggaggtggtcgctgtgctgatgcagttgtgggtatctgattccagaagcatgtcccccaaggggcggtcggaggatgactcgtacgatgacgagatgctgtcagccattgaggggctcagctccacgaggtgaggtctgagacctctgtccacccccctctcctctccccctcggataggggtcccctatatgggcaggcccatctcataccccatgcctggtggcccagccttgttccttccccctgcctgctgccacctcctgagggaatggaccccttcccagcccccatctcaccgcagctgcccccgcccacaggccctgctgctccaagtccgatgacttctacacctttgggtccatcttcctggagaagggctttgagcgcgaggtgagggcccccagcagcctcctccgcagagggacggggtctccaggcctggggtagggtgggggacgcaggtcatggggcagcctgcgttcccaagaccggctaggggaggggcactgagaatccacagctgctcctgggcggggggcaggggcggggccagtgcagcaccagcctggctctctcctgtcggcttcattccatgacccaaatgcaccatcagagatttgcctccatgggtctgcaagacttttgctccgtccagtgccaaagccttagcagatcctggcatggatgcctcaggctgatggcaccggccttgcaatgagacgagaacccaaagctcagttatcagtgtcctgtcttgctgctatgagctttttgtactgataacgaccatttctttactgagcgccttctgggttctggcagcatcctcggcacccacattatataatttaaccgtcacaacggccagcccaggggtgctgctataccacttcacagagaggaaactggctctcagaggcttcagagcctgtccccagcttcaggtgtggctccctgagttgggggcttcctaggtgaggtcacgaggaaacctgctggccaagtgacctggcagggtgtggccagtgtggccagggccgccgagcctgctttccttccctgcagcaggaacccttctggggctgtgatcctgcgatggtgcctgggtgggagtgggggtggggggcgggatggtctccctacctgccagcttcttggtttgaggtgaggacagccccggaagctcagacttggctcctgtccatgtacttggggccatgagctctgcagggaccttggaaagagagagacgggtggtgtagggcaggggaaggcattgtcttcaaacaggaaaaagctgagaatggaaacaggcgaaacttaccaagtgtaacatcacctggaactgaaggagggtgggaaggttttaattattttaaaaatagagatggggactcactatgttgcccaggctggtctcaaactactgggctcaagtgaacctccttcctcggctcccaaagtgctgggattacaagcgtgagccactgtcccagcagggaggtgttttttttaaagctgattcactggaggcagggtgggcaagtggcactgctggtggccacccctcacagtccctgctgcccccagtaccgcctggcacccatcccccgggcccgccacgactttgcctgcgccagcctgatcttcgtctgcatcctgctcgtccatgtcctgctcatgcccaggtcagttgcagggaggggtgtgggggtccggcctgctgggatccaggctggaaggtgactatgaacctgcaaggagctgtgtgatttgggctggaaggggtcggctgctggggtcctagcaactggaccaggggctgtggcagcacaccttgagttaccaacacttctttttaatagaatgtgtgttttctgccacaggcctccctactccctaacgtctctctcctcagccacctgtcatatgtgtggcctgcatgcattttggttgacagcccttgccttaggtgtttggagtgctaggaggatagactctgaaaactgtaggcgccatcctttttctcttatatatagggaaattggggcacagaggattaatgatttatccaaaactcactgagattcatgcttctggctctagggccctgctggtggggtatagggatgagggtgaagtcagagggaagggggatctaaggtcagctacttggtgctttctagaagagcagttaggccgaagcatcgaccaggattgtggttttggctatgcttactaaagacataatagggaggctgtgcgtggtgactcacgcctgtaatcccagcactttgggaggctgcggggcgaatcactcgaggtcaggggtttgagaccagcctggccaacatggtgaaaccccgtctctaccaaaaatacaaaaattagctgggcgtggtggctggcgcctgtaatcccagctactcgggaggctgaggcaggagaatggtgtgaacctgggaggcggaggttgcagtgagccgagatcatgccactgcactccagcctgggtgacagagtgagactccatctcaaaaaaaaaaaaaaaaaaaaacgaagaaagatgtaatagggaatgcgtttttacagttttttctgagtctaaaggctgcagagacattgctcatttcttatacacttggaccaaaaagagtgatatggtcttgacctcaatcttcataatctagctgggccctgtgtattgcccatggggcagctgggccacagttttcacaggtcccctttgctgtgggcagaataccaggtagggtggggacaggtggctgtgagccagaggattggtgggggcggtggtcctgggcagaaggccctaggcagaactgaggttcttccctcctctccaggacggcggcactgggtgtgtccttcgggctggtggcctgtgtactggggctggtgctgggcctgtgctttgccaccaagttctcggtaagtggggagctctggccccgcgggccctccctccctgcctcaggacacctgcctaggagccctccctggtgagcttggctgggctgagcccctgctctggtcaaggttgggtgcccatctctcctgcctcggggacaatttcctgagtgccctggaggcttctcccgaggatacccctccccaggctgccagcgaccagccctccttgcccaggctgttggctctgggtgacttgaccctgttaccccacagaggtgctgcccagctcgggggacgctctgcactatctctgagagggtggagacacagcccctgctgaggctgaccctggccgtcctgaccatcggcagcctgctcactgtggccatcatcaacctggtgggtcccgtggtggggaggcaggcctccggggtagagggagacctccagatttgggacgcctacaatgtggccttaaaagctgcctctggttgtcctctcccccgagctcagcaggtggatgtggggggttcccctttgtacactcagggctcctcacctttgggttctcaaatgcggactttgggggcccagagagcttgtgtggccagctccaggaggatgtgatgccttgagccaccacatcctgacatcccattcattcttcacggcccttctgagactcagtttcccctctcagggatgaacccttgctcctctgctggggctcagaggctcagtgctgcagaaagcagcctgcgggacacttgtccacctctctcccagaccccgcatcctgggctagggcctctccctcacctctctgccccggaccctgggtttttggaatgtgttcctgtgaccacctccctcagggtcacctggggaagctgaaaatgttggtcccggcccctccccctggctgctgccgctctgggggtgtctgcaccctcatctcctagcccctctgccctctgaacctgacggctgctgtggggagtcggcacggcggcttgagccgtgctcagagctgatcccaacgtgaaacctcaggctgctgtgatactcatggttgcctggggcccaccttgcatggcttgggcaggttccagcgttcttgtccctggactgatggggacctgtctcctctacagcccctgatgcctttccaagttccagagctgcctgttggcaatgagacaggcctactggccgcgagcagcaagacaagagccctgtgtgagcccctcccggtgagtgcgccgggcccggctccgtggcctcattcagagtggggctgctgctgccagaggtgtagtttggaccctcaaagcatgggtgctgacccctgagagcacagcatgtggaggctgagaacagcctctcctgcagagctgggaaagcagggtcccatgggcccagctggcctctggcccaagggagtgaggagtcctggccttggcaggcttggtctaggctgtgtgggtaggcagggagtgaggggagcatctggccttgtgcgggtctctggtcagggcacttcctctctgacaggcctgtcactattttatacacgagtatgcacagctcagggaggggcttcattaggtgatggcgccagggcaggcccagacaggctgatggcagaggtcaaggtctctgcctggagggccttgcagacagcagactctgcagcttcagaggctggcagtgcagtgagctgggctctaaaaggcagaaaggttctgggacaagggacagcatgggaaaaagccgaggcgtgtgttgggagcagtggggttttgggtgggttgtctcctggagagggagtggggagaactgggagatggagccgggggcaggcttgatccagactgggaggtgcaggaatgccggggtgtgaagagcgtggtctttattctgggggctggggagccacagcacaatcttgagcagggcagaggtcctttgggagggtaagctcacaaaaactcagggaggcagcttggatgcatgcacgctccggccttgaccttgactgtggtctgttgtatccacagcacctgcatactgttttttcccgtttaaatgagctcacttcataagaaataaaactacagtgaaaacaacactggacactcttaggtctcattgttttttgttgagaagggaggtggtaaggcaagagcgtgatgctgaggtgcagggagtggggctctgtggtatgtgctgggctggaggcgagagtacgtggtggggtggccctgtcctgagtgacaccctgccccctcagtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccaggtggggtcccgcccgtccccgtccccatccccatggtggcctgttcatctggtgcctgcctgctcgcaccaaggggcttctgtgttcatggggagtgggcaccttgcagggcggggctggcagatggtgtccagcgctcagagccgaggaattcactggcaggttctttaggaagtccctagtctgacagaggccaccgggtcatcctgtttccaggccagtctagtggtggggagggaaggaggctgcagctctagctctgtgcctctcaaggccacatcctgggtctcgagttctggaaggagcagttgcttccatctcttcctggacaggtggtgatacctgaggctggcagggctggggtgtgtggttctaggggttctgggtcccaagtggattaaggagcggacctggcccccctaaacaaaaaagctggaagcctgggacccagaacagaacctgctcctgtgggtctgccccgcacctgcaaaatccttatgccacccatccaccccaccccgcctgccactgaccctggctcaccagttctgggctcccttcaggccctcatcacagctgattctggtcattcaggggtgagatcagaggtcttccccacaagggctcccccatctccctgcccacctctcccctcccccctttataataccccaaagttgtcttgttttctacccaccccattagaatcaattttcccctttcccctgggtgtgcgtggcacctggagagcatgactcagtgggttggagtggtgagtgctgggagtgacttgggcctcccttcgcattcagtggcacccctagctgttcctggaaggacctgaagaccatgaccaatttctacctggtcctgttctacatcaccctgcttacactctccagacaggtaaggaggctggccccccccccccccccaagctctgcccacttttcctcacctccatctggagatggggtggggtggggtgggctcaggtggagtagcagaaaagactagagtcctgccaggaaagcactggtcccctggccagaggctccaaggacgccagggacagacagacctggctaggagatgcacagcagcacggctcccacttgcctgtggacggggcgcttatgttgctgccgtttgcagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagttaaacgaggtgtgctgagaaggggctggggcgggggcagggaggcggacggtccaggcgcagtccgtagggtgaaggtgtggagctggagtgcatgctgagcttggcttcctcaggtcctggcctcaccgggatgcccaggcgacaatgtatggcatcagctgtgagagcatgggcctggggtcagggacctgggctcaagtgtggtcgtgaacaaggcaccttgctttcccaggccttggtcttcacctctgtaaaatgggctgacagcccttccccacaggcttgtggcgaggatgaaatgtgtgttcaggggtttgtgatctggacattctgtgttgatgaaaatgtctgtacttctactagttatgtgtagcaagttttctagataggaaacggaggcccagtgagaatgaagacctcccgttaccctccactactgcagaggttctcaccccatgtgtacatggaaacacccatggtgcttctgtgagcaaaaaccaacctgagcctgaccctccctggccacccaattcttaatcacccggtaacagccaccagatgaaactcatgcagcccgcccccctccccactccccgaaagctgggctgggcagttcagcagtgccatctgctcctgaggccttgccactcttcctgtcccctcaagaggtgaagtggtgtaaggtccggtttcttcccatccaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgaggtacagcctctagcccagccttgcgcagcagcccccacccatgctggagagggaagggcggtggcacctgccatcctaaaacccaatttaaaaatgtgacacagagctgggcaaggtggtctataatcccagcactttgggaggtcaaggtgggtggatcacttgaggctaggagttcgagaccagcctggccaacatggcgaaaccctgtctctactgaaaatacaaaaaattacaagctgggcttggggcgcacacctgtaatcccagctacttgggaggctgaggcaggagaatcgcttgaacctgggaggcggttgcagtgagctgggatcacgccactgcactacagcctgggcaacagtacacaactctgtctcaaacaacaacaacaacaacaaaaaaaaaacgacgtggcccgcctggggggaacatacattacacagaatataaaggtacacatttctttttcattctgttttatgcagcaaataattcgttggcatcttctctgtgatgggcagcttgctaagattagactcaggccccttagcttcatttccaactaagcccacgctatcaaccaagccaaacagaggaaatcagtttgggttgaattctttgctggagacaaagaatctacattcctgtgtagataatgctgtgtttgctctgtgcagacacagatggaagggaagagggagacagtgtggggacggagacaacaggaagagcaggagccgccaagggccatgtcctcaccatgcttagtcatgcgctcagctggcagggcagccatgagacgtgtgtgcgagaggcggcgatgggtggagggaaccccacacccttcctgagaagcaggggcagcctggctgcggctatggagtggcggctgcttcaccgcttccttcttgcctgcagctcctactgaagcccaagttcagcggcgtggagaagatcaagaccatcggcagcacgtacatggcagctgcagggctcagcgtcgcctcagggcacgagaaccaggtactcaagcccaagaggtgaaattcagctgactgtcctcacttaaaggtgacctgtcaccttacttaaagggtgtgcccttatctcgtcctgggggaggggcacaggtacttgtagggctcagccaggattttagtggtggggatcctcaacaagagtggcgcgccagggcccactaggtctgggggctctggagatgcaaggatctgacccacagcctgtcccgcaggagctggagcggcagcatgcccacattggtgtcatggtggagttcagcatcgccctgatgagtaagctggacggcatcaacaggcactccttcaactccttccgcctccgcgtcggtgagcccgggtgatggagcggggtggggagcccctgcctctaggccagtccacccagtctgtgtggcacagctgcacctcgccatctattatgaaaggttttagaaatccctctgatctgacaagctcagcagttggacaattattctgatgttttgcatatagttagcatatagttaccattgagagttttaataatacgtaactacagaaaatggagaaccaaaattattgtctgtaaacaggtgaccttaaaatatagagaaggaagcaaagttactaaacctaaatagttgcgggcctgcgctcaaagccaggcctttgttaatacttttaacaaagtattctttgttaaaagagagattagcagatacaagtgttaacatcaaacccagacttctgagtctgaaaaagagctggccggggaatgccctcctcataccccaagcccgactgcaacgcagtgactctgggaagcaacccagccttcactctagttgttttgtccccgcatcctgtgctggggtatggattctctggcctcctctaagggcagaagcttgaggctttgcctgcacgcttgggtaactgtaaacatcatcttcaggcataaaccatgggcctgtgattgctggagtgattggggcccgaaaacctcagtatgacatctggggaaacactgtcaatgtggccagccgaatggaaagcactggagaacttgggaaaatccaggtaaagacctattggggaagcagttgactaaggggaaaagatcttccccagaggtgaggggacttggacttaagagctgctgtctcacccagcagccatggttctagctatcacactctccagggaaggcagactgcatgcctgggcagtctctatctgtccctaccatgacaggtgttcttcccgcctctgaagacaacaggtctctcttccttttcaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgaccagacttgttggggtcctgggatgagttgccccgggctgcaaattaagagtacagctaagtgcgggggtggcggtggagggaacgaaaattgaacctgtctgcctgtgctgtgtcgtgtggctttatcagcccgaggaagggcaggtgtattctaatttgcacaaaggtgctgggtagactagtggcagctctcatgtgctgcacataagtggaatcagtatgaatagaagaacttgctgtataaaggaatttcatggcaacaatgctggtaagggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtagaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaaccactgtatactttgtgtatataataggtcagtgtaaagaaatatgatttgaggtggtgcatgcaagtaactagggtttattctatataatgaatatttatagatctgtaacatttgtttcaaaatgctgtttcatttttataaagtaccagtgtttagctgctttttatacattaaattagcaatttgaaaaactcaaatatctgaaggtattttattttcgtggtcctcatgaactcactagagattaaaagtagactcaaacaacttgaaaatttgactcttttagcataagattttaagtcttttgagggaattaattttcctttaccctatttgttcttcctaaatactaattaattttcaaagtcaggaaaataatagaaatcaaatggcttcctgcctgggtgatttatagaaggattgtataagggccttcaaacttaatttgttcactgaacaaggctatctatctatctatctatctccatcctgatttttttcccttgtgtataacaggttctataccgattcagcaaaatcaccatttatctcagcttgctgataaaagggggccatgaatcttgtggtctcctacttagagttcaactccttgggtacttgacctttgtatttcagataaacagtaagtaaagtagaaatgtcaccttttggtaatctggtaattccctgatctattcaaggatgacttagtttatcttatttggcttattactttgctatagtactaagtaactcctctttctttaaaaaacggaaaaaaccaaaaaagaacactagccatgtgacagtgctataaaactcccagtgtgcttttgtcaggggtgggtgggaggtgcctaattacccatacaagggcatcattcccactgggtatgcaggggcagaaccacagtagtaaattctaaaattatttcaagtatgttcgtataacggaaaatctcactggatggggccgttttaagaacgcttcttagtgatgatcctgtctgtgggacataaggaagaagcattggaaggcactattttgaaagaatgctgcacaggtatggcaacagccccaagcacattccttcctcacgagtcccaggtccagctttattacctaatacaagtccaacctctggaacatccaaattcgctgttccaaagtttaattaaaaacacaatttacaaatatttaatatcttctgaaaagcatttctaagttaagaatgaaaaagtatgtacataatatataatcaaataccaggcagcctcaacttccaccaggtccacactcagcaacatccgtctttttaggttcttcagtgtctgaaagaaaaagacatcacttaattcaacattgtttttaccttttaattaaaaaggggacatgaaagtcaagctgccatccagaagcataactgctgagagcccttcttcaccacatccaaggctgaagactacgcgcattatcaggtgatcattgtggctcttctgcacacaggaaatctttattaattctttagacaagataaaaagaaaactaagagtagtttatacattaaaaacagataaatgttccttttacagttgacccttcttatccatgggttccacatctgcagattcaaccaactgccaattaaaaatatttggggaaaaaacccaattaaaaaaatacaacaaacaatgaaaaaaatataaaaaatacagtctattaactacattctatgaagtatataagtagagatgatttgaagtatactggaggttgtgtgtagggtataggcaaataccttttatgttagggacttgagcatctacagattttgctatctttgtggggtaaataccaaatccgaggtcctgataccaatctcgggcagacactgagggatgactatagtcaccatagctttctgctttcccagagaaaacagggcacgtaccttctgtcaaatccacaaagttgttttccatgacgggggaaggaatggaaatccccattgcttttcgaactccatacgtgcttacgatatcacctggagttacttgctgtgcaagttctttaagattattggtcacttgttcagctaaaaagaaaaacaaagttccagatactaaagcatggttcctttagatagaggcatcccaaagaacagtaaatgtacacatgcaaagaaaacaaaac

SEQ ID NO: 13883 - DNA, 38705 bp, Human
tttattgggaaactagttcatgcagcagaatcatattcataagcaaaagtcattcttttaaaaaaagatcacatctactcacattccattttttttttaaatatatgccctttgtttcaaacctatgttttagagggatctatttcagtgaccatatagcctaacctaaatacattaaataaattgggtacttgctcagagaaagtactttatattccattcttttgttgaaagttttttttggaataaaacaaacaaatcaccattttaatagcctctatcaattaatgtgaaagaggaaaataaatatctaagatgaattctagtcaaattgctcttccgccctttcctggaatgaggaaaaacatgagctgcccttaaggcatcagagggtaaagagtaggcaagagtttggaaatgtcctatagtcaaagcctgtgatgatagtctgagtagatctccagaacctgaaacgcttatagctttctttttgtcctctgaaaagcttcatgctagagaccatgatgtcatctttaataggatgaggtgtgcttatggtatcattgatggaaaactatgagtgttaaaaaatatggaaacggaaggatgtcaattatagtctcatgctgatgactcaggcttattttactagcaaagggtcaatgataattttatggatatggagacagaacagctcattagtggcattcgttaataaaatagggcatgagcatagcacagacacagagaatgtaaggcatgcgctgtttgacattaatttttaatttaaatatacactcagtattgcagtaattctggctcggcatacaatggtgttaagatggtgaacattttcaagaatcgaaatggtgtgagtgtcagggttggcttttcacacaggattctcaggacatccctgaggaaacttaaaccaaataaaagggagcagacaagtttctcttttgtggtcaggcttacctggtttaagtcagtaattgaaaagaggtgcaggaggatgagtcagatgccttgtcattgctttctgaagagctaaaagaaacagcatttatatcttaatcttccagattgtgtgctgcaataattcatttagtttaagtgcacttcaaataaaaatgtaaattatcccattcttattcatttctcaccatgaactctggttttgatggtagtaaagaaggtgagaactctccactggatgttcaggagtccggtataggaaataagttataactctatttgtgaccagggatgttcttggagaaaatcagtaaccacatgtagcccacgactaggacctcaatggatgcatttcttatagtaactcaccctcgattttattattttgcagtcgccttgattccctaactttacgtacgtatgtatgtatatatgtatttttgtctctaaattatggcgattgtcttgtatcattgtcatgccagtaaattcctaaaaacacaagaccccaaagaatggtgcctcagatgactatgatgtctgaactgcttgtgggtgtgtgtaggaaattcactccagtagagtgtgtaacagtctccctggagtcaactttctgtcaggtgggcctcaggcagctgtgacctaaaacccagcctctgcggctcagacctcgctctgtaattgaccccagggcagggaccacggccgtcgccgagggcagcgggcagggcggagccggggccgaccgcgcactcaggagtgagtctttgtgcagtcagggcttctgctgggcagggccggctgttaatctcgcctggcggagcggacaccggggcgtggtgggggagatgggccttataggtggcgtccgctggtgagaaacaccttgcgcaggtaaaagggtggcggcgagagggagttcccacccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcggtgagtgtagccgcggccaccgctccggggaagggggcgatcgcctagggtgcagaggaaaactaggggaacggggataggtgggggtggcgggaaaagctggggtgaaggggcctctgggtggctagaaaatggagttggcgggggtgggggagggcagataggaagaggatcgcgacctgagagttgggatccccaagggaagggaaggtgtctccggtagatgtaatcagcgcactcaaggagaggcgggagcgggccgctttcgcccagccaaaatcgtggcccctgggtacgcgccggggagcagggtgcgccggggcgggagtgcgccggggtcggagtgcgccggggcgggagtgcgccggggcgggagtgcgccggggccgtccagctgcgcctctggcaccttccccgggaacgtgcggctccctgtgcctcgggaacgtgcggctccctgtgcctcgggaacgtgcggctccctgtgcctcagcgcctgcccaggccacggaaaggggaaccgctgggcggccgggacggagagcgagtgtccttgggtgaaaaagggaactgctcgcctttctgggaattgtttactctgagagaagggcggggggaagtggcgggtgggggaggggatcttgaccctttgctcctgaggactgtcgaccggcgagccctaggtgagcatttgtacagtttcagtggtttcttaacgtgcgaggcttcagttccctaaatcttcggaggaaggaagggtctttctgatttcttgtccccagaggcgactcgatttttctgctcaccacccgccccccgcgccaccgccccttgccccaggttctttctttctttaaagagcactacagcaatgaccctaccccttcccagagctgggagcctaagtggttggccttatttggggcgggacagcccctttcccaggcttgaccgatgggatctcgttggggagcctgaagacgcaaaaagccaatgccgggagcagcgtctggggaattggggatataaaaagtccgattggacttttcctggctccctggaagaggaaaaaaatcgacaggtgtggaaaagtgctccttgtcttaagcagaaggcgttgggcgccaatcaatcttgaaggacaaagggaggaacccggaaggctaattccttctgggagaagtgaactgggggctgaaatattcgtataatttccccttctcttccgctctcacttcgcagtagagttccacattttacaatcatgaattggtaattgttactgttattagaatgtctttctcgaggagctcaatggacttcaaacccttaactgaattctcagggcatattaataacatagaaagggccaagtacacagcagttaacattttacagatgaggaaaccaagaatggaataaataacggtcagaacatatgttgatgagtaagaaataaattttcattagactcctaataaaattgcaatttcttctaaaaccaccggccattctttaaaggaaaaggcatgcacagacgctggcaatgcgtggcattgctctgcatatacctgcagagagagctttctgtgtgttatctcagattctgtttaggaggaggtggggtatcactgaatacactgaaattgaatttccattccttgttcttccttagcttcggagtttgataggcggggagtggggtaggaagtatgctggccctgcctacactctcattctgctggtttttgctctgtgcacatctgtgcaaagccctgccaacctcacgtggctgttgtggttgtgagtctcaagtgtgagaaatgcgtaaatactaagtgtaagaaattattaagtaagaatgattgtagctgggcatggggtgcgcgcctgtggtccaagtcactggagagaggctaaggtgggaggattgcttgagcttgggaggtccaggctgcagtgagccctggtcatgccactgcatcccagccttggtgacagagcgaaatcctgtctcaaaaaggggggagaaatatctttggtaggagggtaggatcctttaccttccttccttcccatatacccaagtaatccttcaccattccacaaatcagcttttcctcacttcttaatgtttcttcagaccacacctggcttagccacttgaactctgtcttctgctaaccactaataaaccttctaagatcactggctctcctgtgctaaatccaaatgactcattctttatatggttccaccttgtagcttttgcccttattcttgacattcactcccccccgcctttttttttaatctttctgaccactcagggtctgactccctacctagcgtcttgtctttttcttctttttctgttgtctttttttggtttggtaaaaatgacataacatgagatctaccctcctaacacatttctaagtgtatcgtattgttaattataagcacaatgtcatatagcagatctctagaactttcagtttccataaccaaacttttatatccattaaacagcaaatccctgtttcccctaacctccgtcacctggcaaccaccattctattttctgcttctatgagtttgactactttttcctgcactcttaaatgctggtgtctcttggttttctgttctaggtcttgtcctttggaatctacactctttccctagggcattttatccacttttatagcttaaaatatcacacagttgccaacatatactaaattaatattactagttcagatgtcttcattgaacaatagtcctttgtatcactctactgactgtgatgtgtgacacagcatttattatcttcccaaacaatgttgtttttcttttagtgtcctgtatttcaatatatgtcagtaccatatgcctgttcctcaagtaggaagtctgaaagctgtttgttttttctttctcactgctccccttccttaatccatgaagttccattaactctacattcaaagacagctcaggggtctattcacttgtacctgtcacttctgctattacaaataatgtcacaatgaataaatttgaatgtatgtcatttcatatgtgggcaggtgtatcagtaggacagattaccaataatgggattgacaaataaaagtgtaaattaggccaggtgcagtggctcatgcctgtaaatcccagcactttgggagcctgaggtgggaggatcacttgagctcaggagttcaagaccagactggggaacatggcaaaaccccttctctacaaaaaatacaaaaattagccaggcatggtggtgcatacctataatcccatctacttgggaggctgaggtgggaggatcacttgaacccgggaggtggaggtttcagtgaaccgagatcgcaccactgcactccggcctggacaacagagcaagactctgttagaaaaaaaaaagtgtctaattttgttagattttgttcttccctccataaacattgtatatggctagacagaaagctattttatgatagatatcacatgatcgaggatatatatattggtgtaaagataaattgaatctatgcttcattcagaacaccacagaaaattccagagatgaaagatttaaatgtaaaatatgtttccctacagataatagaagaaaacgtaataaattgttatataaatttggagcccacgaggcctagttatgacttagatttcgaaagccaatttattacaattgagaaaaacaattatataagagtacatatatacatacttcttcatggcgaaaaaacacctctaaccaaccaaaaacacaacaagcaaagtcaaaaggtgattgataaactggaaaaaatattcataggtcatatttaaaaggctaatctaatacataaagagctcttgtaagtcaagaagaaaaagtgcaacatggatgtaacagtatccataaagtagtaaaatggctcttaagttataaaaatatgtcaacctcactcataataaaatatgaataaaaaattacattaaaatgccatttcacacttggcagacacccaaaagttcaacaacgtgcgatgtaggcaagtatgtggttgactcataaattattggtgggtataataaaaagttacaacttttagggactttacgcagtcatatctaatgcaaatacaaattgttttgcctcttcttttccaattcctgtgggtcaaatatcattctattcatatgccagtaccatattgatttaattgttgagattttatatgatttgtaatatctgctagggttgatagcctttcattgctttttaaaaaataattttcctatcttaattttttattttttccttatagccttttaaatcagcttgtttagttccagagaaaattttatggaggtttttattggtatcaaaaaatttgtaatttaacttagtaagaatcgatatagatacgttgttgatttttgtctttctttttttgcaagtgtacttttctgccctgcagaaatgttttcaggtttccttcaaataggctttacatgtttcttgttaaatttactccttggcatttcaacttttaattgcttttgaaaatgatttctttttttttttttttgagactgagtctcgctctgtcgcccaggctggagtgcagtggcgtgatctctgctcactgcaagctctgcctctcgggttcacaccattctcctccctcagcctcccgagtagccgggactaccggtgcccgccaccacgcctggctaattttttttttttgtatttttagtagagacagggtttcaccgtgttagccaggatggtctctatctcctgacctcgtgatctgcccacctcggcctcccaaagtggaaatttcttgtattatctgactggttttgtttatgggtatgaagactaaccatattttcatggttatttctgcttccttacttaagtctcttcttgttttatagtaatgtaatggttgatttgcttgggttttccaggtaaacagtcatatcaaatgcagagattttttttacatcttcctatctaatatccttctcttgcaaatataccttcaatataatgtaaactacatatagtgaccttggagagcctgtcttgtttctgagtttaattggattgcttctagtgttttcccatttgtgttgtgttataatttataaagatcacattgcaaaagtacttatcaattcttattttttgagactaaaaaaaataagaatggttattgaatttggtcaagtgcctgtcagcatctatgatggtgatcacatgtcaagccttcgttaaattcatggcttgaagtttctggaccaagcaaaagatgtgagtgtggatcacagatccacgccagggccagtttacttgtggctcaaatttgtaatgaagatttagcatttgggtcccagattaatgtggagcggatcctcttagatcttaggtgggccctgtgctttgatttcattctccttctctccagaggccagcaaagcagagtcaaatctttgcagatcagaagttgttcctgagttcctcttatcactgtgtgttccagctttatcttcagttttggcctagcaattgcttgctattttgttagctctttgatgctttaggatgtttgaaaaatgttatccctgatttttaattagttttggcataggtttttcttaattacctagcttgttattattgaaaatgacagttttttccattctccacattggacagatctatcacattcaaatataaagctgcttatttaatttatttgctccaagtaaatctttggtttctcattctcgttaggaaaaaagatccatgtgctttgctaatgccgttcaaaatctggcccacacccacttctttgagcccatgttatacctctgcccccgctctggtacacacatcaaccattccagatttcttcttcaggtctgtgccatctctgggccttcacatatgccattcttctgtttgcagcatttaagctctgcctcctcttagcctgtctcacttgtagccgctcttcaggtgacctcacctggcttttagatatcactattacctctgctctcccatagctccctgtacttccctatcattacatttgtcttactttgttgaaattacaaatatgtcttaccttagattgaatgtttcatgaggatcatgtttactgctctgtgtgtggtacatgatacacattcagtaaatatttgttgaattcatgcatgaatggatggatgtccaagatactgttattcaaagaattgtcttaatccaaccatttttcatcttctccaccattattaccttagcccaagtaaccattaccccactcttagattcctgctgtagtctcccaatcagtctcttggtttccactcttgctcttctataacctattttccacataactagtagagtgattctgtataaatatcagtttacgccactccacagcttcttcatcaggctgttgcttctctttgcactcagaacaaaatctgcactccttaccatgaccttttagaccctacatcatttgccattgactgtccttttgttttcttctcctgtcactcttccctcgctgtgctctgctgctatgaccaccttgtttctgcaatacacaagtctccttccagggtctttactctggttcttgccctacctggaagactcttccctggttagaaaactggtttacttcctcacttcatttacgctcaggtattctcgttgtcaccctctctccctgctttatttttgtcgtgacatttatctctcgctgccttggcattatgtgacatttgtgcatttgtgtatttcttttgcttcttattatcatgtaatcttcgtgaggcaaggacttggctttgttcactgctctagccattgaatccgtttagcacctactaagcaaccagtaaatgttggttgaatgaataagtgaatgtattcttccaatcaccttgagctggaatcttcagaatcatctgattctactcctattctctcttggctatgcagccagtgaaaattcttcatatcatttaatttccagttcaaaactaatgtcttcattgtgtctatcccaacattccaaatgaaacacaacctctgccttatttgatccttcaaatgtaattaaaactggataattaaagtctttaatatatattaaaaataaacatttccatccaaattttgatgattttagtttatatttataaactttgtaagtaacagtgtaaatgctagttaactgtcttgcttttggtcaaagatgtttgtaaaactagaaaaaaagaatgtgaatctttgagaaacatccattgtaaagtttcagacagaacaaaattaaatttcagtgtgtttacgtatatgttgcattggacttggttcaccatgaatcactaaaccattgaaaaattttaagtaaattattttctaaaatgaacttaacttttatttatgagaagatacaccttcaaaataattttatatttcaaagttatgtgcctattgtgtggagtaacacataaatattctccaaatcacttcatggcaataagttaatgtttgtctttaaaagcatttactttttgtttaggatattattgatttgatatcatatctcataagcaattaaaaatgtactgaaacagtttgctgcctcagtaaatttggttttctctttcctatgtatatacctgtgctgccttcctgatagttttcagcactctcccacctaggctgttgttggatcgtcactgtacccactgagttaatcagtgaagttattacatacgttttacaatatagtaaacaaagctgaagagcatacataactctttgagtttacaagctttttgcaggaggaagctagaactcagtatattgttttattcttctccttgatatatttttgtcctgatttctttctccaatatgtttttattttatctccaatattttatttatgttttatttataataacataaatcacatataattataaatataaattcatgtatttatatttaattaaatattttaaaattaatatttagtgtagtcaatatgtaatataattaacatttatataagtattatatgcctttttatgtgtatatcattataaatttataatttatataaataatatacacattaaagttttctttttatgcataatatttatttgattttttttcattttttagatcttaatatttgccagtgatgcctgcaaaaatgtgacattacatgttccctccaaactagatgccgagaaacttgttggtagaggtaaggaagccctaaaatttgtaataaatcctgttttgctgtggtacatatacgccatggaatactacacagccataaaaaggaacgagatcttgtcccttggaagggatgtggatggagctggaagcaattattctcagcaaactaacacaggaatagaaaatcaaacactgcatgttctcacttataagtgggagctgagcaatgtgaacatgtaggcacagagtggggaacaacacaagtggggcttgttgggggttctgggagggcgagagcatcaggaaaaatagctaatgcatgctgagtttaatacctaggtgatgggttgataggtgcagcaaaccaacatggcatgtgtttacctatgtaacaaacctgcacatcctgcacatgtaccctgaaacttaaaataaaaacacacatacaaaataaatcctgatttgctgtggtattttaaaattagtgtaatttttagaatgataactctgttgggaccagtagataaaactaatgtagtatattatcatttgtaatatttgtggtgtcattctaatgaaaggaatattgttatttttggaaaacatgattatatgaagttgataaaaatatttcacttgagtaataattattaacatttactttagagaaaagataaagacatttaacatgcctctaaaaaattgagaaatagtactgaaactgttttttttagtttaaagatactgtttttggatttttattcttaaatatttcactctgtattgtatttttttatcaattaaattatttcacataattctgtaagaaaagatcaatccaatgatagcataaaatgtgatcactgtttagcaatagatgtaaagaatttagtaatattttcatttagtaaatgccaattttcatctgctagattctgtataacttcaggtgtatttaggtgttactctatagcttatttctgttgataaagaaaaaaattgttttggttttggtttaaagattcaaacactggagctcacatatgtttacttcagagcaaatgtctcttctttaagagaatgttaagtaggtattagaagtgatgtaagtatttaagcacaacttaattcaccatatagttttatgtgtcctttcaaaaatttacaagtgtcagtataatgaattttaagtttttggctctccccacgtgcatacattactgttaaaactatatcctatgttttactttaaaaatgattgctgtgcatattttctacagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtatacaaggctacataaatgaagaaatgatatcttttcttcagacgtaatcaacattaccagggaagatatgaaatcagaaaggatatggtatagtttggcttaaagacgaatgaaaaccatgaggcaacttcacagtgtttagaaggaaaagggctgtgtcacatggttcattcgggttgtcattccttttcatttgggacgtaaaaggagaaattgggataaggtacagcatgggaaagtgagattagacacaaagcagcattttttttttgagctttaccgtagaatggatttctaacaacaagttttgaaactctgtataaagaaaggaaagcttttttctcgcattcattttagcataatctgtggtcttaaaacatagataactattttaggaggaggtttggaccacatgcatgctattgtgttgtgacacccaagatcaaaataacttgtattcaaccattagccattcctcactgcagcagtttgagagttgtcaccgtgtttctctcctcattctgacacagatctctctgttggttccctggctctgcctagttgctggtgagtggaagttgcttgtgctaaatttagaagggcacatacacacttattttctttgcatatctctctcccatgtttttgcatggcaatggggcaacagtaattttttttcagttttgcttctaggcttccagttccatctctctttcttccatatttccaccaaatcattttcccaagaggattgttgtgataacagttaggacagttacttcttcattatctttttgcagtgttgatgattagtttggttttcaagcactcccatggtctcacccctccccagctaatcctcctgagaggagaaagatgtgtcattgtttaatgtttgagaataaagtagtcattgactttattattttttcctgtcttatgaattgaggtcctaaagaaaagacatactaaagaaaaagttctaaggcgcgccaagagaagatgggctccaattccttgttcgatgctagaaaactccttgggtccttttccacttttccttcaacaggtaccgttttctttctttctgctgtgggagtctatagtttccatctcttaccattatgacactgagtatgaagttatttgtaatagttgtgtataaatatgtgagtgaatgagtatgtgtataatatgtttccatataagggtataaatatatctctttatacttgcatacacttttgttcagcttgcaaaggccaagcataaaactgtggcactcagacacatggttccttaatgaattgtcacatcagcaagggtatcgccaagcctaagaatagctagaaaacccaaaactctcttgcataataaaggagaaaattggatgaaagaccaaatgccacgaaggaggaagacacataggcccttctatctttctatttcttgttcttgaatctacatctgaaatcacactggatccacatttctttctctctctctctgtctctgtctctttttgtttctttttttttgtagcgatgagatctcactatgttgcttaggctggttttgaactcctaggctgaaatgatctcccatctcaacctcccaaaatgctgggattacaggcatgagccaagcatacctggctctttttctctgtcttgttttaactttcagtagaaaccccagcaagccttcttgccttcttccattactggtggctactacattcagtctatgactttggtttattttccctcagttcttgacatagcaagggagaatcctttttataccccaccaacaaatttaatacagctgagagaagagcatattaaagttgagaaattgttagaaaacagttgtgtcagttatcctgatataaagataggatgttactgagaggatgaacacagcttggaggaaatttgcttttcgaatcaaggatcagaatattacacattccaaaatattattccatttctattctcactcatatttttttttttactcagttcctataaggaagatgttggcaaagaacaaaaaactcattaaggaaattattgtccacatttttgccctgcagacagtacactttaaactcggttcttaaatgttatgttacatataataaaaactcagttttttaaaacattgacgacagaataattttccatgctcagaatactttgttttctaagacaggaaaagtcttaagtgttttttccatgtatagacaccatctagcctgtcaaatattcctttagttattctggagaactaagatgcactacattattttactcatgccttgctcttgaaatttctcaattggactttcttattctattgctgttttaatttatatataataataaattaagggcaattatttaaactaataaaatggcaatgagatttcataaatatatagatgaaagctctgctgaaataaagatttgtctcatgtatataatatctactttctaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgaggtaaagtctaaaatgtgtgtactgtattagcaatgatgatgcttggccattttgtctctcatttgcaattcacgtaaccttttctgctttctgagtttgtcaccaatgctctggctactccctaatagcacataattgacttgaaacaaaaaatattttcatagaataaataatattggattccattagattgttcctggtattatggttttactatttttttttcccccacaacagtaccactttgaagaacagttttttttttttttttttttgagacagcatctcactttgccacccaggctgaagtgcagtggcgtaatctcggctcactgcaatctctggctccggggttcaagtgatcctcccaccttagcctcctgagtagctgggatcacaggcacgcaccatgatacccagctaattttttgtatttttagtagagatggggtttcaccatgttggccaggctggtctcaagctcttgacctcaggtgatctgcccatgtcggcctcccaaagtgctgggattacaggactgagccaccgtgcccggccaagaacagttacttagttggcacaaaaagatctgtgaacctctttatagtatggagatatcataggaggtaaatgaagttcagtcattaagtaaacctcagtaccctggcaatgggagagcattagtttatggggagcaggtagggggtgtgacagtgcttacctaagcttactcagtcctttaatcatctggttaatttcctatgctggaaagtgagttaatatgaaagaatttaacctaatgctggtttgatttcccaacaggacttggtcattttgcttaagtcagttttaattattttatgtctattttggatgaattaattattcattagaagaccaaattaatcaaataagacaggcaagctttgaataaagtatttaggtttagaattgccatggcctggccttctgagtacctaggatgttctggcctttctatgatagctgttatgagaaaattggtattgaaattcatattataaaaacaaaaaaattaaactgtattccaccacagtttaccaccattcatttgtttcatttctgattcaccctttttaaattaaaaattctttgaaaagacttacccaaatgtaaccattgatatgcctaaagtcctcattagtagaaaataggataatatcccagttaactgtacctgggtaatcctacaggatcccaagttcagaaagatccagaaagttgtatttaaaatccatgcacctgaacctttcaaacaaagcaaaataaagaagtcttcaaggctgtttgggaaaataacagtaaaaattgttacactcatgaataacagtatagcaataatgaagaaactaaaattatctttcataaatttaaagagataaatttaaacatacaatgccatattgaatcatgaaattaggcacctctttggcattaaaattatatccatatcccagaacaataacaaatggtgagactcatactgtagttctgaacagtctccaagttaaagccaaaatgaatttgaagcatacctcattttaaaagattattttcacttttctccttattttactctcttcacagataattgcctttgcaacaactccagatgggtatactccagaacttccactgcccctaataatcaaaatagaggatgaaaatgataactacccaatttttacagaagaaacttatacttttacaatttttgaaaattgcagagtgggtgagtacctccttaaacaatatatggcaaattaactgtgtttcaattcatacatttagtttcactatgtccgttgagaagcagcgtatcccagcagcaagaataagggactctgggtggaattttactctgtgtttcactagctgtgtgatgcttggcaaatttcctaatcttggcaagcctaatttcttcatctgtaaaatgggttatcagtatgccagattgttatgaagatgaagtgaagctcaatacacagcgaatgccaagcacagtgcctgacaaataggagttaataaatgttatgctgtcatcctatggatggatggatgtaagagaacatagcccaaaaagaataagtctttcactaattggagatgtagtcttaaagatatgtacggatgttctctaggattaaatgtgattgccagtattctgggcacgattatgaaagtcactgagaataatacaaacattttctcagccctgtgaaaatggtctgttttaactaaaagtcagaatgcagttttggagaccttgtctagaaatgtctaagtgaaccatgcagttttagagaaaactgactcctatgatcaatctaagcacaagcttacaaacagagaaaagttatagaataatcagaattgtttagtctgaaaatacatggagggatagtatcaacatttataaaatcatacattaaatacaataaatatgaatatgatcacccaattcgaaaatgctagtatgccagaatatttgaaaggaagtgatactgtatggagaggtctgcaaatttataaaagccatgactttgccatgtaataatgtggtccagaacttttttgaggtgggtgaaaaggaatgaaataaagggaacatagaacatgtgaatgttttggagattaaaaaggacttttcttctctaggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagaggtaacataaacattaataaaacctgattataacgtggctattcaatagtacctgtataactcctgtagatgtgtttttgaaaagtatgttgtgaatctcattttagaaacattattattttatgtatgttaatagagatcactaaataaccttggagtatgctggttttgaactgctaattcattcttttctgaattgtttgtttcatacaatcagatttcctgatataaacatatttacagtattaaaacaaaatgtcaaatatgaaaagtgaaccttttaaatatatgcagaaatttgttatcttttcaacaatctcatctacattctacctcttacatagatgaaaagacagtttatgtctctctaatctctggtttcccattttcaatcaactgctagaaatcttgatttggatgtctgacaggtacttatgatgtaataaatctaaaatttaacttgtcttcttttcttctaaacatattttccattctatgttttctagttaaaaagatatttatatattctttctctattaatcattttctattgtcaccttggagtcatggtctccaaattgtatttgatgtctcttggcccccctgaatcacatcacttcctaaagcatgtttttacctccaagattgttttaaatctatattctgtctctttctactgcaataccctagcttagtaattcattcacttagttattcaactattacctcctccctgaagcattattcatctaaattcttatagcagtttctgtgtccttatttactatatttataatccttaatcttaaaatatagtaatagatgtttatcaggtattttatttgattcttaagtcttaaatcttcagattaattttctcttccttcctctatccctcatggattagggtagtggttctcaaaagctttggtctcaagaccaatgcttgacattattacatattgttaaatattgttgaatactgttaacagtgttaaatattgttgaaaatcccaaagatcttttatttatctaggttatatttatctatgttacttgttaatgtttaaaactaaggaaagtttaaattatatattaatttaaatattaaaaataataaattaattacatgttaacagttaaaattcttataaaataacagtaaaaattgttacactttttcttctttttgtacttacaaaataagtacattttccaaaacagtacaatttagtgggaagaatgacattgttatgcatttttccaaatgtttttagtattttgcttaagacaggtggattctcatatctccttctgcatttagtctgttacaatatgtagttttagctgaagcatatataaaggcaatctgacatgatataaaattagaaaagagagtagtattttgatgataattacagatcactgtggatattattccttgatactacatgaatacttgataaggagtagcttgtttcctaaatgtttttggtaatgtggactctgaatcctcaacaatgaccttttgtactttattacgttaaaatccattgctctatcttacactttgagtgaccattttaccagtacatcattctatattgtgcattggtcatttggaaaatattggttcaccaagtaatgcagagcttccaaatattgacacattgcattaaataatatcaaaaagatcacctctttacttccattgatatcacattggttgataaaggttttccaagcttctcatttttgtttgaaatctccaatttatcattggcaacaaatagttgttttccctgaagtgacagattaactttatgttttacaaaatactttcataaaactatagtctgcatagccatagatgtctatgtgaaaatagcattctatggaaaaaaaaaaaaagcaaaaactcaacagcttgttcagctcctaaatcaaacaatcacagaagtgcttttctttgaatagattcttctgaaataatcagttgaaaacacttgtccagtgaaggtgtttatccagtggtgctctctagtaactttttgacctcaggattccggttttcttcagttgcctacaaccttttagtccctttaaacatcagaatttctcttccatctgaagatagcataagttaatacttagggtatcaaacttcatttccttgtttcattagccagttaattatttccaataaattttagttcactacaaacaaaatatgtattccttcttgaaagtacagtagcatgatgttttaaaatttttcagttgaaataaggccattatttttcaagtctacacatgtgattggttatgagggaggagtaaatctggaaaattatgtgtgttaaaagcaggaagatcaagagaaactttagttttattttagataatgcctaaggaaaagaaagtttcagagatgatggaattaagggaagaatctttgtaagagaagggtgaacattctaggtagaagatgaggatagattttaacatgctattttgtcttatgaaaagagataaattaggtaggaaaggtaagcatcaccatcttatagaagaagaaacctagacaaagtgaattttccaattgcccaagattgtgtctcttatttttggagttggaaatagaacccaagtctcctaatgctcagtccggaaagcattattactgtattgtttttaattctcccatatctcaatcacttatgataaatgaaagttataaggagaaacactttaaaatatttaaatgcttcagatgtttaaaaatattttttaaggtagtgatgagttttcaacaatatctgataaattgaaagccttaagagccagattctattttccacagaaagaaaaaaacctacatagccccagacctttatcttcatgtcagtttagatgatctcttaaatgtaacataaacccttaaaatctatattttttgcaggaagaaatttcattttattgttttgttaaaagactattttaagagtcattgctgtctatttttttgaacataagaatgtactttggctaggagataaaggttttgattaattaccaggcaattttaaatgcacttgtggcaaatagctcttctttttctgttgaataaagacaaaaccaattgaatctatattctgtaagttaatagcactataaatttgagaaactattcaattttcataaattgattaaaaattcctagtgtgattctcctgcctcgcttgaacccgggaggcagaggttgcagtgagccaagatcacaccactgcactccagcctgggcaacagagcgagacttcgtctcagaaaagaaaaagaaagaaaagaaaagaaaaattactagtgagagaaaattcttctaatacacgaatgctgtgaaatgtaataatgcacttcttaaattcttagtgcaaaaaaattatggagtgtaaagtaagatttcaattataatgttggtgctttcccccaataattaaattctttttttgttttcagttaattgacaagtaccagttgaaaataaaagtacaagacatggatggtcagtattttggtctacagacaacttcaacttgtatcattaacattgatgatgtaaatgaccacttgccaacatttactcgtacttctgtaagtgtatgatattaattaaagaaaaatgtatagaccagttttaattgtttaatatgcacatctctggcctggcgcagtggctcacgcctgtaatctcagcactttgggaggccgaggcgggcggatcacctgaggtcaggagtttgagaacagcctggccaacatggtgaaatcccgtctctacagaaaatacaaaaattagccgggcatggtgacaggcacctgtaatcccatctactcgggaagctgaggcaggagaatcgcctgaacgtggaaggcagaggttgcagtgaaggaaaagaaaaaaatgcacatccccatccacccctcatgatttcaaatgaagtgccccagtgacattaaaagttgtatagtgctagggtttcaaatcatgtaaacatagtactttggaaattagaagagtaggatttacttcacatcgtgttcaatttttgtgagagttactaacgaaattttttgtttgcttttattattttagtatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaaggtaagaataaattagaacattatttgtagtttataatatcatagaatagcatgctagaatttaatggaaagaaaggaattctgataaatgtagaataaaataggtatataagtaaatgcaaatgctctgttcttcatatacaatggaaagaatatattagtttttgataatcttttgtttaggtatttttttttttaaaaagtccatataatacaatatctattttgtaaccaatatctttaaatggttcaaaaactagcacagctttgatgcccctgggacagtgccagacttttcctagcccagtttttctgtgtttgggtcaaggagcctttatttacttactgaatttcccaaatcaagagttactcttggtcagccccatggagaggttattcataggtttgttcatcatattcagtatatattacatccttagcatccaggttcagaatgaaaatcctcagtgattcaacaatgcaaacacttctaaaacttctttctaatactatttcagcagccagagttagtgcataaagcaatctgagctcctttagccttggacaaatttatagacttatttctgctgcatctttaaccagaacatggttttacagtgggtctatgccgttttctttttgtatatattcacaaggaccatggattaaaaaatgatgaatccattttccttacaatgatgaaaatcagctgctgtttttatattattttctctattttaaaatagcagagaaatttcctttaaatcttgtctctttcttcacctaacccctcccctaatccttggtattctcagaaggaaatttgtgtgaagtccaagacctgaaaaaatttctgtcttctagggcatggtttcactaattctcattacaactacatatcaggcaagataaaataaaaccttttattaaatatgttcccgtctttaagacaggaactggaatggaagacacacataaaaaaagaaaatatgatgcccataagctttgtattttcttgtcttgctcctcttaaaagcattttaaaaaaatttacccatttttttctcttcctcataccaggtacaaataattttattcatcttaggagggtaagacaagctgtcctaaaatttattttgtagtaaataactattgtttatagtatgaatcccctaaaggagtatctcatgtattaatatccaagaaccctcattaaatactctctgaaatcttcatcaatacctgttatactacttatcttaaatttgcagttgaagaacaattttctgtccttttttttttccagctttacccaagtactgaatcagtgggagaactcctctgtctccaccaccactgggtttctgggtgtattagtctgttctcacattgttataaagaactacctgagactggatagtttataaacaaaagaggtttaactgactcgcagttccacaggctgtgtaggaggcatgactaggtaggcctcaggaaacttataatcatggcggaaggcaaaggggaagcaagcccatcttcacatggcaacaggagagacagagcaaagggggatgtgctacacacttttgaacaaccagatcttgtgagaactcactcactatcatgagcagtggggaaatccacccccatgatccaatcaccttccctcaggtccctcccccaacattgggaattacaattcgacatgagatgtgggtggcgacacagagccaaaccatatcactggatatatgtttcatattctcgtggttattcccaacatgacacttaacatatttccaaatttaacattatatatactcgttagcattgccaaatattaaatgagttcatctgatttttcaatacatttgctttcgtagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtacttaccattctattttagttttaaaatatatagcttattttgttacgttattataatttagcatatgataaattttattattttaattcatcattaccaacaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggtaagaatttgtctttaagccagctacatacttccttggctacatacatcttcagtgtttaagccaacagtatacattttaaagctgggtacatgcactctgttttcatatctcttgataatataaagtaagaggtttactataatttattaactcatgtctgctttctaatagccttctcagttttagatgtaattataaaataatttactcttagaaacacttgagaccataatttattaaagttaaaattattaaaaattgagaaaattattttagtaaaacttgtttcagctgggtgtggtggctcatgcctgtaatcccagcactttgggaggctaaggctggaggatcacttgaggtcatgagttcgagaccagcctggccaacatggtgaaatcccgtctctaccaaaaatattaaaaattagctgggtgtagtggcatgcacctgtaatccgagctactcgggaggctgaggcaggagaattgcttgaacccaggaggtggaggttgcagttagccaagatcgcgccactgcactctagcctgggcgacagagtaagactctgtctcaaaacaaaaacaaaaacaaaaacaaaacaaaaacaaaaacaaaacttgtttcagtttatctacttatttcgcttaaagtgttcactttgtaggaaagtgagaacatacttacatagtgcagtcctggaaaacatacttacacagtgcagtcctggaaaacagctctaactttttacaggaagctaacaatatacttgggggttagaattctgattaaagacattatataaaaataaatcatggtatatttatgatcatggtaaataaatagtatattataaaattagagagacaaacactatgaattcatataatcatataaaatgtaaaattatgttctgtgcattctataaaattgagagaaatatgagtatgatgattatttatgagacgcgtttggtgcataaaatataatttctataacatgaatttgaactttatgtctttgtaaaataaatatgctaaatataacaaacaaattattatactataacttgcaaaattagaatttagaagtgattttggaagatgatttatgtattccagttctctgtaaattaatgagaaatgactcagtttgttaaattgctgaagttgtaatcattattgatttgtctttaactaattaaagactgtcctttaaggcctcagattctcatgtctttttgccaagaaatacttgttggtcaaaggcaaatgaaaagaaaaaaaaaacatgaaactcaacggcacttggaaatagtttattgacagttgagataaaaattgctgtctgaaattagaaattttgcctataattttattctacattctcgtctgttgcagaggagtttaagtgattgagagatcaaatatttgttatggaattgagatggggcactgcttatcatcattgtgatatagaataaatgtgtaatgaggctgttcgcattcatttcttttgaagagggtgggagtcattgtgttactctgtgtgagagaactgtgaatcagtaattccacatgtgtttactttgtgaattgaatgaaatgagattatacaaaagtgtgtcattttttgaaaaacctttttctaaaatctatactggctaatttcatttgggttctccctgccactccctaatggaaacctctcctccctcatggatactgctgtcttgggctggtgctcacttcctgccttcctacatctccgcagcaattgcttcctctttttaaaactctctctcaaggcttctatgtctaaacttgcccacacattcctgcatgctttctggtcttaactgccttcccctctcctaaacatatatatttcttaagctttaaattcaatttatcttttcttcttaacttcttaatctaaattgtgtgggcagctttacccagaaatcacctctatctagttgagcttgagattaatgtttctattgtattattccagctgttagaatggggttacttgcaactattttaaaacatttgactgaagagcatcatgcacataaagcatgaaaccatggatagtgcacctcatgtgacttcatatttggaattagcctttgtccatgtagaattatattattactagaagatgagcattttatgctgacattccaatgaataaaacagtatgtataactcatcagcatatgaaaaacagctatgaaacacagtggattagatatctgaggtcttaaatgttcttctatgacagtattaatcacaatgtgcaaaaaaagattggagtttaatcagtgagcaactgtaaacatctactggaaggaaattgaagcatttatcccagttgtagaagagcaagcactatagagttcagtttttaaagatagcacaattaaccagattcaataggtaaggcatgtgctctcaattgtgtgtgtggactcaaagggaaacaaatgttcaagacaaccagcagtcccaattttcagagagagcaaggtaacaccacatagcatgagaacaggagaagttgagggacagaaattattctgctctaatgaatagaaacatatgccagatacatgaaatatatattatccacctgcttcctttttctaatgtaaatactctttttcaaagttgtccaaaaatggaaggtagttgcgttgtttcctgcttctcattgttttctctcctagctcttttttcttcttgctgaagtacatcctttactatatttttttcaattgtggaatgtgaattttaaactctctcagttttgttgttctgaaaaatattttaatattggcctcatacttaagtgacactttgacttggtttaaaattctgagtcaacagcttctttcccatggcactgtgcagctattaacccattatcttctggtatctcttcttgctgatgcttcttgttctgtcgattaacgattgtccttttgtagttaatatatttaggtagcttttatagtaccctaaattgagttctacagtgttagtacaatgtgtatgccgtggatttttttatatttgtctagttctgcagtcagaaaatactttcaatctgaaaagccatgtttttctttaattctggagtattctcagctattaatctctttaactattgcttctctgccattctgtctattctcttttttagaatccctggtaggtaaatgttgctgtttattttctactggaatttgagctgtaatttcattcttgtttaattggttacccctctttatgtctttgaagattctaaacatacctgtttcagagacgtcttggatagaatgaattaatcttttgactggtgcttttgttggttttccttcttagtgttaatcttgattatttgggaattttagtttgcaggcttatattaaatgagaggtgtttgctttgctttctgtttttgttttttccctctctcccactttgcccatattaactactagtcttgtagttgccttcacctgctctttctctgtggcccacggtttagaaccagttcttaacttggtggcctagtgctcctgacccatgatgacgctggctctatcacgagtctagttgctgtgctgcaggtgctctggctgaggttgtgacttcagggatgtgctcggagatcttcccgagcttggcagcttcatataagacacagccccaggcagtggatggcacagggtttttaaattctgttttccacctgtaatgtcaaaagccttctttttaaacagaaagaatgaatgatttagagacagaactcctgggtttgtgttcagtttcagacttcacaactgcattactaatctgtggcgtgggtccatggctgtttcatctttgaatcccccagattttccagtgcagtgctttatataaagtcgtcatcctgtaagtttctttctttcttttcttttcttttctttctttttttcgttttgagatggagtttcacttttgttgtccaggctggagtgcaatggtgtgatctccgctcactgcaacctccgcctcccgggttcaagcgattctcttgcctcaacctcccgagtagctgatattataggcatgtgccaccatgcctggctaattttgtatttttagtagagataggctttctccatgttggtcaggctggtctcgaactcctgacctcaggtgatctgcccacctcggcttcccaaagtgctgggattacaggcgtgagccactgtgccccgtctatcctgtaagtttctattgaatatacagatagatgaattacttaggctacaacccacagtgattatttcagttttcaagtaattttctactcctggagtcttctgccctttgaatattcccatgtactatttttgttacaatctttcaaatatgtaacttcagtttctttgctccaaaacctaagtgctacctatttatccaacaaactctaagctccctagtctggctttcaaagacccttagctcctgcttccatgtcagtttctacctgtctaccttccctgtcattgtctccagatcacgggtgtgtataacgtgcgtttccatctccttgaatttccttgtgcttttaaatataccagaagtgtcctcattcatactctcttccttcctcttctcacaaatcagccaaaacttgcctctaataataatttagcgaatgaataaacacatcttaatagcagtcattgtttgtacaacccatatgaaagtaatactatttttcttgtaacattccctgaggacatagcttgtgactgcttgtcattgtaacttctacattataggtgcttaataaatatttttcaatgtgttcagtgcatacttttgtggtgaaaactcaaaacatagaaaaactatttttattttcatttttctaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatggtatatatttttgaaaattgctttgtccttttcaacatcaggatgtctgcgatactttttttttttggtttgaaataggagaaaattcaccagtgtgggaaacaccaatgaaagtttctcagtttttgtgtgttgggagtaggtctctctagtgtgtctctaatcctatgccgagattcccttaggtgtgttgtgaattctccctcctactccaaacacacacacacacacacacacacacacacacacacacacacacacattttttctctttctctctttctctctcttagacttggtctaatgcagtcatttcctaacttgtgtacctctcactggcatagatttctttatagtttcctgggtcataagggagtcctcatttgttactggttggctctccagaaagcagaccctgaggcagggcatctcaagcagaatgatgactaaggaatttgcttgggatcagtagctttgaaaggaggagaagtaggattgggcaaaaagagaagtcaagctgcagcacaagccaaatgacaacctcagtgaaccccagggggagtctgagctaaatgggccttcagagtggtcctgaatcgatcccctattctctcttattgttccatcagtgtatgtgggctgcccatggcaaaaaggcacaatcccggaaggtgctgatggcctcccaagcagctgggatgcaagtccttctttgaaaagggatcagatatacaccacagtgtccaccacgttatctctcctctctgccactgtattgacttctgactatttcatgtctattgtattctccttgggattctcccctaactcggttccccatgtgtacttttgtctttagcccagaaggatctacagtgataagtatggcaaaaatgaaggcaacctgtctacattatcaccactgcctcattccctagttggcccgtaactcttcagcatgttccccatctcctgctcacactgcctatggaccatgatgtcatggtctaccagctttcgtgactctagaaccactgaatgaggcttgctttttaaatgcccttgaatgtttttcagccccatgctttcagtgaatatccctcaatttcctgttatgacaaattagaaaagaaaggttatgagggaacgtaaagggagaacaggatggggaaaagaaagatgaagacttatagaaataagctaaactactatgtcttggatcctgctctgtgaactaacaagattttcagctttctaaacaatattctgttgtgtgtgcgtgtgtgtgtgtgtgtgtgtgtgtgtgtgcgtgtgtgtgtatcggggttatcagtttattttggggtggggaggaagaattaactttattcttagatttttttcttttctacttatttggtgtcatgatattaatttttaaatagtgttgatagaaagtggacatttttttttcccaatagtcttacttagcaaaataaaactttggcagctgtatgtttgtcaacatctttgttattttaaagatgtacttgtctgagtaatcacttataagcttgggaaacacccaagttttaagaagaatataccctaaagaggctttgaagtcagttaagcttagtgtcaaaaacgctggttcttccctgtttgttagttaagtaaatctgaccgtgctatttattgtctttgagcatcaatttactaaaatgggatttttgggggagtaaatgagataatgcatgtaatacaccatgacacattaggaattataagttttggttttgctagtctcattataattttttacaaaatagacttaacaggttaaccatggcttctcttaagatggacttaattcaatgtgtttttacccaagcattcaaatttgtatttagagcttcaaatactatgcagaaaatgagaatgtcatactgggcagctatgtgggagagggattattctatgggacctggtatctgcatttagagtagtagtatatctagtctccaaaaccaagattgtattggcttctaaattttttttagttttttattgtttttttcttcttctaaattcaagtcatacaggtaatgtactgttgtcgtaataaggtttgagagacgtgtgtctcacacatgagcataaaaaccctatcatcatgcttatgcaccataaaagccataaaagaatctgtatgggctttcggttctagatattttctagcctttatctaagaaaactacatcaaaactaagacacgtgcagttggtccctttgtcctttaggaccaggagatgcagctgcagctgtgtgactcatgacctgctaatgtagtcactgtcaggggtgttttaagttgtcagaattagtctctgacagtaagtcacaagtatttatgtttatttggcacaatttttgaaaatgaagtaaaggaaaacatccagaatttcagactattacttcgatgaagcatgtgtaaaagaaaatgtacactcactggtttaattaaatattttcaagatatggtaaaaactaatctattaacaagtctattagttgtgataggaaggatttgtttacacacaaataaaatatattattacaagagccaaaagactttgtttaagaggcagcatagacaaacttttatatgtaatatgtttgcaatgggtatagattagaactactctagccattcacatttagaatcttctagcagctatgccatcccatcaggaatatctgtttctaggaaaatataactatctgataatgagttatttatgttcagaagaaatcagtgacattgtataatgtttggttttatttatttatattttcagatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgtaagtcttaagtcctttcttgaattcaaataataccctttaaagtaactttcaagacactttttgttttttgagacagagcccaggctggagtgcagtagtgtgatctccgctcactgcagactctgcctctggattccagtgattcttatgcctcagcctcccgagtagctgggattacaggtgtgcgccacaatgcccagctaattttttctacttttagtagagatggatttcactgtgttggccaggccagtctctatctcctggcctcaagtgatccccccacctcggcctctcaaagtgctgggattacaggcgtgagtcaacacacctggcaactttcaagacacattctaagaatcagtgctatttcctatagctgatcatttgcatgtagctgtatttttatttaatatataaatatatttaatttacatattttaagtgcatttatgtatagttctagtgtcttagttattatagacataaaattcaatgtagaaacagaacatgtaacataattatagcatatctgtttaaaagtttaagtagatatgctatttaaacttttaaatagcatatctatttaaacttttctattgtatactgctttgacacaagcaatccaggaaagctgtcttcttttaatatacacttttaagtttatgatttatgtgtgtattaaccattgtacatttataacttcatattattttatgataaactcaagtatatttctttcttcctccaggcatcctgtttacgctggtctgtggggcttctgggacgtctaaacaaccaaaagtaattcctgatgatttagcccagcagaacctaattgtatcaaacacagaagctcctggagatgacaaagtggtaagtagtctggctttttaaataaatacaaaggatgaattcgcttataatgcgtattccttctaaaatgatcttttctcagaaaagttcttttggtatcaggcaatttaccatagaatgtcatgggtcccctgaaacagataaaatgactttgatttacatgatgatatatggtatttaaatttggccgtagtgtgttacttaatagtaaaaatgcttgagtatgtcattgttatttttacttcagatgattcatggtttcaactttaagccttgtcttttgtatatatttcaactgctgtttgtgctgtaaaaatgctgcttttaattattcacggtttaccaacatggttttacattttctggcaacaataaaatcactacaagccttgatcatcgtgggaagaactttaatagattctttctggctctaatatgggttaggaaacagcctgaggccaaatatatgaaatagcaatgctagcaagtggtcatttctccaactttgctttctagctcaatatgtggaaaaggaacaagtaaataccctataagaagtgtaattgatgactagggcaagaaagatttagaaaacaaaagcatgacagtatccaggaaggtaatgaaaaaataaaatttaaataatattagagtttccaaaaatgcaacataaataactagtggccaaagctttggtgttcttgttattttccctgcctagtttattcatatatatttagatggcaagggtttaatgttgcagttaagatttttatggcaattatagttttattctttttgatttagttgaagtataactgaattagatactaaatggaaatattgatcattacttctgtttctgctttagtcaggtaaaagggaattaatttaaactaagcagagtaagtatatgtgagacaacagtgtttattttgaggtgtgagatgtaggaaggattgaagaattagagttgtacagtattctaagaggctttttttttttttttttgagacaagatctggctctgttgccaaagctggagtgcagtggcacaatcacagctcactgcaagctccgtcttccaggttcaagcgattcctgtgccttagcctcccgagtagctgggattacaggtgcctactaccatgcccagctgatttttgtatttttagtagagacggagttccaccatgttggcgaggctggtcttgaattcctcatttcaagtgatctgcttgcctcggcctcccaaagtgctgggattatagacatgagccaccacaatgggcaggtattctaagagatttttaaagaaggaatatacatcaagcttcctaatttatctccaggtaccaaccacttgacagtttgcttgtgtggctactacgttaaattatggggtttccatagttgggtatgcaggattcacaaaatagatttagttcctgctctcagagagcttaccttctagcatacacacaaaaaaaggcattatccgcttgatgttgttctttttcataattttgtgttcctctctgtattatccctaatgcaaattgttttcatttcagtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagtgagttttcctaagtggcctacaaatctattttaattttctttaaactttataaataactaactggattctgactataattttcaattaattatgaatctactaattctactaattgaaagctattatttttcctcaattttaatttagttatgttcagatttaagtggttatttacttcccctcctatttttttaattgaaagaattactaaataatgtgtgatgagatttaaattactgtctcatggctttgtgctaatatttcccatctgacaacttgtaccttagaaaccaaaaatgtggtaccagcaagaccagcatgtactatcactatgtctatctgggaagaactgagcccatatcaatttgtcttcagtttaatggatgcatgtcactttcagctaaaattttgaaagggaaagtagtgactatgtaaaatgaacacctgtatacttgctgccacatgcgtgacttttagaaacatgctatactgaatttatagtgtgatgtatgaaacagaccaatcatgtgcattttttatgtataggaatccattagaggacacactctgattaaaaattaaacaatgaaaggtaaatcaaagcaattacttttatgttagtaaattttggtgtttaaaataataataataaaaacgttgtgtttttccccttggcagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaagtcacatgtacaattcatttcatgttaacaaaaggtcaattaagacaataagatactgaaaagatttttcttttcactgtagaacatgtctcttcataatgatcacctgatgactgggtcttgtatgttcagtttttcagaatacgtagtgcaaagattgctgaggcattcgtatgggattgcctggtttgaaacactgtgaaactgtaaggttcaaattggatgaaaagcagaacatctgcttcttaaaatgggcactaattctaacaccctatgaaaattatgtgtattttagattctccctgtcaatcccttccttggcttcttccctagctgtccagctagacattagcagtcacttgcctgggaggtcatggctgtttggcagtcgtcatagtaaccccaagtgctaagacttccaagtaagagtgtcttgatgcaaattccggctctatccttactagctgtgggatttgagaagtcacttaagctttctgtgcttagtttc

SEQ ID NO: 13884 - DNA, 38705 bp, Human; identical to SEQ ID NO: 13883

SEQ ID NO: 13885 - DNA, 10075 bp, Human
  misc_feature (1)...(10075): n = A,T,C or G
agtgccgggcaaagcatgttaagagacaaggatgaatttaagttctataggaatgtggatttattaaaaaacattaagacaataattaattgtcccaaagataaaatgggacaccctcaccaggacgcccacacgccttgcaaagacagccgtcctgtcctccctggcccagacagagccttcccccttcatctcgggctccccctgatccagcgtgcctggccctcagcgggggacttgctccacactcctgcttacttaggaactagcggggccaaggtcacaagcgctaattactgagagaaccctgcccccaacacaacggctgcccagatgctctcggctgccagtcactgggccccggtcaatgggcgcttgggcaaatctgtggatggttcaaaacaaagccatttgcattcctggaaacagagttaaggtgcaggtccccaagaagggctggtcctggctctcagttgctggggtaaatgtgatgaacacgagccaagaacactgtcaattcactctgcataaccttcaccgcccacataccgcaggtacaagacaaacctcctttctccactccagactcactaaggtccccacctagtcttacagccacatgcttctgccggaccctctaaaacttaacatacaaaaccctctaatttttttttacatagtccattctttcaaaatgtttaatgttcattaaactattttgaaacaaaaactataatacagttacaattcagttttccattttggattttaaaatgctctggttcgagtctcgacatttttcttaaaaatgaacattacggtatattttaggagataatttatatggaaaaaaacacacacactaaatgtcggcttgcacctaaattgtttacacgttcatgggaaaacctagctgttaaccttggtgagggctaagatcgccctctacaagataaacacgtttctcccaattccaaggggagcctgcgtgctcccctcccccactctggtggcccggaggacagaggggaccctaggactggagggggacggagacgggctcagggatggagggggacagagagggacccggaggtggaggaggacagagaggggtaccccaaggttagagaacagaggatgactagggggatgtagggaaacagagcggcgcagaagaggacagttggggacggggcggccccgggcatagaaggggacagttggcgaccgggaagcccccggcgtagaaggggacagttggggacggggcggcctcgggcatagaaggggacgggggggaaccgggcggccccgggaccggacggccgcccgcagggtgagctgccggaaccggggctcgcgcggcgacagggcccggcttggtgaccgggacgggcgtggggtggcgggaccgggcagcggggaagagagaccgggactggggacaggcgacgcggcccgccccggctctcccagaccccggctcccttagctccggccgcgggcgcagtgcagggctcggccgcgcacctcacagccgcggactcctccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacatcatcggcgcgcagcccccgggccgggagccacgggattgggccgcgcacggggcgggcgcggggcgagtcacgtgggggcagggggagtggggggagccaggcaggaacggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacaggtaaacgcagccggccgcggttccctgcgggcgccggggcgcgggccgggtcggctgtttggggttcagacccggtgctctctgcggtccgctgggcctgggccccgcgctgtcaccgggggagcgggcgcagcgcccccgccgatcgatcctccaggctgcgatcagcgtccgcccagggaagccccaactcccggcacagcccggccgagcccctggcacgagttcggagcctgtccccgctccagacgccacagctggagcttgtcatggggaccaacttgctctgcctgccaaggtgttttttttttgtttgtttgttttttgttgtttttttttaacggattttgtttttgttttgtttcttggtgcttgtacttaacagttttttaaaaaaatcacattttgcccccagaacgtagaccagctctcttttatttttgtcttttttaaactgtagaccatttccaatgtgttttctgctctttggaatgcctaacatttcccctagatctgccttatttgtcttccctgcttctcttgttgaccaagaaaaataaaaataaaactgtgtacaccccagtgacttgtcagtcttgtgacaatgagcccgtccaaactgcttcaagtcttagtttggaaagaaggacctcggtttccgacattgtcgtagaactggaatttgggggcattggaaatttaagaaacttaccaggtccccgtgcttataggtagcatcgcccgaggggagagagactgacactcctcccattgtctctccagcgatcgcaggagggtttactgttgtctccctgccctgctgtgctgtttgtttttcgtcacaaagtgaattgccagatcaaatagaggctgtgggtttccaagcctcgaaagctttaaggaagatgaaatgcagggtgttgcaaccttcacacgcctgcttaattgttcacagtcctctcctgccttttccccctccccctcctgtttttttcctcctcaaagaagctgctccctaggacgtgattgaaattgatctaagtagtttccttcgggcgtttgggatttgggcaaacggccagacctggctcttggtcgcctttggaggcttttaaactctccgagagcttcgttcaggtcccgggtgctcatcagcgtaatggagattttaaattggccggattattaaagtttaacaagatctccataaatgtgcttttcttttttctttgttaaatcaataaaatacatcgctgctgcctctcttcagaacgctgtagtgtgcattgtaactcagacgcctggtttcgggggaaaggggaaagcatgattctcccgtgtgcttgctcccaccggctgtgtgcgagcctggggagggggagggattgcctgtggcaggagagaggcacactgctaagtcagcctgagcccctggggtaggctgcgctcaggaaggtccctgcccggaaaaatgacgtgctcaccagagccgtttggtgtagaaactgaaatctgtagaattgccagtagtatagacaaccttatatggacatgcaggcagctgatcctcgtgaaaatcagggcagacataatttaatcctaaaatgtttcctaccatttttcttttccagtggctagaaagtttgaaatggtggggagaggggatgctgatctcggcagttgtagcttcttgaaaggttggttgcggggctggggaaggggtactgtccatgccacactgcatgtccatttgagctgggtccttatttggctgctgatgagaatttcaaaaggaagtctcctttggcattgcgtgaaagaaatcagagtgatgactcatgcagttgtactcttggccagtagataaagttcttgttcattgtgggactcccagcagggccgtggagtaatttccccttgcacccttcacaatagcagatggccatgctggaattatttctgcactcctgttgttgaagttccttgtttttctctgaccactgtagaagtaattaaagttctgtgtcatgcaagggcctgcacttgggaacggcattctgtgaaaacataggcggtctgggctacacaggaaatgggtggtttttctgcagctccattcgatgcccctgaatacagacagctgctgtctcctctcccccgagtgtggccctgtgttgtcagccgtgtccccaagggggtccctcagaacacgctgtgtgccgtgcagtctttctgtcctgtgtgggtatctgtggagtgtgaagggtggatggctggggctttccttaaaacacatggttcttgacaatgtcagataatctggttgaacctgttggggaggagtatgtgtatggggccggttctcttcctctggtttcatgagaaacatcaacactggtaactacaacaaaaaaaccggcttagtgatcatcactcattgtggcccttggcccaacattgggaaagccaggagaggtttcaccctccgacttttcctctgaattcttaccattctagaaacagatttcctctaacttccgtaaggacacggatgcttaattacaaaaggttttgcccctgtagtgaccgggcagcaatgttatctgtccttcattcttgcatgtttttggaaattgcttttgcttttacttttggtcgtcatggcaatcacgtgccttctctggttcattttgcacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgccatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccctggccttgcatcccaccactgtgtgtgttgttgaatttcccctttccgtctgcgggtcagtgaagtcatgggctgcttgtcctgtgctctctccccaggagaaaagccttacagatgctcatgggaagggtgtgagtggcgttttgcaagaagtgatgagttaaccaggcacttccgaaagcacaccggggccaagccttttaaatgctcccactgtgacaggtacgtgcctgaggacaatgctgggcaaggagcgtggggccttgggaatgtgatgaccagggttgagtaggtgtgcagggcacattcgaaggaaggcatgcagtttcctatgtgtgaacatttcttttcaagcctgggactttttagaaagtttctggtgtgctcattgtccatggttaggaagaactgttccacatacacctgacattggagtcagtttattgatatgtttggagattggcctttcaacagttttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggtccagaacactggcaagggatgggaacctaacttcttctgtgcttctgatttgcccttgcaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagtggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccggaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatgaggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggtttttttttttatctgggctgatgaatacatttacctaagaaactcatttcgttttacttaagaggggaagtgcagttttctt

SEQ ID NO: 13886 - DNA, 39489 bp, Human
  misc_feature (1)...(39489): n = A,T,C or G
tgggcttcttctatcaatgtgtcctcacatattgatatctgattccctaatgcagcaccgtgtcattaatggagggtaaggcagacaattattattcagctgtgctgtttaataatattcaacatacatcccaagtggcgcagggtgccttggcaggcggagcccctgacaaaatgctcccatgtatgtcccgtgctcgacagtgctgtgtgcctgtgagtttgtgctgaagtatgataaacacgttgggtgaaagtgacccctttcaacctctagcgaaacacgaccctttcaacctctcgggaaacgctgggccataggagaatggcttgattcctcattgcactgtgaggctgagtctaggcagacgttcccattactagggactcaaggtgaggactttcccacaattcactgcttttatccagtgctggaactgccctgtcttctgaccagtggatgctgaggaactgacattcactgtcatttttcccgttttatataatttaaggatcacttcccatttagtgaagtttatctcatttttaaaagattctcccttctccctagggctaccagggcatggtggacggaggctcaaacatnnnnnnnnnnnnnnnnnnnnaggaccggtacttcagcccgggtgaagactggtataatgtggtgtccttgtatgtgtaggtgtgtggtgtgtgtgtgtgtgtgtgtgtgtgtgtgaaagaaagtgagtgaagagaatgggaatggcacccactcctctgcagcccagttatcctggtttcgttcctgagttgcggccacctcgtctctttggttggagtttctgggttgctggctctagctcccattgtgctggctctcgtgctgccccccaggtttttgtccaggcagagtccagagagcacccctgccctgctctgcgcccccaccctcacttgccttgggggttgggttgtaaatggtctcggtcacacttggtgccagtgacgtaggatcgtgtggagtgaatttcagtttttgtaaccttttcataatgttttgataaattaaatggtggtaggtttcatgtaaaaataggagcttttctgggatttggaatattagtgagtctctgtgtgtgaaaatgagctgtgtgcgtgcaccattggtgtatcgaaacacgcactcacgtcactgcaggggtctcctgggagctgcctgcagaccgaaggcagggagagcttcgcctccagtgcagagacaacccctgctgtgcttatgagcaccttgcttgacaaagtcagcacgcgcttagggatcccgtacggatggagttttttggtgcattcatggttttatttaaagaaatcttgcatttgtggatcccaccaacaattcttagtttttggaaaaccaagtgtgacgaatcatgatctatgtcccctggaagtttggatgaaagaatttaagatcctgaagatatagctctttaaaaggggcagcgagtatgtggtgcaaaaaaaaaaaaaaaaaaaaatccccctggccccaggttcctgctggttttacttgcaggtgctgtaaggggtgactggagggagaagcctggctgctggtcacaccgcttcccttgtcctggccggcatgctctggtggtcagtgggcttgtctttggttccacgtgcacctggttgagctcgttggccggtgctgaggcggctgctgtgacaccgcaggctggttcctgctccatgtatttaactgctggctgccgtgtgtctggctctgcaccctccctggctcctcctgggtgtcacgcgcctgtctttgtccatggaatgctggtctgggactaaaaacaggaaaatcacagtctttcatagctagttactaactcacaagatgaaaatgagaaaaatgtaaattctagcaccccatgtttatagtcggcctgtgtgtgccatccacctggcgctctctcagactgagaggagataaattagctggtgtctttcccagggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggtgagtggacacctgctcctctgtcctgcgggttttcgccctgtttcagagctttggaaccgacaggtttccctcttcactgtggcagaagtacctcttctcacagatcttacaggtcaccatctcaggactttttaggatctcaaaaaacaacagcaatgatcgtaagaatgctagtaatttaaccttaccatgtgccaggcacccttcgacctttcacacagatagctttatggaatcctcacgacagccatctaagccaggttttagatcatcccatttacagatgaggaatcaaacggccactcagccgtggggcgagccgggtccccagcagcctgggacactagcatccgcctttcagccctcacactgtgtccctccagctcgctggggtcctttaaaactgaagttgggccgggcgcggtggctcacgcctgtaatcccagcactttgggaggccgaggcgggcggatcacgaggtcaggagatcgagaccatcccggctaaaacggtgaaaccccgtctttactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactctgtctcaaaaaaaaaaaaaaaaaaaaaaaactgaagttgccacaggactttaatttatttagacgataaatctctgccaatacatcatcccggtaccaactttggcactacttaggaaagcgtttcctgagagccctgtgtgtatgtggtttatttttgttttgtttgattgtttgattttgtttgttttgagacagagtctctctccattgcccaggctggagtgcagtggcacgatctcggctcactgcaacatctgcctcctgggttcaagcaattctcctgcctcagcctcccaagcagctgggattacaggcatgcgccaccacacccagcttttttaaaatttttttatttattttttatttttagtagagatagggtttcgccatgttggccaggctggtctcgaactcctgacctcaggtcatccacccgcttcggcctcccaaagtgtagtttttctcccttgaagcggttatgtaatttcagtgcaatattaaatatgaccagggaagcatattgtttaacagcaactcgatgagaggcggcattgaggcaaagcagctgtccccaggtttgtgaacatcctcgtaggggatggagaaggctgcccgttggaagcagccaggcctcacggttcccgcttgtccacctcatcccgtctggcacagcacagtgagtgcacagaccgggacagtggccacaagtccgggcccaagcttgcccctggcccttcagtggttccgattccctttatgcagaactgcccagcccaggtctgtcctgagtgcgaggcagatgctcacccacgatccagcttcccacagatgcatgagaaatcagtgtgaagatggcctagtgtcttagattcttaattccgtaattgtaacgtatcctgttcaaagccgtgtcattctctgaagctgttgccaggaagtactgagatgtttgtttaccgattgcaaatgtggatcctttcttttatttttctaatccactgctcttgtctaagtgccaggtgacagagtccattgtgtgtaactgctgccagctttgtctggcttctctttccttaactatgcagaatccggttgccttgagttcggagaaaataaagaatcggccagggcagtggctcacacctataatcccagcactttggaaggccaaggcagaaggaccacttgagcccaggaatttaagacccgcctgggcaacatagagtgtgggtctacaaaaaaaattaagaaatcagccaggcatagttctagcttctcaggagactgaggcagaaggatcgcctgagcccaggagttcaaggctgcagtgggctatgatggtgccactgcactccagcctggtcaacagtgagaccctgtctcagaaaaatgataataaagaaatgataccaataacaaagagtttagaatggttgatttctctacccacggccattctgcctcacccctcgtggggcaccccccgaacgcgccatggttacggcgatgagacgtgctgtttgctccccgcgcaggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgacgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgatgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggcctgggagtgtgagtgtgtcctggcacaggcaggcagaaggtgtccaacgtgcaactggagagcgcagaggtggctcaagtccccttcgtcacaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttaggtctgcacgtctgtcgctgagcggggtgcctgggctgccctcgtgggaaggatccttctggggtgttgatgctgttgccttgtccacataggtacctggccctggtgagtgccttggcctgcggtgcggactgggtgttccttccagaatctccaccagaggaaggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtccgctcatgccgtgttttctctcccgactctctgctgctggagcgtgtgtgcaatacaacctcatcccagtggccaggcttcggggcctccnnnnnnnnnnnnnnnnnnnncggtaaaatgagggacaataaaagcaatgagagtggatgataaaaaaagatgcggataaaaagcacaatgtgtttatgtctcctaaagagatacctcgatgctgccacatggtagcgataacggaataaattttaggcggagggtgtagacaaagattaggggagaagcaatggttggaggaattagttcacaaagcagtgttttttaaaaaagaggaaaaggctacaataaagatttacacgggcaaatatagtttataagaggggtttgaaaaaatcccaacaagacctgttttcaagaaaaggccccagtttctaacacagggacgggaactgtacccaaaccaaaagtcgttcccccggcccctttcctagcccccgggcgttttcttctaccagggcccctattcttaaccaatggccctatccttaaacctggcccaggcccttgccctttcacctttgccccggccctttaacccttgcccctatcatcacccttgcgcttttcatcaccctggccctttaacacgtgcccttctcctcgccctagccgcttcacccgtgcccctctcctcacccatgccccctgccccttcacccctgcccctctcctcgcccctgccccttcacccttgcccctctcctcgcccctgccccttcacccctgcccctctcctcgcccgtgccccttcacccttgcccctctcctcgcccctgccccttcacccctgcccctctcctcgcccgtgccctgccctttcacccctgccccctcctcgcccctgccctttcgcccctgcccctctcctctcccctgcactgccccttcacccctgcccctctcctcaccctgcccctgccccttcacccctgcccctctcctcgcccctgcccctcctctcacccctgtccctccctgctgtcacccagcacacctttcaccaccttctgatgtcattgggaagcagctcttaggaagttaggcaaagattcctgcccagaaagaggccagttcagtttgagacagacttctgtggttttgttgcatttgttgctaagaacaggattaggaatttgagagctttaattttctgtctccgcagaaccgtgcccggaaaaaaaggctgaatattattattgtggctgaaggagcaattgatacccaaaataaacccatcacctctgagaaaatcaaagaggtgagtgtgtgtagctgctcactttctctcggtttctgcctggaagcaggggaggctagcgtcatgggcaggcttggtttagaacattgaattattaactttttatccttgatatttaaaacattttcataatgactcagaagttggacggcaggggaaacacgcagctcccgctcctgggagcccattccgcttacgtcacctcttgccgagcccgtagaggttccgggactccccagcagacagagggggtcagctcgagtggccacgcgtgttctttggattagaatgttccggctcttaaacatgagctgctctgagaatgaggactgaccacttggcagccgacccgggcttctgtttgccacagtgggaaaaggcggcgtcttgctattccctgtgccctcccataacccagagcatcagctgagcacattcttactcacaaagccactgtgtcctcgtggccctgcctgggaacaggctttggcaggctttggcaggcttcgtgccctgggacttgctcaggccagtgcctgcctgtctggagaggactctgataccatgggctgtgcccctgctgtagacggggctgcaggctgccggggctggggatgggctgtggctccagcagccacggggcagaagacgtccccacctggctttgcaagtcggcttctttattgtgctttgttatggtcagttaaggagcaaagcatatctctggatatgaaaacagtgatggacacctgggaaagacatctgccaatatttataagtggtcatccataaagtccaggcaaagattttatttcccgcttaactgtaattaaattataggacaatggaccgagaaggaaccaaggaatttacgtagcccagccccactgtccttacagaggaataagctgagttccagagacagtcagtggcctctccagatcaccgggccggtgtgcccatgggctggggcgaggggaacgccttgattgggctggcttgtgctgttcaaatcacagctgaacaaattaaagctggttcaaggaagatgtttacattttttgtaaaatataagtaatagtttaaatgcaagctactgaaacgttacttttttatttttcttttttaaagcaacgaacatattacttgtattcattttctaggtgcgagccaagatcttgtctggtaacaacagtattatttttaaaaccaattttcagctgcctgttatatacactaaacgttctgctaggaaacaaaatttagaaataacttttcccatttagatctgaagaaagagcgaaaaaccttttccagtgcccagtacctccttccagatctgggctgctgtgtccgcatcacagttccgcatcctaacgagatgtttccttgcagcttgtcgtcacgcagctgggctatgacacacgtgtgaccatcctcgggcacgtgcagagaggagggaccccttcggcattcgacaggatcttggtgagttgggaagggttgggcatcttcacaaggtctctaggaggaagcgtttctggagaggcacaggcaccagccggccacagaggctggcaaggtgctccccgagagatgcccgcggcccggccctcatcttaacgatccttgagacctttggtgtagaccagtctctaggcctgcagccattcagatgcggggagagctccctaatgtgggaaggcagtgcttggtgttggcacgacgtggaccccagagggcacaatcccagggcagaaaggctgtgtttctagtgtgagtttctggaaactgactcagggcagcaggaatcccaagtacaaaccctccgttcttaacactcctgctctccatgtgccctgacctcctctctgttcccgtcttgccagttctaaaggagtggaaatcgctttgctctaaagagttgggctggaagcgggaggggctgtgagcacctgactgaggtcattggacgtcatggaaagataggaggtgacagggacagggcaggacgggaggctgcccctgacccacatggacctggtttccaggccagccgcatgggagtggaggcagtcatcgccttgctagaggccaccccggacaccccagcttgcgtcgtgtcactgaacgggaaccacgccgtgcgcctgccgctgatggagtgcgtgcagatggtgagtgggcagcccatggccaagggcagggcggagacggctgggacagaagctgcttgtcaggccagcctgggcaccttgggtgtctcgtcggtgcacgatgcattacacggcctttctgagaaggaggtgagctgcccgtggggagggagaaggcttgtgttctctcccacacctgcagagcctgcgccatcttcgctctttggttttctaagttaccatccatctgtgtggcacatagtcgtaacctcccctgagtgggggtctagagcatcgggatcctcaacagtcgaggatccaggtggccccagtgcaccaggtgctgcagaaggacagagtgcagggaggcagccgagagagagagatccgtggacagactgcagggaggcgggcgtgagagagacccatggggcagagggggcagggaggcagggaggcgggcgtgagagagatctacagggtggtattttgtaggggaaggtgggaccttcccaaacttctccagtttcagccatttcctgtcctcctatccccaaggacattcaggtctgtgatgggacacagggaaagctctggtcacccgaagatacacccacccttcttgggccagggaactgtctgcctgcaaatgaacaaagggaaaagcagttccagcttttcaggcattggttcagtagtggaggtggctgtggagttagctgcatttgaagttatttaattaattaatttatttatttagagacggagtctcactgttgcccaggctagagtgcagtggcgtgatcttggctcactgcaagctccgcctcctgggttcacgccattctcctgcctcagcctcccgagtagctgggactacaggtgcccaccaccacgcctggctaattttttttttttttttttttttttgtatttttagtagaggtggggtttcaccgtgttagccaggatggtctggatctcctgaccttgtgatccatccacctcggcctcccaaagtgctgggattacaggcatgagccaccacgcccagctgttgttttatttttcagagttcattcatgattcatgactcctgttttgttgcctcttaacacacacaaagaagtcgtgaagcaatcaagtcagggacttgttgaaagtcaccttgtaaacataatttccaaaagcccaagggagaaaatagtatttgtgtgtatgtgtgtgagtgtgtgcgcaggcttgtgtctctgtgtgtatgtatgtatatgtgtgtgcatgtgtatctctgtatatgcatatacatgcaggtttatgcatatatttatgcatgtgtgtgcatgtttgtgaggtagtttgggtctgcatgtatgtgtatgtttatatgcatgagtatgcatgtttgtggtagtatgtctgcatgtatgtgtgtgcatgtttgtgtgcatgcatgtttgtacgtgtgtgcatgtttttgtgaggtagtgtgtgtgcatgttagtgtgtgtgcatgtgtgtatatgcatgtgtacatttgagtgtgaggtagtatgtttctgcatgttagtgtgtgcatgtatgtttatatgcatgtgtatatatgtgtgtgaggtaatgcatctgcatgtgtgtgcatgtatgcttatatgcatgtgtgagcatgtttgagatagtgtgtgcatgtctgtgtgtgcatgtgtttatatggatgtgtgtgtatgtttgtgagaggtagtatgtgcctgcatgtttgtgtgtgtgtgcaggtatgtttctatgcagatgtgtgcatgttggcatgagtgtgaggtagcgtgtgtctgcatgtttgtgtgtgcaggtatgcttatgtgcatatgtgtgcatgttggagtgtgaggtagtgtgtgtctgcacgttagtgtgtgcctgtgtgcatgtgagaggcagtaggcttaaaaggctcagagcactgaacgacatgcggtacgtgtattttgagcctgtgtctcatgtctctgcttgtctagagacgaccgtggtaggtgtcacttgccctgaccttgaaaccacccttgtgtggctttgtttttaaagctgagggaccactactgtgcacctgctgtttgtcaggtgtcttcctgagggtctgacatgcttgaataaccttagagatagctggaagtaggagtatttttctcatcttacagatgaggaaattgaagttcagagcgagaaagaacttgaccaagatcctgacgttgcccagggctgcctggcgtgcatcagtcccagccccgtgtcccagggcctccatccgggcccctctgctcccccgcccgctgtgacctcgctcccatcccacatcccccagtgagctggtgtgttctgttttgtttttccccaccataatcaaattgagaattccttagaaccatgcctgagagatttcatttcctctggctttgttctcttggagttaaatcttcacagtgttgtgtccacaaacagcaggtgacaccttctctttttcctcagaagcctcctgagctaagcagtcccagggctctgacctcacagccgggccgtgtggggctggctgccaaccagcattaggacacacttggcggccggtcgtctagaccattaaccctggggctgctggctgcccgggtcagactggagggggctggtgggaaggaccgagccagtctctacctaccccatccatgatgcaccaggtcctgacacattctttcttcttttcatcattgttttaaaagactcaggatgtgcagaaggcgatggacgagaggagatttcaagatgcagttcgactccgagggaggtgaggtgctttggagaaagctctgccctgtcaggaacacacacccctcaggcccagccactgcaaacgtgcttaggggttgtgcttattccatgtcactgtgaaaaatcagaaagtcaggcagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctagagtgcagtggtgccatctcagctccctgcaatctctgcctcccatgttcaagcaattctcatgcctcagcctcccaagtagctgcgactaccagctcgtaccagtgcatgtcaccacatccagctaatttttgtatttttagtacaggcggggtttcaacatgttggccaggctggtctcaaactcctgacctcaaatgattcacccacctcagcctcccaaagtgctgggattacaggcttgagccaccactcccatgtcttgcaagagaaagttatgaagtgtagaagcgtgcccttttctcttagtccatttccaccagacacggacagcaccgcgggtcgcggctaagggctctgccatgcacatggaatcctggggcctcctccttctgcccagatagtcgggcagacacatcgagtgctggcagataagccgccttttctccacatgagccctgagtcgtgtccggtattctcgactccggtccaacgacacccttttcctttaggagctttgcgggcaacctgaacacctacaagcgacttgccatcaagctgccggatgatcagatcccaaaggtaggtggccggcctcccgcgatgccccgacctctcctgcgggcctcccctcatggcctctgcctcagtgaatgaggccacctgttttcaggcctggcacggcatgagccactgccaaagtgtgcagcaaatggagctcacgtgtgcccgtgacccagcgctcacctgccttctgttttgcagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccaggtgagtcacccaggatgccgtaggcaggcagacaccctggctctgagcacagtggacgtggcggcgggggggtgccctccatggccctcataccttttcatgcctcagtccgggatcctgtgatattgtgactgaatgactacttatttaaggcattgcttctggagtaaaatctcaccctaaggtaggtttcaggccctcagatggagcccagggtatgatgtgcttttgaattttctgaaaaggtgctgggggatggcagtgcctctggggtctgatggccctgacattaggtgagaaggaaggtggcgttgtctcggaggctgtggtttgtttaaaccgggcactggagggaaagcaggcagtgtctggtgtgcacaagcacccactgaaatacaaaccttagtgaacacaggtaacaccccttgatgtgtgctgtatccagttgttctgtgggattgacatgtgttcacccatttaagcctcacactaaatctaagatgttatccccattttccttacaagaaaaccgaggcatagggatgccaactgggctgggtgcacgagggaggactggaaacaggattctgagctcctgaccaggggctgaacttgtggctatttgtttatctgattagccaacaaatacctactttgtgaaattctttttttttttttgagatgaagtctcgctctgttgcccaagctggagtgcaatggcgcgatcttggcccactgcagcctctgcctcctgggttcaagcgattctcctgcctcagcctcctgagtagctgaaattacaggcacgcgccaccacgcccagctcatttttgtatttttagtagagatggggtttcatcatgttggccaggctggtcttgacctcctgacctcaggtgacccacccaccttggcctcccaaagtgctgggattacaggcatgacccaccgtgcccagcctcctactttgtggaattcttatgctgaggaattaaatgagtgagcaaagcagacacaactctctggttccgtggagactgcgtttatagatggggagagaggacagtggctgaggatcctcctgctctctggatggtgagcagtgctcagaggcatgccgaggagggcctgctggagatcccccagacagcaatgctgaggaaggtgctcccaggctgctggtggctcatggggccctcaggggacactcatcccaggtggagggaaaggatgctctggagctgatgctcacaggggagggggctccgagcccgcacagggcagtgaggatgggaactgcaggggcagggccggcttctttgtgggcagcctgaggaggttggcttttatgttatgtgagattcgaaggtcctgagcagggactggcccacaccaagagctttctaaagggaccctctgctgttcactgaggcaggaggcagggctcccagccggggctttgcagtcacctagcaagagatggtgggtccagactggctactgtgcagatggcgagaaacctccaagggtctggaggtatggagggcacggagggcagatggggtttgcttgctaagtacacgcaggcataaacagaggaggcaaggatcactccattcctggcctgagcacatggaaagggtagagttgcaatttatgaggactaggaagccctgagacacacttcttgcaggtaggatgaggagcggagactcatgaggccagggtgaaagtgtgtgtcccacggccgaggacaggactggggatgctggggtgaaagtgtgtgtcccacggcggaggacaggactggggatgccggggtgaaggtgtgtgtcccgcggtggaggacaggactggggatgccggggtgaaggtgtgtgtcccgcggtggaggacaggactggggatgctggagtgaaggtgtgtgtcccgcagctgagaacaggactggggatgccggggtgaaggtgtgtgtcccgccgtggaggacaggactggggatgctggggtgaaggtgtgtgtcccacagctgaggataggattggggataccagggtgaaggtgtgtgtccctcagctgaggacaggactggggatgccagggtgaaggtgtgtgtcccgtggccaagaatgtgcagtaagccgctgtgtcccagcatcttcaggagggtttggctgagctcatgggtttaggaatcttcagcgtctccacgttgttaaagatgcagaactcacagagcttccctgagggcctgagtgcaggcaggagagagagaaggtccaggactgattcctcagggcgccattgttaagagtagggtgggaagaggaaaccccagcccaggagactgaggagtggcagagaggtggggtggagatgccctgtggcatccctgggaacacagatgatccaccttccaccaccactgcccgcccttctgtgttggcccatccacccgcatctcagcagcaggaaccggatgaggaaccgttctgtcctgggtggatcttgctttccccgtctttcttgttcagacttgtgaagattaattggcttaaaactggtatttgctttatttaaaaaatattgccttcaaaactgatttatgtgggaaaaaaaaagcctgatttatatggttctgtcaaatatatatatatatacatacacaccttgtacagtatttaccttttgatgtagaatgatcttttttctaatgtaatttacctggagatccccctgcagcatggcagtgtgtccaccacatccgtgaacttacccagaatctcgtgaccggaagctgcggagctggggttcgagccccacgggttctcctcctgcagtcctgccgtcctcgcagtggcatcctctttctgcgattaccttagtttgcttagtaatctgttttccttttttctccctagtttgtaagaaaagaaattttcccttaatcttttaccaacttagaaaccatcatgttacttttcttttagttgccggtggcgggatacggtgagctgatgtatctcacacgtggctcaggatgagacacagaggccccgacaggcagggagaacgcagcccctctgctgctcttcatgagttgttaaccttggacttctgcttctcaccttgattcatccgggcatcgtgataaatgctgtctcatacgcctctcaaatctttaccggaatgcagcttgttgaaaagtacagaaagctatttttagcactttgcaacttgcctttcattgttcactttagctgtttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcgtaagagagaagaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctgcctcccggctgttctcatgagctctgtgtgtgggtgccctggacggtaaagctctaggtagaggcagatgcatccctcggtgtgcgttctggggctgaggactggctgctgacaccccgggcacaggtgcttgatagggccagggcgttgctctcgaacgtagagaggactcgctggctgttgtgggctcgtcctgaagaggcttaagaaacctcaccttaggggccagcacaggtttgcacttagctgcattcacttgtctgctctgattgcctggcctgaacgtttttgccctacggtgtcttataaatctaccaagagtacaagtacttcacttcttccaatcaacatgaaacctttggatgggcttgggatgggatccagggaggggcacagtctggtgttgcacttgttagccctgtcatgtgacattggtgagagcatgggggagggagagcaggtatgagcagatgggattttaaatgagatcaatagtggataatgcatatgtaagttatttggaaactggaaatttccatttaaacaattattgggcacggcggctcacacctgtaaccccagcactctgggaggctgaggcaggtggatcaggaggtcaagagatggagaccatcctggccaacatggtgaaaccctgtctctactaaaaatgcaaaaaattagccgggcgtggtggcgggcgcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcaaacgtttaccgctccttaattaaaaccacagactggggaaggcggccgggtggggaccggcgtggcgtcccgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagttacttgttggctactggccacgatccgagatgataggttcccagacccagcggccactggagaattgtagaacagcaggatagcaggtggtaagacgtggcctacgagtggcccagttccagtaaagcaacttaaccgagaagcaaaagcttgactccttaaccgggcctcatctattcagtgagctcttaatgtatttcaggcctgtggaagtaattctatctcttgagtccagagtccagtggctacttagagactaaggtagttatacctagaattttgtttaaaatcacatattggactgtagaccctaatattttttctattcatgaagattagtcccatggtaacctttccatttacttttagaaaaagtaaaaactggccgggcgcggtggctcacgcctgtaatcccagcactttgggaggccgaggcgggcagatcacctgaggtcaggagttcaagaccagcctgaccaacatggtgaaaccccgtctctactaaaaatacaaaaattagccgggtgtggtggcgggtgcctgtagtcccagctacccgggaggctgaggcaggagaatcgcttgaacccgggaggcagaggttgcagtgagccgagattgcaccacctcactccagcctgggccacaaagcgagactccgtctcaaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgttgatctcggagtgttttcgtgatgccccagtgtgctccctgcgtgctgtggtggaggtggcgctcccagcctctcccagcgagaccccctcctccccagcttccctctcgccccacaactcccacgcttgtctgacaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgaactcactcccagaaagttttaccacctcttcttctgtgtggccaccagggggacgtagtgtggccgagactccaggagtgcccgtgagcacccgaggcgctgaggagggctgggtcgcagtctcctgtgattgtaccagcattaaaaatcactttgtgtgtgtgtgtgtgtgtgtgtgtctgagcctaaattttctttgagcctccaatacccattatgatgaacccctgccttgatgctgagggtagaaattgaattgaatattttataattttattcattgccctgaatgcaccattgcatttgttatctctctggtcttggctgttgacctcattttcccctttgtaaactggggatgttaaattacctctaaggcaataattggtgctactttagtttttttgccaagagacaataataaaacatagaaatatattcttctttttttctttgtgggacggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcatttttttaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttatttttggcagttgctaatctctgacctagacgttgcttctgttctcctggtggtgggtgtcacggctttgctgctgcggggctggcccggctctggaccgaccttcgcactgtgaatgtgaagatgagcctctttcacagactggattccgtcattgctttcactgctctttcgcctgctttagctagatttttgggtctgtgaaagttgggtgtgcaatgggagggactgaagcttcttttttccctaattgttacctaattggaactcgcccagagggaacgggtggagaatttgagagcggtcgctgcagttagctgagtttctttttaattccagggtcctctgctataaataactgttttttttttttttcagattgtaaatatgtaacaaatgcatagggtcaaatttatgaaaaccaaaatacgtggggcaaaaacaccccacaaatgatcatttccacctgcttttacttcccttggagggattgtgtgatttattatgcgattgttttaaatgcagtttttcattcattcgagtttctcgaagctaggttaaacaatttctttttttttctttttttcttttttttttttttttttttttggagacagggcctcactctgtttcccaggctggaatgcagtgctgcaatcgctattcactgcagcctcgacctcccaggcttaggtgatcctcccacctcagcctcctgagtagctgggactacaggtgggtgccaccgtgcccagctaattttttgtatttctatagagacggggtctccctgtgttgcccaggctggtttcaaaacgtctgggctcaagcaatccccctgtcttgggctctcaaagcacaggggttacagggatgagccaccgcgccgggcctgaagttaactgattacaatgtctgagaaagaactggagcgtgtagttagttgagcctcccgttggccaggcacagccaccttggtaagtgcatgtgtgtgtccttgttgcccttctgatcctgagctccaaggaacaaggctgtcttgggagtgcggtggttctagtctcgtgatgggtgagtggcgccgtctgaccgaggtcaccctggcgaatgctgtggctgctcgggagctggggcagagaagagaaagccgctgagggtccctctgtggaccctgaagggagagggaccgatatgtgaacatggcagctgttttctccagagccctgtttactgacggccgaacagtgtgaatcctgagacggtttggatttgggtctgaactgggctcgtctggccacagaagaacatgagctggtggcatcctcaggaaatcagggtgtgaggcaactggacgtggatggctccgggtccccccggccactgtcctgaagccgccagaggctgaggacgcatgggagtgagcgtctcttccctgtccggccacaccctctgtgactggtgactcatggcgtggccctgggcagcatttaggtttgaggtctgtagatggctccagtatactggcttctcttgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctccgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcgtgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaaggtgccaagacccccacctgccctcctgtgtgcctcaggcccctcctggtcccaggtcacccacaccgtctggcttccagcgagcgcttctcggagaaacagccagctccccacagccagtcttggtcagtcctgagctcgggtactccaaagtgaagtgagcgacatcacctgtctgaaaagcataaggagactcccacgtggcggtgctgaggggccacatcctgggcaccaggccagccagtgccccgacatgagtgttgctggccgggaagcagctggcatttggattgaagtcctgcaaaaactgccatggccagagcctgccaggcagagcctgcacagagcggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccgtgctgtgaactcacctgccacgggtctacacccactgtccgaagccctcggcccacacgggctccaggccttgggatgctttgcgttgcaccagggctgcagagtccagatcgctcactgtccgactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcaggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctcccgttgcttttccgtcatttattttagcaacttgtttcttctgtgctaaggatgagccggatttattcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacaccctcctgggcaggcggtttcaccaacatgtgccttgggaggggtggattctgccagtcgtgggtgtggtgctgacacccgcatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagccctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggccctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacagctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacaccccacttcatgctcttactcttggctgagtcccatggaggcccgttagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactcactctcccacagctctggagcgcaggagccatgggctgaggccagaatgtttgctccaggagcgtccctcgtggtccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttagggcccacctgggtactcctaggattcacctttatcaccgcatgagggagcattcccaggttctagggattagggataggactgggattcctttggggactgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggacccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcccggctgctgcacacccttcacctctgcgggatgctgggaccgcatgtttgggcgcggtgggggggccttgctgcactcactcttgggggagctctgggatggtgggcgcgccccgggcctgggctggagtgactgatctcttctctgtgaccagacctgcgaccgcatcaagcagtccgccagcggaaccaagcggcgcgtgttcatcatcgagaccatgggcggctactgtggctacctggccaacatgggggggctcgcggctggagctgatgccgcatacattttcgaagagcccttcgacatcagggatctgcaggtatgtgacggggctggcctcagggcccgtccccttgggatccactgggtgctacggagtgaatcatcgtgtctagggtggtttgctttccgaggggcatggagatggagatgctacagaacacgccacgcttgatacacttcgcatcgcccaggtgcccctactgcgtgtcaggtgacggcgggtgtgcctggttgaggacaccttctagtctcatgtgtgaaacacaagcttgtttgacgtagtctgttgtgtagttaatgttgtctcacttatgtcatcaatgattcgagaacctccgctgacagtcaccacccacgtctgcgacaggctctgaaggttgctgcagcttcttttaaatcctgaggcccctgatgctgcgtctgcctctaaacggacacagacatgaccgtggtttctcggcatctgtggctcttttagggaagggtgtcgctgaccccgcggtctgcccctgcttggacgacacagcagaatccaggcctggaccctgcaacgttcaaagttgctaaacttcatgcaagatgacaggccttggcagataaaatgcaacttgaacaattgtctttatttagagagggagtcttgctgtcacccaggctggagtgcagtggcgtggtctcggcttattgcaacctccaactcccaggttcaagcgattcacctgccttagcctcccaagtagctgggattacaggcacgtgccaccacgcccagctaattttgtatttttagtagagatgaggtttcaccatgttggtcaggctggtctcaaacttctgacctcgtgatctgcccacctcggcctcccaaagtgctgggattacaggcatgagccaccgcgcccggcaccattgtcttttaaaaagtttggctcagaaacaagtaacatcctaacagatcaagtaaaaagggccttggcactaattatgtgacatgtgaatcacgaatttctttaccatgtcaaatatttgtggagtcattcactgcatcatgatgtttctgtcaacagtgggtcccataagattataatggagctgccccaaacaggtgcagtttatcttttataaaaacatatctttttacatatatttttataatatatattttataaaaagatgttttttatcaaaaaatatgtatctcttactgtgcttttctacgtctagacatgtttagatacacaattgcctgcagtattcaacagtcccagacattcaggtttgtagccaggaacaacaggtgtgcagcaggctctgcctcctgggtttgtgtgagttcactgtaggatgtttgcgcaaggcttaagtcacctagcaatgcatttctcaaggaacatatccccctgttacatgactcatgaccgtatttcagaaatctgtccaaagatcctgcctcaccagcgctcagcatggcaagggcttaagagaaattatgacagatttttattttttgctttaatttttgagatggagtctcgctctgtcacccaggctggagtgtagtggcacaatctcggctcactgcaacttccgcctcctgggtttaagcaattctcctgcctcagcctcccaagtaggtgggactacaggcacctgccaccacgcctggctaattttttgtatttttagtagagacgggggtttcaccatgttggccaggctgctctcaaactcctgacctcaggcaatctatccgccttggcctcccaaagtgctgggactacaggcatgagccaccatgcctggcctcctactttgtgaaattctgccattgcgcccagtgacagatttgattagatgtaaaaacctccattttcttaggatgaatcattagagaattacctccctcttgtaatcctcctaacatgatctgaaatggggatgttcttactctaagaccatcttttccttaagaaatctgtgtatgaatgtgagtctacaaaattctttggtcagacactgctcatcaggccgtcacatgagattccatagaaaggccacaggtcactctttcctctgagagcaccgagaacatcgtcatgcaaataaacaaggagcaatagagccatgaatgatcactaggcaaagcacggaattaccattttcagagggaccctgttgactctggaaggtgttgctagtggccgccgtgagggctgctcaccgtgccctgtcctcagcgttcatcgctgcagacgtgtcctccctatctgggaggaggctccccaagacccaagccgcgagagctgcagcctccttggccacgctcactgccacacttggttggcacttcccagcctgcagtgcctggcacacagtaggtacttagtagaagtttattgtctgattaacaaaatactctcttccagtccaacgtggagcacctgacggagaaaatgaagaccaccatccagagaggccttgtgctcaggtgagagagagagaccaggggctgatcttaccctcaccgccacaccctggttcttagattctagtctgtgacttgggctggatgagtggtcatttctttgccgctagagtgcactacacacactgagcaggtgcagaagacagctgtggtgcattgctctaaaggcttgcctgcatttagacaactaatatttttgctttatagtctcttattctttgatatcttgcaatcatttccctaattagcacctgatgtttatgaagaaagaaggaaatacagtcatccctcttagcctcagggactgtgtcccaagactgcagtgggtgtctgaacctggggatagtacccgccccctgtatacacgaggttgcttccatctgataaccaaggcggctactgagtgactcgggcaggaggcacagacagcatggagacgcagggcacagggatgattcacgttctgggtgggacagagcaagagagcacgagatttcatcacgctactcagaatggtgtgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagggccatctccccaagcagggagccacgtgcccactgcacgctaaacaaagtgactccttctcgctcgtttcagaaatgagagctgcagtgaaaactacaccaccgacttcatttaccagctgtattcagaagagggcaaaggcgtgtttgactgcaggaagaacgtgctgggtcacatgcagcaggtaggcccgagactgcatgaggggccacaaagccactgtcatgtgacttttaaaagattagtgtcttattttagccattgtggggaaaaatgtataagtaaattccaagatgataaaaaacatctgaactttttgagacagagtcttgctctgttgcccaggctggagtgcagtggtacaagcttggctcactgcaacctccaccttccaggttcaagtgattctcctgcatcagcctcccgaggagatggcagtacaggcacccaccaccacgcccagctaatttttgtatttttagtagagatggggtttcaccacgttggccaggctggtctcaaactcctgacctcaggtgattcacccacctcagcctcccaaagtggtgggaatacaggcctgagccactgtgcccagccaaaacatctgaacttttaagtgatgccaaacatcaccagctttaggattcttttgttggtgaggtttgagtaatggggattttaagggaactgtcagctttcatgaaaacagtgatacccccattacttggaaatgcttattcaaattaaacacttcatcaagttaaaaactggagcttccctaagatttaaaatggattatcagacatgtagtatacttgacaccccaagtcagaatgacctggaatgagctgcacacaggcacacacgtgttatgagctgagcctgggacacagggtccaggcctcctaacttgcacatactccttcctcaccacctcctattcttatacttttaagccagagcccatgaatcccctgcaatgatgatgaaatagtaggcatatgtgtgatcttcttaaagaatccacaacggttatcagattaaagctgtgacccatccccagctcagatgagttcatgaaatcctgatttaagattttaaaataatgaagattgttagttgacttgttcagtttattaaaatcctcatcttactgagcggggggaacacttgatactttttcttaacaggccaagttcaggctacgggaatcacaggttttgttctgttccaactataaggacctagaaataaaaacatgaattctgcaaaatagaaattgtcatttctatttaacagcaaagtgttactgtataactggtatttcatataactctaaccaccaacagggtggggcaccctctccatttgatagaaactttggaaccaaaatctctgccagagctatggagtggatcactgcaaaactcaaggaggcccggggcagaggtaaggggtctggggagggaggccacagcctcgtgatgcaggccgtcctgccttggtgaaaatgctgtcctatcggggagaagtagggtgctggttccttcttcagttcagtactgagctgcacgtgatgttttactcctgatctctgagtgttgctatttaaccaaccttggattcctgggataagatcagcttgggtatgacatgttctcttttatcactgctagatgcagtctgcagttcttttgtgcaggctttttgctctagagatcctgaacgttggccagcaatttcccctcacagtttaagtggggccttctattttttgaatgtttgctaggacaacctccttgtgactatccatcaaaacttccagttttgaggaagatctgactgctgaatgaattgttcatgtttgtagaactgcatgttcgtagaactgtgcatgttcttccttaaatcagttttgtaagttacatattctaagaaatctttaaactgaagtttcaagaaacatgacttttttataatactcttgttaatggttccaacatggctgttccccactcattcctgagtggctctttgtgccagcatctttctcacccccacccccctcagctttcttaatcagtcatagcagatgtgtgcttttattccggcaaaccactatcactgccagtgtccaacttagaaaaatgacagtctataaaaaccagtgatgtgaatagtttcaatgggtttgtctttttgaagaactgactttggctttgattctttctacagcgattttcttttgctaatttagctatggatgctttttgcctctgtgtgtgtatgtgtgagcataaattagtgtcctgctgtaatttaagctaatttccctattccactatttagtgaaaaattctctccactgggaggaaaaaacaaaagctgctttccaggaagccctcagggcagtcccacaggagcagagctgcacgaggccaggtgctggccccactgcgcggctgttctcagtctcactgggcttccaggccgggttcagcatggttctgaggaatctcagttctcatctcgccccgtgattctgctcccccacctgcccatgttgacagggtgttattaatcttttttaaaatcttttataggaaaaaaatttaccaccgatgattccatttgtgtgctgggaataagcaaaagaaacgttatttttcaacctgtggcagagctgaagaagcaaacggattttgagtaagttggctgggttccctgaggcaataagaccccaatgtgagtacgggacaggggaatggccattgctgttgctgtcggcaactcattcaggggtttgaggaactggcttttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgtgaggcagaggttgcagtgagctgagattgcaccactgtactcaagcctggcgacagagagagactccaccactgggtcttcgggaataattttaaacaatggtttcatttgatcctgaaattggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaattaaacatttgcctacaactccaacagtcctctgttttagttttttaagtaggagattagtacctcaatctatgggtggctactaaaggttttctcagttttgtgggcaaactatgcacacgtcatacaaggagaacaaagccaggagttcacacaggccaaggggaaggccacgtttactcaccgttccatagctgccatgtgtcagtttccatccacagcagcaggccgggaccctgggcctcgaccccaggctcctgctctcctttgaaagtaaaacatgaatcttagttacttgtcctcttgattgcaatcctagctgcatgttaaaaccaccaaggggtgggtggggcggcggtgggttcaaaaatctgatagccagcttctcctccaggccaagccacagtcctcgctgggacctaggttggaactctccggaagagtcctgccagagtagacacggctgctgggatgacagccctgctgccctggtgggcccccctcctgtagggacagcgtttctgcctcttagctctagtctgcaagagagaacagctgcgcctcagaaatgggggcagagagctgggtggagggagaggagaggccaaaaacaaactctgtttgggaaatcagagtccgacagccaagaaagagctagcgcggaggctttcctttctggctctgtaacgatgaagcaagtgcttgctcaccccaacccacttgcttctcaggacggtttccatgcagccgccgcggtgaactcccgtctggtggacactcccccagggcctcggtgtgatggagtttcctgaatcagcgcaggcagacgtgggacacccttgtgcaccttttcattttacttctgtttttaaataaaggccctaaatgctgcttaaaataatgactcaagcagaggttaagtcagagttgccctttatttttagattcttaaatattctagaatgaggtaaaacgagcctgccagtacaaagtgaaaattctacatggtgcatctttggcgcttcatgcatgattatttcaatgaacctcttcctggtcactcttaagatagatctgagtttttgactcgccagtcaagggctttggcgacactcaatgacataatattcttggaaaaagcagtagcatttctgacttttcatattcagctcggaggtgtattgtctcgggctcctgtgcagtcgagcgccacggctgctcatcggatgatccaggatgggtccttggcaattttcgggttctcgggtccgaggatggccaggccgtgtgtgctcttcccagtgccgaggtacctgagaggaaggcaggcgtggtcagcgaggactggcttctgcgtgagcgctgttagagtcagcacgagggcttccagtcccagacgctgtctcccccgctccccactcacctatcgctcacggccaggagcttgtcgtggctgacagcaaagagctgctctctgtgggcctgcttcatctcatccgagaggccgtacaagaagtggtccattcctagaagacaatccacaggcacgatggagccgctgcccgggagctcgcgttgtgggctgtgcactcatgtcccggaggggacacaggcatctcactgtcatttcacgtgcatgtttcaaccacagggatgtgtctaacaacccagagatcacaccccgaactccagctcccacgtgccacgctgacccctacccacgcctgcttctgcagcagggatgcagtcagcgccgcgtgaggctgatgatgctgtgagcaaaagcggctccagagagtaacgtggccatgcccgggccgtgcccacgtcctccttccaccctaaagagcccggacactgccatgggttggccccactgggtctcaggtcagtaaaacaaatgacaggatgcactcttctcgcccggatgtcaggaagcgtgtttagggtgtcagacgtggaaatcgtatcacaagcaaggatggaggcaccagaagctggtgctc

SEQ ID NO: 13887 - DNA, 25194 bp, Human
gtaactggacttcctatggctaggctttctcccatcaaatcagttcttacattattttctacactgaagttatagtaatcttcctttttaaaaaaggaatatacttatctgatcatgttgttcatccgcttaaaaactttctatgacattccattgctctcaggataaaatgcaaactctttatcccagtttacaacacccctgcttatatttccactcttctctcagaaactgcacctctccttcctaatacacaaattcacaaattttattttccagccattctgaacttctgtcaacaccaaacttctccttccatgccgaatctttttgaatgccttttcctttgcctagagcactcttactgatcttaatttcattggataacaattgctaattcttcaggtctcagttaagcctctaggaagacttatccaactccctaaaactggattgggtcccgacaggctctcatattagcctagacttatttgaatcatggcacttatcacgctctatttcttactcttggctagaaaacagtcttcttgaagtggaaggaatactgtcttgtattccatgtattaggcaggatgttgcgaatggcaagaactaataaataattgttggattgtatggcgtttttattttatggtgctcactggaaaaataaagaacaaaaaattattcatacggttatttaaaaagatatcacctgaaatataaaaaaaactcaaaggacttttgtacatgtcgtggggcggggctaagttgaattatccagactatattttcaaatctgtatgtaggctatacacaaaaatcttcgtctatttcaccataatgcaaagagatagggtatttgttttactcagaaagaattaaaattaaacgtaaagcaatacaaatttttataatgttagaaaactaccaaaactacataaaggtatattctatgatgtagaaatttcattcctaagtatatatccaaatacacacacacgcatatgttcgctaaagtacacccagaagaatgctcatataagttttatttataataccccaaactggaaacaaccaaaatgcgtattagtaggagaatagtaaacttgtttattttatgagataaatactacacagcaataaaaaagaatcaaccactgataaatgcaaaaatatgaatgaatcaggaatgttgaaaaaaaaaagagaaggcagacacaaaagctctggttcaacatttagacttgtgtttcaagaaactgataactttagttctttctcctctcgctctttttttagactaatggtctatcctgaagcctgggttcagttttagcaaccgtgaaatccaggaaggtttcccataagaaaatgggatggaaggtctggaccgaacacacacagccaacagagcggaggctctgaggctcacattaatcagggaaaaggaagacagacggtcgagctgagaaacttcagccgggtgaggggactaatccctctgtaacggttgtcagtctgaaagggcatcctcactcggttctgggctcacctcgtctagttccgaagtcctgggcagtccgctcactcgagctgtcagcgcgtcctgcactgggaaaccagctgacttgccgacatactttttccacaccgcggatccgcgaacgtagattcgccacatccttttctatttcctggcatcttgtagaaaatttctcagtccaagtgcccctatgtcccaacctgtttcaatttaacaatttgaaaggtgcaataaggtgtatttctattgttattctgtatttcagagacagggcaaatccgccgttgtgacgaaagtgcagggacaaagcacaaactcggctctggtggaccggatacggaaaagcggtgccttggggagggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgtgaactgtaaataccaagccttgaaagggaccatggtgcggcctgtgaggtgggtagttcctgacattcgtcgggggtgggaggaaaactaagggaaaagacatgagactaaggggaaaggatcgagtaagaccggagggcagcgatggtggggttaggatggacggttatcaagaacccagtctccagtgagagccacccgttgctcagaagtatcctagcatcgtagctttttccttctctttgcctcccttcacaaccgtcgccgtttcttttaccaagaccttgttagcgtttgaacagcgctttacatttcaccgagcgcccaattatgtgttattttatttgtttatcactgtagttatttgatatagaaagagtaagcattcctgttgtattgatttaacatttctacgtatagagggtaagttatctgagtcatacagcccagtaagtggcagggcaatactcaaacctaagtcatctcactcaagatcctctgtgctttccatcgtggtattagaaacgattcttctatttacacagttgagtgccatggaagcctatagttagccattcatttaataaagttattgaatatattcacttctttagtgtacgaggtgctggaggttacattccagtgggaggtgaggttagggggccgaaaataagcctcgaaatatgagagtgcgaaagaggaaagcactactttaaatatagtagttaatatgtgactctgaggcgataatgcatgcactgagtcatgaatcagggtagagggaataggagccaaggccccatacttgaccatattttagggacagtctaatgctataggattaacaagcagtggggagaatcgtagggggattaggccagagaaataggcaggtgccagaacagatagggtcttgtaagtcttagaaaggagtttaggttttattttaagtcaatgggaagtcagtggagggttttaagtaggggagaggaatctaagtttgcttttataaaggtcactggctgttggtggagaataaatgatggatagggtgaccagaacgggagcaggaaaatcaggtattatatcattggagagcggtttgggatagggtattattagtgggcatggaatggaacagatgaatttgggatgtatttcggaggcactgtggacagaacttgctgatgaagtagatgtacaggtaagggaaagaaagaatcagagatgactccacaatagttttggtctgagctacaggatggatgatctttgtattaagatagggaagactaggaaaaggaaggttaggaggtgtgagggatcaagatttctgtttcgaacatgctgaatttgaaatgggttttaagcatccaggcagtggagtcataatccctttgtaaggaacagcagttgttaaagtatggtctacagacctctgtgggtccctggaaacttctctagaggtctatgaggtcaaaactcctttcataacaatactaagatatgatttgcctttttcgctgctttgtcatttgcactgcagtgaccccgataaaactgctggcacctcagaacaattaaggcagtggcactaaattgtactactagtctttgcaatgtttactgccatactcttaaaagtaaaaaaaaaaaaaaaaatcatttcagttaagaatatgcttgatgaagtagtggaaattattatattcatcatagcttaacccttaagtatactaattaaaaataggctattgattttattttactattattcaagttcagaatttataaaggggttttcacattttattcagctctaacttctttaactctgaagagtaagagagtaatatgagtgcactttttaatagtttgcgtgaggaaacaggaagtacacataaagcacttctgtatactgatgcgtgatagttatctcaaggaaaagcacttgtgagattgtctgagttgtgagctgagcttactacctctttttcatagaacattctttttacttgaaagaacaaccagctgacaaattaggttattcacatttagccatttgacaaaaatatagaaataaaaactagaaaaacattttatttagtgcctagaggagggaggaaaaaattatttttttcactttgaatatcattttcttctaatgccctctgaagtagtacaagttgagcatcccaaatttgaaatgctccaaaatttgaaacttttgcagtacctacatggcactcaaaggaaatgttcattggagcacttcagattttagattttcagatttgggatgctcagctggtaagtatataatgcagatattccaaaatctgaaaaaatccaaaattcaaaacatttctggttccaagcatttcagataagggatactcatctcaggtggtaggaacaaggtcactcaccatttttaagtgtccgttgcataaaaatgttatttggtatggtggagagattgaaaagaaagtagcttttagtgtcaagaaatttataatctagtaaggaagatagaatgcacacacaaaacagaagaacacgtacaacgggaacttacaaatgcccaacagcaattaaacagtatagcaattataaatgttaattatgtagattattctttgtaagttacctgaatttttttcctttatcatataattgaaaagccaacaatacccaggtatatcaggtatagttgtaactattttagctaatgataaatccccgcggtaaaatgcaaatcatgttttagagttaaatattcttacttgaacccaaacacattttcatttattgaaacacatttcatttaacacatttttatttatttcgtttattcattatttattaataaatgaataatattaaataaataaataatattcattaatagccttaagtaatagtggtgagaaattgacatttgtgttaatgaaaaaattctgttttggtcatagacataagaaaccagtcaattactcacagtttgaccactctgacagtgatggtaagtaaagcttcttatttttgttctaaagatttggaaactcatttcctcggaatttatatgacatatatagctcaaacactgactaaattgcccaaatgcatatgaggtaggtctggaaagatagttttctaatcatttgggataattatgctgataattatactgataaaaattatgttagtaggtgataaatgaacaggccaggtgaaaagtctctttagatctaaactactctaaagtccatagttgcaacatagaggtttgtctcctattccatccctgaagaaggaaaacactgtctttttgagatacaaagatgttacagcatattatataaaatccctattaattgtactataaaacaagaccttgaagaaaggttaggcttatgttatgccttttaagcattagtcatatgtttacttgactctgctatgattgaaaagtttgaggaacattgcattagattatgttatatgttgaagtggatttaatatttctttcttagaccactagagttttctgtaagtcaaatatttagtaagtcttcggtttgaaggaatctgtttttgccttgagcacagccttaactgtatctaccacttgggaaaaagagtgtagagtataacatctagctttttttttttttttgtcatcagtctgtcatcagatacttataaattgccaggtgtgtagtagtaggtggggggagtcctaagttatcttatttttacatggggaagcatataagagacaacaagtattagtgcttgctgagtatgtgatgaagactgcatagaccctgaaagtatgcatatatgtgttgtatacatgtggaaaagccacagcagtagttttacgttgacagtcaagagtagaactacaacagttcagaggattggtaagacagaaaaacctgtgagaaacagtaatggactggaaaagaacatccttttgcaagaaaataagaagttactttggtaggatcttaggaagatcattatggtaatggaaagagaaaatactactattgtaaaaatcctcaaataggagctactttctcttccccccataatgcttatttcctctagcatggttaatgtactaggaataggtaatgggcttttttttctcttttttttgagacggagtctcactcttgcacctaggctagagtgcaacagcgcgatcttggctcactgcaacctctgcctcccaggttcaagcgattctcccacctcacctcctgagtagctgggattataggtgtccgccaccatgcctggctaatttttgtattttttagtagagacagggtttcaccactttggccaggctggtcttgaactcgtgacttcaggtgatctgcccgccttggcctcccaaagtgctgggattacaagtgtgagccactgtgcctggcccaagtaatgggctttgaaaaaagatatttggctacattgtgaagttcccataaaaataatttatttccacttttcaatgtgattaaattctaccaatttttctaatggttttacaggtttttaatcattttttctttgacacttatatgctgtcttaattgcttttgcagtttttagtgaattggtttttgatagactgatatttttaaatataaagggcacaaaaacaaaagtcgaaatagataaatgagagtaaagataaacaaaatactaacaatgatttttaaattgtggaaattaaacaatttgcctagcctataaaaacttgaacacacatggtaatgattttcatttatgaagaaaataatatttttcttttggttttaattcacacatgaatagatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggtgagaggtaagacatgcagtaaatatatgacattagatgtgttaattttaaagagacacagattcgaacccttgatttaaattagaacttgggcagagtcataggtcttattttactaggtgcagtcagaaaacaggacgtactatttttttctggctttctgacttaaagaaattcacaaacattcaaggaagtatcattaaatattaagacaataatgattgtagaattcagaagttatgactggttttgacaggacccagcacttatctctgaattcctcaaatcatacgagactactttgttaaaaatgacattagatgacttaagatgattaagacacaagatgacttaatatgaggacagtttttaaaatataaaaccatgtattttcttgcagaaaaagatgtcttctccccatgttgttaagatttatccagcagtgagaagttcccatagtttctagactaaccgtggaattccattagatagtatcaagaggcagaaaggagtgaaggaagtccttagagacccaaaacttgcagtatggagaagagatgggcggaaggggaatattaacaaatggaacatggcatatataatgttttactgccacaagtttctctatgaaaagtgagttagcctggagaaacttacctcatgtcatgctcttttttgcttttcttttttttggtttttgtttgtgagtttcttgtattacattttaaatatatagaaaaaggaacccacacgtgggagaaaatatttgtaaatcagataactgataagggactgtatccagagtatacacagaactcgtaaaactcaacagtaaaaagactaacaacacaatttaaaatgtgcaaaagatttcaatagactttctccagagaagataaacaaataaccaataaacacatgaaaagatgctcaatatcattagctgtgagggcaatgcaaatcaaaatcagaatgagataatacttcacacccactagatgacttaatacaaaagacaaggaatgtggagaaatttgaaccctcatatattgctggtgggaaagtaaaatggtgcagctaaattggaaaatggtttagcagttcctcaaaatgttaaacagagttattacatgacccagcctatgtatgtatccaagagaaatgaaaacatatgcccacacaaaaacccatacatgaatgttcacagcaacattattcataatagctaaaaaaaaatggaggcaatctaaatgtctatctgctaatgaatggataagtaaaatgtggtttccacaaaatggaatatttttcagccatagaaagaaatgacaactgataactgatatatactgcaatatggatgaaccttggaaacatcattctgagtgaaagaagccagatatacaggtcacatattacatgatttcatttgcatgaaatgtccagaataggcaaatccatagaaacggaaagcagattaatggttgctaggaggggagaggggtaaacaggaagtgaatgctaatgggtatggggtttctttttggggtaataaagatgttctgaaattaggtagtgttggtggttttacagctctgtgaatgtactaaaaactgctgaattgtttactttaaaaggtaaactttatgatatgtgaattatatcttaagaaaactgttattctaaaaaaataaattctttaaggtacatctcagtgcttcttcctttatgtaacttttccttatctgtctttgacgttttcttcctcttatactccatagcacttttgagcagcttgaataggactttatagtctgccttttataggataattattagcatgtcttgtttccccaccctcctcctttaattgcagactccctgaaggtacttttagtattccagctagtgcagtgccttgtacaaagtaagtgcttggtaaaatatttgttaaagtctggattgggaggaagagatgtaaaaaaatgataataattttaatttaatgtaagagctataaaatctgctaaaggggagtgggtgaggtcaaggaagagttttaagtggaagtgatgtttgaaccaagtctgttttgggttgagtagggtgtttcccacctggacacagctggtagtaaggtgacacattacaatgaaagggaacagtcattgcaaagaggcacatggtcctcctatttcaaacctcttattctgtatgtaacatgatactgtgacattttaggagtcttatcttatcatcaaaggtctattaatgatgattgtttaaaaacatttttgcgaagttagcaactcttgaatagtaatttggagaaatctcaaactttgctctttagttgagattgatattttgaagaactcattattacttgtgtatctattttaggatggctttagatgacaagctctaccagagagacttagaagttgcactagctttatcagtgaaggaacttccaacagtcaccactaatgtgcagaactctcaagataaaagtaactttattttctgtatatttagctttaaaaccttcttaatgcttttgtgattatttgtttgggtgggccttcacagaggaaacaggtaaaatgtgaatactttgcactataaatagacccatttgcagagaatacgattggatttagttcttaattcagctgcctaaatctcatacaaacagacatacatctctgcttaacacccagaataagcttgagggcacggactgtgagcctcagtgttcgaattatatgttgttgtacagtgaacatttaatttcttcatcaaatgatttgatctgtacagtcctaacaatccatctccattttttccagatcagttaaacataccctaattatggtaatttttattacttacaaaggtcaaaggtattaatttggttagcaagttcagtagacttaagagaatggcttttggatttctctgttgattttctcctttgatttttctggcaatatattaatattctagagaggcagaaatcattattcctgaaaaagatactctactgctaaaatgctttttggcttaaagtttttatgttgggggatattttagcttattatcttatttaggggtatacatggagcttttttctttgtttcttaaatcagtactgcctccttatttatttatttatttgagacagggtctctctctgtcatccaggcaggaatacagtggcatgatcatggctcaatacaaccttgacctcctaggctcaagcagtcctcctgcctcagcctcctgagtagccgggactacaggcatgtgccgccatgcctggctaattttttattttgtagagaggggtctcactatgttgcgcatgctgccctcaaactcccagcctcaagcaatcctcctgcctcagcctcccaaagtgctgggattacaggcgagagccaccttatctggctgcctcctctttaaaaagaaatgaaagtttgattaggaagacttttagtaaccaagaatcaaagaaacatcaaaagagaattatcatgaattacatttaaaatggaggcactgaaattcatctctctcttttaagacattgtagaatgtataaggggagttccttagaagtattaatattataccatttcttattaaataatgcaccttatagcattggaatttaatagtaccaattattatgtcttaaagtcctcttagaatgctttgggtcattttaaggttattataacgattggagagttcttaacgttagtaaaagcatggatttgcctacacagaattgatagtttattgaccatttcctgtatattaggcacaataataagcaattcctatgtgagatccacatttggtcttctgtaataccactgggtaagacactatttttatctccacattatagatgaggaaattcagtcttaggataagcaacttgcccatggtcatatagccagtttacatggtagagcctgaatttaaacatgttagatttcagagcccagacttctaaccatatgttaacctctctgaataaaattattgtgccagttggagtttgggatcatttatttatatctaaatgctattacattttagtactaattttcctatatctagacattgattaagatatatctgaattttctttcttattccttatatttaggcattgaaaaacatggcagtagtaaaatagaaacaatgaataagtctcctcatatctctaattgcagtgtagccagtgattatttaggtaagttttttatattaataatttttctcatcaacaatgctgtttctctgacttttgtttaaattgctgaaattgtggctagaagcaagttctttaaatttgtcaagactctcttgatgtcatggcctttatttctttgtgttttagtctcattctgtcgtactgcagacacacattcttccctgaagggtcataactacccgtggcttctagttggagcaactgacctttgaagaaaggggctgcatattcccaattctagtttgaaaattttgggggaaagattatctctgtttgggtcttggatttatccctaaaactagaggtgttcccagggcactgatgtaccatggttgacccagattgggctaatagtctattactggaagcatgggagggatgaacctgggcaaataaaaacaatagctgtaatagagtctggtctgcagttcttgaaatatcagttgtcacagaaagttttccattgatttttatgcctctcctgaagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtaggttttattctacttcgaaattaattctatgggaattcagtcaaaaaagttcttggaagctattaattgtgcaaagcactgtgttaaacctttggggtgtgcaaacttcagggacacacagaacagttcaattcagtgatagcatttggggaaaaagttttttctacgagttaacctttaagctatgccttgaaaaatgagtagcgtttcaacaaactaaaggtgtaaagtagcatttctgactaacagaaaggcattacctgtggaatagacaaatgctctatttgtctctaactgaggcttgctgggatgaacatggaagaggctcgagagggaggctggtactaatcagggagggtctcagacccactggaagaagtgtaggcttttttttcctggaggtagtagaaatccatgaattattctgaggcagaagtgatatgaaatctatattttattatgatggtttttagactcatttagaaattgggcaaatggaaagtgtagtgaccttgacagaacattataacatattaattaaaaatttaaattcataaattcataaatgtaggccaaatcaagataccatattttagattttgatatactatcaacaaacaataacagatttgctcatcgtcacttattcgactaatatttgaatgctttttatgtgcattatattctagatactagggatacaatagtgaaaaaaacaaacagctcctgtccttctggaacaacggaaatacatgaaaaaagactgttttgcatttgttttactttgggagggcctgggagacaggaaaatgcaaagacactctttgagcgccaatgtgatgcttaaaggaaatactcatttgagcattttggatttctggaattggaatgcccaactggtataatgcagatgttccaaaacccaaagaaaatctgaaccctgaaacatgtctggtcccaagcacctcagataagggatactcagcctatactatatgatctagcaatccacttctgagtatgtatccaaaacgattgaaagcaggatctcagggagacatttgcatacccgtgttcatagcagcattattcataatagccaagaagtggaagcagccccaaagtgacatttcagttttccccctgcattcgcttgtcctggatgagaatagaaaggaccatgtgtgaccttcattagggaaagaaaagagaaaattgcagagaagataagtcttttctctaacagttcccaaaatccgtaactgaagtgtttgggccttccagattttcctctatgggatgcgaatgacttggaattttgggaattccaactccccatctctaattttatttaaattgctttctcaattgactgacgaagattagttggaccccatttctgaacaagcttgttaaacagaaatgttgccagggcctactgtttatcctcttgagccaagaagagaatccttcagacttctaagttactgaacacatgcagtatcagaactattggatacacagaaagttttgttgtagataatatatttggaaagtttggagaaagttcctctaccccttgccttctttgagcggagagcttcttaggattgcttgaatttgcaggctgcatttctaacagccctcatgggacctgctggcctttctgggctgattctctatagcacgggaaccgttatgtgaacatgtgagttgattatctttaacattgtgtgtgggaacaatgatagaataaggacattgcaatttgaagatcataatgacattgttttttgtttttgtttcgttttgttttttgagatggaatctcgctctgtcgcccaggcgggagtgtagtggcacgatcttggctgaccatggcctccgcctcacaggttcaagcaattcttgtgtctcagcctcccaagtagctgggactacaggcatgcgccaccatgcctaactaatttctgtatttttagtagagatggagtttcagcatgttggccagggtggtcttgaactcctgacctcatgtgatccacctgctttggcctaccaaagtgttgggattacagaggtgaaccactgtgcccagcccataaatgacattgttgatttaggtaaaggtcatcaatggaaggttgataaggatctttacaatgttgaattcaggctggcatcacctgaaccacctaagagagggacaaccacacattatatgatttctgatgtgatgtaatatgaagtacaaagaatatacttatgaagtatattcttgccgtccctcctccccccaccaccaaaaaaagcgagcctgaatccactcaagccttgagagcagaattccagctcacataaaatgcaagaatatggccgggcacagtggctcacacctgtaatcccagcactttgggaggctgaggtgggtggatcagttgaagtcaggagttcgagaccagcctggccaacatggtgaaaccccttctctactaaaacacaaaaattagctgggcgtggtgttgtgtgcctgtaatcccagctacttgggaggctgaagcaggagaattgcttgaacctgggagacagaggttgcagtgagccaggattgtgccactgcactccagcctgggcgacagagtgaggctccatctcaaaaaaaaaaaaaaaaagcaagattaagttaaatgacaccatgagctagaaaacagacaaatccagaatttaggacattctacaggacaattgactcaactgcttcagcaagtcagacacaagggaggacagggagaagatactgctctatattaaaagagattaatatagactgaatagaagatgataccaagaaactagtgttggtattgctagatgtaataatggcattgttgtatgagaaaatgcttatgttttttagagatacattctgaagtatgtaggaatgtaatgatgtgatgccttgattttattttaatatactacaaaagggaatagaagaagaagagcgagatagatgaaacaaatggagcaaaatgttgataattgttgaatctgagtggtggtttattactgtctactgtggtataggtttgaaaattttatatgattgtattttacatataatatttcttatagataggtagatattagtatgtggggacaatagtggttatctctgagtggtgagattacagagtagattttctttaataaagttttgtatggtctgtattttctacaatcagcatgtactgtttatttttcattttatttgtacattttttgatttaagcattttctgcaataagcatgtccataatattaaaaatgtaaaaaagttttatattaatataggactaaccctatttacacttagttttcagagtttatctacaaggcatggttttctgatcctaaccccctcaaaaaatagaaagatcattgcttaactatcaggttaggaaatgcttttttctagagcagctgtagcactttcaaaattagatcactggcttatattttgccacgaagtgcagaaaagcatttttgagaaataaaggtttgtcccaaatgaaatcagctctaggattatctgctaagattgttgtgtatggttatctcaattctcatttggtctgttccagaatgttgaagtttatgtgattaagggaaggctcactattaccataaatgtcactgttttgaaagactagctattgtcataccctaccattcttttcaaaagtcactgagttaaaatggtaaaatctgaagtaaagattactgatgggaaatttatagtgatggtggtaatagcaaacaattttattttgctcagtatattgcagatgttattctaaatgcattatatatatattaactcatttaatccacgcaacaaccctttgatggaggtttacagttatccccattttctaggtgaggaaactgaggctcagtgaagttagtgacctgtctgaggatgcaaacccaggcacccacaatggcaaccactgcagtgttctgctactggaaacagtgcagcacaaaggtgcataagaatctgaaagctgtggataaagttaaggcaacagaatcctcactttttagagcaaagatgaactatataatcttctgttttaggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttgggtaagcttggtccaaaacacttaattttataaaggaaatgtatgtggtttgtttgccgtatttttcttatttttgcctttgttctctttaacattttcctaacgtccatttcttgttaaaatatgtaaaaggaaggtggggtggggaagggagaaaagcggacaagaatgctgactccactacgtatgctagcacttactgtatatgacctcactttggtactcatggctgccgtctgtggttagctgttgtcacctgcattctacagtgaaaaactgagtgtcagagaggttaaataatttgttggaaatcttacatctaataggtgaagggctagaatttgaacccatgtttgtccattcagagtctaagctgtatcttggaccatattttctccagacaaaacaaggaagtttgcataattctaattttttgcttttgtgctttacttagtctgatttgagagctcttttgccacatgtttagggccctttttttttttttatttccccaaaacaaattccattagaaactacttttatgataaaacgtttaaaatttatggtgactcgaacatggaatacctgtttcttgtgtaaaagaagttaggatatttttgagttcatagtatatgataggttattgcaaaatataactgtcattaactgagtttgttttatttcttgataatcatttttatgtcttggtttatttaatatatatgctattgatattaaaagttccattatttagtctttccatttattcataggagctgctgtcaccttcagtagcctgttgctgagtacttactaagaattaaatgagaattaagtactgattgagttatattcttctctctcctgtattttgaattaatgaggttttttaattagagtgttttttttttaattgatgacttcatctgggttccagaaattctgagtatcagaagtcgaaagtggttctcactgggctaaaatcaagtagtcagcaaaactgtggtcctttgtggaggctctaggagacaaaccacgttcttgtcttttctagctccttgagggtgcatttcttggcttgtggccccttccaccttcagagagcaatggcagggactttctcacatcatgttactcgactctgactttcttcctgctcacgtttacttataaggaccctgtgattacattgggcccctccagataattcagtgtaatttccccatctaagattcttaattacatctgcaaagtccctttgccatgtaaggtaacatattcacatgttctggcaatgacgatgtagacatctgaggagccagtattctgcctactacaagctataataggaaaaagttattaacaccatgaatatattttgtattttctttagatgtttgtttatgcttcttcaccaagacacactaataactaaaaataaaacttcagttcccaagttggagtttaccatttaaaatcttttctctatcccttggagcaagttgcttcacaactgagatttaatatataatattagaaatgaaatttaaccattaagtgataggactaggaattaggaaaaatggattatatttttagtcctactagtaatgtattgggtaaactttgcgaattgtgtctagcacatgttataattttcccttgatagaaaaaatgttgagagctatgctgtccaatatggtaacctctagccatgtgtggctatattacatttgaattaattaaaattaagtaaaatttaaaaatcagttcctcagttttgcaagccacatttcaagtgcacagtaactgtatatggctagcggctaccatattggacagcacaaaacacaaaacatttctataatcacagaaagttccatcagacagtgctgatctagaggatgcagatgttaacattaggaagagtatacggtgaaaatgttcatgtttatatgtgttgaaatacccctaggtatctcaaaacaagcactgtctgaaagtgaacttaatgccacctctcctccctccccaccaccaaaaaaataaataaatagaaccaaaacatacttccaggcttgtgtttattctctagataaatggcaccatcaaagtgtgcccatgacaggaacctgcaagtcatggattatttcttcatctccattgctgcctcccacctatttttgccaaaacatatctaatgtgctgttttccttctattctccaccttagcaggcccccatttcctcttacctgattaccataataaccttctaagtagcctacttctcctacactaccaccagaaagatgtttttaaaatacaaatcactcctgagaaaaatatgtgcatgactgtgactagccagactcttgtacatggtctgcaaagctcttcataagtgatctacacccagtgtctatctctcacatttcctacccttgagatttctgctccagccgtacactgaaccagtcagtactactgattctggaacttggtgcatcctccatctttgcacactgtactccctctgcctggaaagcttctctcaattcacctttactcttcaatcttgatttggttcagaccatcctcactcacctccttctaactttaaaacacatacccccagattgcagtttccttttctacttggcatacctttagagtctgccatatcccttaccacactgcattttacacatctttactttcctgttcttcccactgaagtctagtgactaaaccttaaagtccttgggagcaggagccatgtttctaaccctagagcctgacacataatctcactgacacatactcacgagacactattgtgtaatggttagttacaaggatgggattttggaggaaaatctggtttctaagcttagatgcttactagctgtcagactacaggcagattgcttaacgtctctgtttccttctctgagagtggggatagtaatatctgtattggagttgttgtaaagagttagaggtaatgtgtgtgatatgcctaccacactgcctggcatattaatgctcataaaagatggctattcttaggctctcaataaatgtttgttgattaataagtttattttttatatgattatgtaactttataatttttacacatatatgctagacttactttttcttcctgcatgacaaacatttttacgtatatttttcaaataagtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccaggtatggcatatttatcatcaaggacaggagcttggaaaattatcactggtaaatttttttcctagttacaaacatcatgtgtgagcatttccccatattattacatattcttcaaaaccaaagttcctggttgctgcatatattcatttatttaaccattccttattattggacatccaggtttattattttttcagtgctataaataagattgcaataagtgcaaatgtccttattttagaaatctctgggcatattactgattattttcctaggataaaatttctagtaggaaaattacagtgttaaagggtgtaaacatttgagattcctgaagtatgtatttctggcagcaaatcttttgctcaggacctgctgacctccacagtctgactgaagccttgggatctatatgtggcaattctagcatttaacaaatgccctagcaaactcaacctcttgctttcacaaatttcacttctctgttttcttttgctccacagccaagtctcatggatccttcaagaattctttgaccttcacccttcttgacattactaaaaccctaatccaggcccaaattgttgctgcctttcctaaccagtcctgtctttactttctgtcatccacctgcatgaaccgtccacttcagtgaaattgaaacactttttgtctctcaaacatgttgtatgtatgcctctctcagggcctctcttaatcctcctctgcctggtgtgtctttcttcatgtgtcccctctccttgcctgagcccttccaattctactcctgtttttcttttgaggggcctctcttgattggtccacagtgctcactcccctgctgactactattcatagatttaggcgtgagctgtgaggctgcatgattacttaacttacagagtcttcatttcatcatgtgaaatattgggaacaactgtaatctttaaagtccattctggtttacaacttctaagatttttaatgaggacttaaaaactttttggagaaggaaaggagggaagattaattacttgatgtcatatcattcaaagagtaatacttagtatatttctaaaaataattaatgcttccccaatgaaggaaatttaaatggagtgatataactatagaaatttaaaagtagcataattaaaaaaatacaaggaaacagtggaatgatggataaagagttaatgtcatcaagcacaaagtgcttatcaagtcagcatgtgacagtcaggcaagtgatgtaaacgagtgaattgggcccatgcagtagacttgcgtgggtaggaattttgttggactcaggagcgcgtacccttttgaaggaagcagctgctactcagctccatcgtattgtttccatgcaagattatgggcttggtatttctagatctgattgctgttttcaagagaagccagaaatccagattttaatatgaaatctgctaatttttgtaagttgattttttttgttgttgttgttagcaccatgtgaaccaaaacaatatatctgagagctagatttggccctcagattgccagtttgttacctatcttatacaactggagaagaccaccaagaccccaaaagtaaaattagccagaggcataaatataacagtgtccccaagaactattaatacaacaagaaaatatgaagagtttcagtctcactggtaattaaggaagtgtaaattaaaataaaatactattttatacctttcaaactagaaaacaataaagcagtatagtctgagttatagggtagcaggtataattatttattttaaatttataatactgttgtgtaggcgagcaactacagtcaccatcaactgtgaacattcatgtggataattttgaaatagatggaaataattgcgacattaggataatagtataatgaaactagtataaataaataacaatatttgccatttttaaaggtatttaataattgaaaaatagactcttcaaggactacttgtaaaaattgcaggaccttaaaaatgcatttgctttttctattactttagaaattataattatatgcatttttgtatgcctttacaactagcattatttgttcccagccttcctttttcagctttcatggtgaggttttagtgtcattaccttggcttctgggatgtttggaaataggcaatactgtattaatttctgctctttagaacattctgttcttttgatctagtttattgcttgatagacactggaaagcagaataatgcttaactaccttttttttgctgcttattttataaattaatctttgttaagagatttctgacatcatcagcatcacatcatatgtttcctttcagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtctattgctgttgtacacttcttttatctaacgtatatttttatagtgtcatataccagccccctaacctgccccacctgtcccctttttaaaaacatattttccagttacatagcactgaggtactctatttggtgtagatcaacaataaacataagagcctactgtatattaggtactgatataattgattaatcatctggcaccagctcaataacctgtttttgccgtgttctttatagtttatcaggggatttgaaaattacctcaaagtatgttaaaaccagcctggctgaaagcactgatacctttatgttgccaaacccagtgtacaattttctcacctaatcttatacaccctattcattatactctgatgaaaacatttgatttccttggctcatgtgacacatttctttgtcatttcttcccatctccatgcctactcttcattattttgcagctttctaatctgttgtgtcacctttacctacttgtcttaccagtttcatgttctatgcaaactccaggggtcacttatgtgacagtgactgccaagtcagggtctgtaccctataccatgctcttgacaacagaacctgtggatggtccactgacaatttgatgtagcagatcagttgttaaattcaacgtctcctcctacccctgacatctctcctgtgttttctgttggtaaatgaatggcaccaccatcactgcaggtgccaaaggtgtcatcctgggattgagtcttctctcgactttcacatccagtcaccaagtcttactccatttcctaaatttctcaaaactactcttccatgtgctctcccttactctgaaacatcatcactcactatttctaacaggcatccttgccttgattcttaacctactcgggcctacttccattgttattgccacagagggttttataaaataaagtcagcatgaacacccctctgcagtctgcacatacacaccttaccctggtcgagttcatagcctacttggtgtctgactccccctttcctgctgcttcaaccttgtctctgcccacgtgcaactttgatccctgccccactaaactgggtgctggcacaatggtaccaagcttttctatggctctggccttcagaataggacttgcctcctttacgtagacaactactgcctgtccttgaagactcagattcaactcagctctttcagaaagcttcatttgaatgtcttttctgcctggaccagactgtgcacctccaggtcaacctactgccactcaattacaaatttcccttttcatgctttctacaatctggtgcagagtaagcactcaaaaagtgttcagctgatatatggattttacccagaacttttgctatgtacttactttttttctttttctttttctttttttcttttttttttttttttttgagatgcagtctcgttctgtcgccaggctggagtgcagtggcgcgatctcggctcactgcaacctccgcctcccgggttccagcgattctcctgcctcagcctcccaagtagctgggactacaggcacgcaccaccacgccccgcttatttttgtatttttagtagagacggggtttcaccatgttggccaggatggtcttgatctcttggcctcgtgatccacccgccttggcctctcaaagtgctgggattacagaaaaaaatgtctaaatagagacaggggcgggggggtctcactactttgagcagtttggtctcgaactccagacctcaagtggtctgcctaggcctcccaaagtgctgggattgcaggtgtaaaaccaccgcgcccggccagaacttctgtgatgtaattctgataaccacatgcttcgcttgaagaaggggagagagtagggataatttcatgtgtccggtctgggcaaccaactttaagttctttatgctgggattttgttcaattcttgccctatactttaaagaactggggcaagagaatgcgagtag

SEQ ID NO: 13888 - DNA, 8237 bp, Human; identical to SEQ ID NO: 12067

SEQ ID NO: 13889 - DNA, 14084 bp, Human
ctttacctttcacaaccagaataagaaatgcagggcaaatgttcctaagtgatttgcatctcaattctgaaagctagctatttcttcaattagctaagacgtagcattatatttataatccattctgtggctattagtaaagaagactgttttacatataaacatttcatgtcatacttcttccactcaaccctggggagacaagcaccatgtgtcctagagattcatcctgggtaaaagcctgggtttttagagaataacagaggactgctttgccacctgcacttttttaccaagctcctggctctcatggctttagctctaacatgttgtatgggtttggacaccttgaaaagtgcttaggaggtcttggggccagacctggattcaaatccaacctcttccacatgttacctttctatctctaggcaagttacttaaactgtgtgcatagatcagtttcctgatctatataaagaaaataacagcatctcctcaaagagttattctgaagatgaaatgggttactacaagtaaagcacttagagcagtaagtggaacagtaagctctccatgagcgttagttcttgctgtgattctttggagaagcagcctagggaaggagaagaccttgtcctggctctaccatttatttgctttgtgcctttggacatggaaacactaagatttccatttcttcatgtaaagtattaaaatcttgataatgcatggagtgcctatctcacagagtggcagtgaggttcaaataagctaatagatgtgaaaatgctttgtaaactataaaaaaaaactgtacaaatgtagggtaacaaatgccatctctttctgtctatacctgtaagcttgcactcattttgtattatagttacttatttttatctgcctcctgcattagatttgagctcctcaagataggaatcacatcttgctgtctcctatatcaacctgtacatgagtctagcttgatgcctgtacatggcatatactcagtacagggaaactggaagaatagcaaactccttgtgtgttttttcgggtgtgtgttccagtagcttgctcccctttagactgtatgtgccaggactattccacccgacatcaggtgtagcttcccagagggctcactgtgaacagcatctgcaggcaggcatccaacaccaagctgagcactcatgtacagacactaaatgtggggacaccctgtcctgaggctcggatccccagtgctcagccagcagctgttccaatccccatgaggtctctgaatgagtctccttactactggagagactactagtttagttgccctcgatagtccaaactagggaaattgagaaattgaaccttggcatattcagtgaagtccagactaaggaagctgagaaactgaaccttggcatgttcactgacctcaaggccttacttctttttcttccatttcaaaatcttcccaaaatggcaactttggcttttgtgcccctgctcctagctcccatctttcatgaagtgggtgttcttagaggatgccatctgcctgatggtgtcatgtatctctatatcctgcaagctacccaccaaatcctgctcacagattaagcactggatacatacttgctgattggaatttaaagaaaaccaaaataagtaaactcgacaggagattaattgcctaggagtcggttgactgcttgactgaagctggattttttttgggaaccgctggctgccttcacatttcctgatggaagtgggacaggtcaacagacagcccagagtggcagataacttttgcccacacgtcattcattttttggagcgttggcttgaaattgaggggtgtgtgtgtctggaaccgacgtgccttccgtgcgcctccggggtctttgcactttctttcaatgggctgattacaacacagaggatgtggacagtggagtttttcctgtttgatgtcacactgctaccctttaaaagtctgacggcaaaaaggagggaatccagtctaggatcctcacaccagctacttgcaagggagaaggaaaaggccagtaaggcctgggccaggagagtcccgacaggagtgtcaggtttcaatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgagtagggcttcaggctgggaagaaggggagcacccttgttgtccatctacaggaggcttggggaggttggggactagactggagggctaatccaaccctcctagctttctgcccaggaaccacttattgtctttgtgtgtgtgtgtgtttgtgtgtgtgtgtgtgcgtgtgtatttaaaacttaggggaagattctgtcactctcctaattagcatttgctggtttttctcaatatgaataatttttatttcaactaaaacccttcccacagtaggagccatgttccctttgccccgtcaaaagattgaaaaaatgtacagaaagaaaggcaaggagtctaagagaaaaagaagccaggcagatcaacagacactaagtttcagctcatggactttggactgggttaactagggaggttgtaaagattcctgggtcatacccagattgttatagataaatctgggggctctttccaactctggccttataaaaattcttggaaaaatgtattaaagacagactgtccatgtatgttgtcttggtgagaatggccaagtatacaacccatccacccattcatttgtccatgcatccatccatccatccatccatccatccatccatccatccatccaacaggtttaatgggtgtttcagacacccaggtacccaggtacccagtatgagttggtgattcttctctgtggaactgaaaggtgtccagtcagtagcaagtcaagctagttagaaacttattggcaacatgagacaactggaatgtttttaaagatcaggtttgtggagaattggatcacaatccacaataatcaatccattagcaatgattcaaatgagggtccctttgtgtgcacctatataaggggtaatgtggtgaaagcagggatagatattgaaaaagactggatcttctattttaagaaaacgtgagaaaacacctcaaagcatacagaaaaatgcaaactgatccaatatagctcaaattaaaggaaagaaaaattagttagacaatctctaactaaagaaaacataggaattatgatttgccctttattgttgtaataaataaattaattatttttgctgtgaccttgctgtgtgtgaggcatttattcttctaggctccaaaggtccttaaacctggttgcaagatatacaacatgcaaaattaagttgcaagatatataacatgcgaaattgacagtttaacctcttcaagtactaaatgcatattgacaggagataaaaggagagaggaaagttctctccgaataccaaacaggttccagaactccagagaatatagtaagactcaggagtcaacatcttggaaaccaagtttgagtctcatggcaaaaatttcaattaaatctggatacacttgatgcacccgaagtgttgttcattttattcaatggatatttaataggatctaccatgtgcctggcattctaccaagcgctgtggctgaaaactaagacacaacccttcaaggacctcatggtctgtcgtcctaccttgtcagccagctcactaccagactttcaggaaatgcaattttgcatgtctcatggaggggacacccttactctaattcaagactatatgtggccgggcgcggtggctcacgcctgtaatcccagcactctgggaggccgaggcaggcagatcacgaggtcaggagatcgagaccatcctggctaacacggtgaaaccccgtctctactaaaaatacaaaaaattagccaggcgtggtggcaggcgcctgtagtcccagctacttgggaggctgaggcaggagaatggcgtgaacccgggaggcggagcttgcagtgagccgagattgcgccactgcactccagcctgggtgacagagcgagactccacctcaaaaaaaaaaaaaaaaaaaaaaaaaaaagactatatgtgatttaaaatgcagaatagtagattatggtaaattattttgattctcttagatggaaagggctgcatccaactagagaatgtttatacaacttgtctcgaatcctggaatcccgttgctgaaaggaactccttaaagacgtttcttcctgaacaagaattagggtagaacagaacaggccggctacggtggggagtgagtgtgaagagtcaacctcctgggctggcagtctgaacttagaccttttccttgaaagcccacctcgtatcaggccccaagggatcactgagtgctagttagagtgaattaaaatgactgagaagcagcaaaataaattgaactgacttcagatttttaaaaatagaaatgtgattttgtttccttagacataggcactagctaaacattgcatctttaaagagttaaacatgaatgcggggaggggaacttcgggtcagggtagtgggagggagatctacttttcctagtctatgtagataactttttgtactgttcaatgagttgtcatgtgtattatgggaaaaaaaaagtgcaggaaaaaattacacactacaattaaaagttacccaaaagaggccagatgcggtggctcacgcgtataatctcagcactttgggaggccgaggtgggaggatcacttgaagtcaggggttcgagaccagtctggccaacatggggaaaccctgtctctactaaaaatacaaaaattagtggggtgtggtgcctgcctgtagtcacagctacttgggaggctgaggcagaagaatcgcttgtaccccagaggtggagcttgcagtgagctgagatcgcaccactgtgctccagcctgggtgacagagtgagactccgtctcaaaaaaaaaacgttacccaaaagaaagaggaaagattaatgcatgtagataagaagcacaactaattaaatgtctggtgaaggatttgtaatgacctcatcagtgactgttaagcaatgtttttacactgatggaaacctaaaatgtgaggggtattttttcccctcctaattatccatttctattgaattctggtttatcttattactttgctgtaagaaattcttaagagttgagtgcacaacccatctttgggtcactggacttgacaaaatgaagttatctcctgcctaccagattcttcaagctcccttaggactcacaagcgctgctgccaggtacccctctggtgtccttatcacccgttccatgaacaaggccatcctctgactcccctttatccttattatatggaaacagcaagagagagatgcttattgtccctggtaatatcatttcctagatcctgctattttcacttcctccatcttccccataggaactatctttattgaagctgaattaccgctgagctccttcagcctttttcatacgtttttcttttgaggtgctcaaagcacttcactgctatcatcttatttatcacttactggccacaagagtagaatggagtagataattttctacttctataagcagaggttgaagcaaagtggtaatagtaaaaattactagcacttaggaagtgctttctaaaggataaaaacattatctcattatgtcttcaagatgaccaaatgaggtaaatgtttctgctgtcctcattttatatgtgaaaaaacaagagttaaagaacttaaataactggctgaaggtcagacaggtagtaaaagacctagaggacaccttgaccccaaatcccaagctgttccaaggtcacacgcacggagacacctccgtcattgaaggcaaagtccattaagcctgctcagctccaacaggcggggctggttgctccggcagtccatggtttgttccttccttctgcaaaattctcccttgaatctgtgcagactgcgaaaagatgccttttgaaagcacaaaggaaagaaactctgactctctcacattttctaaactttcacattggctcacactgtttgatggaagagtctgtgtgccctccgtagcagcttctcacagttcctcaaccaccgccggatgttttctagggggactggctctggaaaccaggagcgtgtgtgccatacacactgcccacactgaccccaagcatcaagccagcacacctgtcaaggcatgggcccggcataaacagcaggtcagaacacgccacgtgatgtcctctgtttgctcgacactttcgagtcacttttaccaccattatccccttcgatcatcaccctatgaagtaggcaggacagccattgttctatttcacagctgaggaaactgaggctagtgcaaggtcagcaagtggcacaattgggaccaaaatccaagtcccctggttcttggcacctggctcagtgccccttccccgagcccttagtgctgctgtgactccttgtcctcactgcctgcagcatgtattttagcatttgatattgtcttctcagactcttagtgatttctgctggaggcttgttaccgggtggtgggaagatgtctctgacctgagtttcaatcctgtcttagtttccttatcacttaaattaggatattgctgctactactactactactaataataataatcagtactaacaatataaaatttgttttgagaatttaaaatatgtaaagtgcttagagtgcaaccgctcaaagaccattactaaatgtaattttttcccaattagactgaaaagtcaccagaacagaaaccatttctttttttttttttttgagacggagtctcactctgtcgcccaggctggagtgcagtggtgcaatctcggcttactgctagctccgcctcccaggttcatgccattctcctgcctcagcctcccgagtagctgggactacaggtgcccaccaacacacctggctaattttttttgtattttagtagagaagaggtttcaccgtgttagccaggatggtcttgatctcctgacctcatgatccacccgcctcagcctcccagagtgctgggattacaggcatgagccaccgcacccagtcgaaaccatttcttacacgttccttatatttctccaaaggtttaccacaaaactagccatacatttgagacacataggcagacaccactgtggaggaatttaagcatcctttgcgcctgtcataccccagtccactttctgggaagctttcctcaaggttcccctcagccaaactttgaaacaaattaacttctctctttggccctcttcctttctcacctttctggggcttgtctccaccctcattccctctgttccgcgtcagtccaatttcagtccctatcatgatttctactcagctagtacctaattattgctgcttattttcctcaaaggtccttgtattgagcctgcatgggataggagaagagctttggcctttaaatcacccccacgaggctccatcacttgctaggcacaaacattgggcatttacaacctctccaagctacagttgcagaagaggaattagaatccctgcatgggattctagctgcctccctggaggctatgaggtcagatgagatgcacctagaaattctgtgataggcaactggaagtggccccaaagacctaaagtaatgatttttaacagaaaatgtcaggtaattaaataacatgtggggaagaaatctcgctgaattatcacgcatgttacaccagtatatgatctaattgtgcctttgccacaaaacagtaatttaaagccattatcaattacttaagaggtaggtcgtgtgaatgggtttcaggcccttgtcggagactagtttttgagaggggacactgaaagtccatgaggggctgcacctggagaggtcaccaccaagtgagaaaatgacaaagaaccaacccaagaagagccaagaagaaaattccatccgtcacttatattgattcaacataaacagttataccctctgctcctaagcagctcactctaaggaacgcactggataggtaaactcagctaaagcaagttaaatggaatacatgctgtaatagaggtgaaggcattgtcctgaggagctgagaaggaagaacaactgattttgaatggaaagatgaggaaagtcttcatagagatggtgacgcctgagcctggtcttgaagagtgagtgacttcaataagtagagaaggaagagggagatcaactctactaccattctgtacacatactgggtgttgactgatgtattagacaattacacagacatccaggaggagaatcagactctatggcaagctggatccttgaaagacatctcagcatagatttaaaaatcacaaagtagaaggcatggaagaatgtgactatcaccacaaacattcaaaggtattagtaaggcaaaagggaaaataaagacggtccaggtagagagagagaaacatgtgttcagcacaggtagaagaattccaggagctcagagtgccccatacaggcaacaagatgaagcaggaggtgaatgactgtatgtgtgttgggggcaagagaggatgtcagaagaaacgctgaatatgcagaaatgaggctgaatttaagagtgctgaagttatcaccacccttaaaatcaatccagggaggtttcatgaaggtaggttttcaggaggtgcttgaaggtgggaattggatggcaatgagtctttgccctgcctgtttttctccataggtgccctgatgatcagatcagaggatgctggctttgtggtgattacaggtgtgatgagcagaagatacctctgcatggatttcagaggcaacatttttggatcagtgagtttcttttttgtgttggtcaccatttgcaaacaattaacctaatttctttgacacgacatagacttttctagcttaacaattccatttgcagtgtaccctggtgacctgtttccactgatacttcatgcagtctaagtatgaattaaacgtgaatgctcacgtttaatagctggggtttgaactcaggcaatctggctccagatcccaggctctcagcccctagtctgcactgcccattggaacccactttttttttttattattatactttaagttttagggtacatgtgcacattgtgcaggttagttacatacgtatacatgtgccatgctggtgtgctgcacccactaactcatcatctagcattaggtatatctcccaatgctatccctcccccctccccccaccccacaacagtccccagagtgtgatgttccccttcctgtgtccatgtgatctcattgttcaattcccacctacgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttgtggaacccacttttgaatctagcacaggccctggtatgtagtcgtaggtcctcaagtcatgtcaattcacgttgtaaagtacattagaaagggtgaaaagccattggtgtcttcttgattctgggactagctgtgactttgggtaaatctcctcacttctccaaacttcagcattttcacttggaaaaagcgaagtggaatagaccacgtgacctgtggagctccctccagttaaagatttttaattaataacccctgccccaattgtgatagctattcattcggattggtaagcaaaggatttcccaaactaaaggctgctggcctcttttggaggattttgagatagtaaaatagtaggactgcttatctcaggagtctctgaccaccacacatgcccactagaaactccacaagaacagagactttctgttttgctttctgctgcatcccagcccctacaatagtgtctggctagagtaggtaaacaaacaaacaaaaaatctgttgaaccactattgaaatatagataactaactaaacatccgttaacccctctaggcatgtagatagtcctgatctgtaaactgcttactttgtggagcttgaggattaaaagaaataacaggcaaaggccttcgtggggcactcagtaaaacccagtactagtggtagaggattcaaacccagctcatctgtcagcaaagttcatgtctccaatcccgtcagtgctctcattcatgtttgaccctataaactccatcccctctcctttctccagtaaagagacaaacccaagccaattttcagccagcagaggcttggaaaagatagagggcaggaaggacaaggtggtgcctactccaggaaaaccacaggccaggccagcccgggcctccaggcagtaagcggaggccccagtagtcgtagtctctgaaagggcgaactatatagtcagggcttgagcattaatcaaaaccactctaccccagcagggaacaaaggggtgaaggctcaacgccctaagaactgcagagcttcaggccggctggcacaagcatgtggccccaggaggagctggggagtgggtggggcccccactgccagccttcacgtggttcgctcttgtccttccagcactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctagggtcgctggaagggcaccctctttaacccatccctcagcaaacgcagctcttcccaaggaccaggtcccttgacgttccgaggatgggaaaggtgacaggggcatgtatggaatttgctgcttctctggggtcccttccacaggaggtcctgtgagaaccaacctttgaggcccaagtcatggggtttcaccgccttcctcactccatatagaacacctttcccaataggaaaccccaacaggtaaactagaaatttccccttcatgaaggtagagagaaggggtctctcccaacatatttctcttccttgtgcctctcctctttatcacttttaagcataaaaaaaaaaaaaaaaaaaaaaaaaaaagcagtgggttcctgagctcaagactttgaaggtgtagggaagaggaaatcggagatcccagaagcttctccactgccctatgcatttatgttagatgccccgatcccactggcatttgagtgtgcaaaccttgacattaacagctgaatggggcaagttgatgaaaacactactttcaagccttcgttcttccttgagcatctctggggaagagctgtcaaaagactggtggtaggctggtgaaaacttgacagctagacttgatgcttgctgaaatgaggcaggaatcataatagaaaactcagcctccctacagggtgagcaccttctgtctcgctgtctccctctgtgcagccacagccagagggcccagaatggccccactctgttcccaagcagttcatgatacagcctcaccttttggccccatctctggtttttgaaaatttggtctaaggaataaatagcttttacactggctcacgaaaatctgccctgctagaatttgcttttcaaaatggaaataaattccaactctcctaagaggcatttaattaaggctctacttccaggttgagtaggaatccattctgaacaaactacaaaaatgtgactgggaagggggctttgagagactgggactgctctgggttaggttttctgtggactgaaaaatcgtgtccttttctctaaatgaagtggcatcaaggactcagggggaaagaaatcaggggacatgttatagaagttatgaaaagacaaccacatggtcaggctcttgtctgtggtctctagggctctgcagcagcagtggctcttcgattagttaaaactctcctaggctgacacatctgggtctcaatccccttggaaattcttggtgcattaaatgaagccttaccccattactgcggttcttcctgtaagggggctccattttcctccctctctttaaatgaccacctaaaggacagtatattaacaagcaaagtcgattcaacaacagcttcttcccagtcacttttttttttctcactgccatcacatactaaccttatactttgatctattctttttggttatgagagaaatgttgggcaactgtttttacctgatggttttaagctgaacttgaaggactggttcctattctgaaacagtaaaactatgtataatagtatatagccatgcatggcaaatattttaatatttctgttttcatttcctgttggaaatattatcctgcataatagctattggaggctcctcagtgaaagatcccaaaaggattttggtggaaaactagttgtaatctcacaaactcaacactaccatcaggggttttctttatggcaaagccaaaatagctcctacaatttcttatatccctcgtcatgtggcagtatttatttatttatttggaagtttgcctatccttctatatttatagatatttataaaaatgtaacccctttttcctttcttctgtttaaaataaaaataaaatttatctcagcttctgttagcttatcctctttgtagtactacttaaaagcatgtcggaatataagaataaaaaggattatgggaggggaacattagggaaatccagagaaggcaaaattgaaaaaaagattttagaattttaaaattttcaaagatttcttccattcataaggagactcaatgattttaattgatctagacagaattatttaagttttatcaatattggatttctggtcattctaaccctaaagtgttttctttctttctttctttcttttttttttttttaagatggagtcttgctctgtcacccaggctggagtgcagtggcgcgatctcggctcactgcaacctctgcctcccaggttcaagcgattctcctgcctcagccttccaagtagctgggattacaggcacctgccactgcgcctggctaatttttgtaattttagtagagacagggtttcaccatcttggccaggctggtctcgaactcctgacctcgtgatccacccacctcagactcccaaagtgctgggattacaggcatgagccaccgcacccagccgtgttttctttaaagagggaatttttatttggaaaatacacaccatcacaaccacgtcagtatctcagtaaaccaaatgctatgcactaaacacatacacagtgttaccgtcccgtgagatttgatagcaggacaccaagataatgaatctacattctgagactggtgttcccagagttccttctttcagaaggaactatgaaaaggagagactttacatatgggcatgagcattcactacaggtccttcgccaaagactgg

SEQ ID NO: 13890 - DNA, 15474 bp, Human
ggtatgggacaacggcagtggaagggagaggaagccaatggggaagtcagggggccgtggtgacagtaggaacaagtggtgcctatgtccctccccattcagtttaccagctgagggtaaagacagacatctgggcttcacaggatttcagaaggcatgtctagggcaacactaaacacatggcttgacagaaatttgaaccaaagcatcgaacccagtgaacgaggcagaagggcagagagaaggcaggtagaagccacagaccagaggctgggacccagggcacagcagaaggtttagaatcagagggaaggcggtggtgcctcagtagagtccttgggccatggaactcaccccaggagcttttccaggctgcctgcagcctgcaatgtgggtgtagagtgtggctaagggagctgcctgctgggaccagctctactgctcaggacactcaaatccatctgtatgccactgtcatcaccccacacatactctctccaatcccggcaaaatcagtgctaatgtctcaccaacagattaaggcctggattgaagtacaagaaacaggatttttaactcaagttaattcaattccccagcgacccttgttaacttattcaccctcagagacgtattaatagttctgtcttatattgtatagaaatttgtgcagtgagttttctggtagctttacattttttttctcacttcagttagacatgtaatctatttaaaagtaatatgggaataagataaatcagtgtaggaataacttcctggcagaaatatttttactagtttctgagtgtaatatcagcccagcaaaagttatctgcaaatatagaagttctcatgtacatcaaagacactcaagttttttttaagaaataaatcattttatgctactgaaataactctgtgatgtgctattggcatttaaggagctaaacagactctatgggccagccaacttctactgcaagcattagacatgcacaggctttagactcaggcacaccttagaagttctggctttgctacttattagctatggtaactcgggcaggtcatttatcctctctaagcctcaacttcctcatctgtgaaatgggaataatatcagtcacatgccagggataaatccagggagaatggccagggggctgtgtcaaaggccagacacaacttccaccccaggtgaatgtcgggaccaggacagtgagcaggcaaaccttgcccttgccctccttccctccacaatcttaaagctccttgaacaacccccatccccaccccctgagaatgtctgtgccctcctgctgaaagggtttggcctttcagtgttcccctccaccatgagctgtttccatgaaaagatctcaagggtgacttgaggctacggtcatcactaccacaagccttttcccatccctgcctctacctattgccctctaaataaggaagccagcgctgccaggcaaagaacttctgcccaatatgggtcctgggtggcctctcgcctctctctttccctgggcccccagccagctcccccctcccccagagatgctccctgctcacttcattcctgcctcatagttggaatgacagtggctcccagaacccctggggagtgtggagggtgatgggggtctggggaggcagccaggcccaagagcaggttaatgttacagccctggataagtgagctgggcgggttgacgtcagggcgatgatgggtggaggggagggccgggctgctgaagcaactataaagataggtcaaatcaaatatcatcaactagggacggagcaagcgggcgagctagagagcgtccccgagccatggtctctaccggccgcggctcagcctgggtccctctgctctcaacccgagtgcccgatggaggctttggtttcatgtcagcagccttcatctgccttccaaaaataagcccctgccgccatgccggagggagaaaaacaagaagggcggtatttttagggccattaattctgaccacgtgcctgagaggcaaggtggatggccctgggacagaaactgttcatcactatgtcccggggagcaggacgtctgcagggcacgctgtgggctctcgtcttcctaggcatcctagtgggcatggtggtgccctcgcctgcaggcacccgtgccaacaacacgctgctggactcgaggggctggggcaccctgctgtccaggtctcgcgcggggctagctggagagattgccggggtgaactgggaaagtggctatttggtggggatcaagcggcagcggaggctctactgcaacgtgggcatcggctttcacctccaggtgctccccgacggccggatcagcgggacccacgaggagaacccctacagtgagtgccagctgcagccagtcgggacgcttgggggtttgggctcatgcagggctaaaaggtgaaggggccctgctctagcggacaggatgcacgataaagggggcagaaatgctgctcaccacttagatgattccacgtgaccctgcctgggtgcaagctcaatatactgcggtccaagcatcctggtgttctttgccatcgccttggttagatcctcagtggcactaactatttcagcattactggcccatctgatgccttgtaagaccattaggaaccattagtctgggaagcccccaaggcctgggtagggagaatcagttagtatacttggatcaaatttgacacaagctcatttttattcagcttctttcttggagaaggaagggaaattcaattgcaaaatgtccaactgaagcacatccttctttttatttcagcggctccctctgtccccaggttcttatcctgcaagctgcctgcaagctgccagcttgctgtatggttagtctcctatccaagaaaggatgggggctgcaggatccaagaaagccatcagctatggtgtggctgctgtgttttcaagattaagtgggttgagatttgttgaaacatgtagagtacacattaagaagaagaagaagaatcagaatttatttttttactcaagtcaaggacctcaagtaattatgtcactgaaagcccagattcaaagctcatcttaaacagatagctaagtggtcactgcagcccctaactctgctatcagaaccttcccttgcagaactggatttctaacagcacaatggcagcactcgatgagtccagcagccagggtctcctagagttagagggatcatggatagggcgatggagagtctggctttctaggagaagggggatggactgagatgcccttgtcggctcaagttcccactctgatttgcacaagccttaggtaatgtggcccccctttccttgtcaggcctgctggaaatttccactgtggagcgaggcgtggtgagtctctttggagtgagaagtgccctcttcgttgccatgaacagtaaaggaagattgtacgcaacggtgagttcaccaggccggggaagtgccaggtttacaaggcttgatgcttacacagttgaagaaaataatatgaagtcctgagtagagaagtgactatctaaatgggaaaggaaaggctgtgagaggagcctgtgaaagggaggggccttgcagcttgtgcttcttcagcctcacgggtgattgtcctctgccctggcccgtgcttcttctgttcccacctgccggccggagcccgtgtgcttaaacggaaaccacagctcagggagcccgtgggccagagggaaacccacattctggcatccaggcttgtgagcaggtgtgattccctgcactggcgaggccccgagagcaagtctgtctctctgcctgggtgcgctgctccatgacacgcgccctgcaagacgccccagcctcgtgcgcagcaggaggagtggaatgggaggctattttcatcctcatcagtgtgctgagattctgcactagggttttcaatcctctggtctccgatcacgtacgctagagaagcagcctacccgttatacactttaggctggtaccagtcccacccattcccatccccacccccataggtcacctctgggagtgccaatgctggcacttgggttaatgcaaccagcttctaagcacattgacgaaaacctctgctctcactgacctactctttcctgcagccctcggcccatcatttggcttattccaaaatatggcggggcaaacatcccgatgaggctgaagaaatggagagttcctttgacagaaataagcaagctaaaaaggaagacctcagagcaggcctcaaaaaatatcaaagttatttatggggagggtgtggagagctgatctactgccccttggaggataaactgaggactgggatgtgaagaaatagatccaggactggcactgggtcccaggggagctgtcccaacagaggaggtctatgaaatacaagaacgggttcaccaggtggcctccaccccataatctttagtgctaacatctctcagtctgggttggtttatgtggacatacggcatgcactacaatcagtgggtctcccacacgggtctgtggacagtttgcatctctgtcaccttggaaacttattaaaagtatggatttccaggtacctacctaggagattcttattcagcagagctggcgtgtgggcctggaaatccatttgtttttgtattttaaatttgccaggtgtttctgaggaacaggcaggcttgggggtcagcaggctacatggcctctggagggcaggggaccacccactccccatgttacactgaacctgaaagctggagggcgagtgagatgagacagaagagacatatccttgttaccgctctctgggaaagtgatggcgaggacaggaagaggcctgggaccaacccaggttttgatggagcaggtttcccctctgtagggtggggcatcccaaagaaccccttctttccagcctgcataatgcccggaagcccatagggtcgggagagccgggaatttaggctgttggctgtgggactccatgcaagcaagggacgttttagcaagtaaatctcctgggagaaagcacaaatttcataaactcttctttctccttgtcgcctttatcaacaaaccatttattacttttttcttcctacccagaaaggaatttaattgtggggaggagaaaatgcacaaatatagaggaaatttacccacttcccactttcaatctcttggccctggaaggagaagctgggaaaggctcgggaagggaatatacgatttaaccatcagagaaagcgccacaaagcggggaagagcattcagaatagcaaaaaggaaaggaggctgactcctaatgcctgaaacccaccaccccacccccagccctcactctgcagcaccgttactggctgatgacttcaaagggggttaggcaggttgatgaactgctgggcttactaaacaagcagagtccaggagaaaggaagacttctgggaaaagacccggcgcccttcacctccaccctcccacccctcctaccttcaccctcagtagcatttggccaaagagcatcttctccagggagggagattctcctccctggacctcagggccagccgggcctgcacacagagagtggggctggacagctgtgccccaagcctggggcacctgacgttttgtgtggctcaggaccagatgctcctgagcaacttctacccctccctctccgcccctcagaggccgttatcacagtctaaaaaaacaattgccaactgatccccggagccaggaagactcctgctgggtgatgatttcattcacactatttccttttaagcccccggagctgcctcatctcccaggctcagctgctactgccagttcatgggatttctcatgggtgggggagggaaactgggctggggctgaggtgttggtgagggggacaaggcaacgactcgtgggcagagaacaagggccaaggaaacctggctagaagtggcttcacacatgtctgtctcctggaaagaggggtgtggaggctcagggcagtttgccaggcccccctttagacaatataaacagctgccctgccctgagcactagcctactgcttgtgctcggattcacaggctgcagagggcttcacgagcatgatctcacagcacccctaggaggtgcatttgatcttcatcctccctgtgcagctgcggacacccggtctccagggtcacacgtccagccacagctgtgtgcagccccgtctcagggctccgcgacccgagttccagttcctggccaacctaccctccagctactcgtcttactttgggcaacgtcactgaacttctctgggcctggatctctgctctctgaggatgaggcagaaatcagtgaattctagcccccttggtcccctttgaaattcagaaaacaaaatatcaaggatctccacctgacagtggttctattagaatcctttggttgagaaaaatatatactagtaaaaagataccagcaattcggtcgtgctttcaagtgatttcagttttactaagaagagccgcatttacatgcttttcgtcaacagtatgacaatgtgcaaaggacaaaattgatttcctccagagacctttgattattatctggggcattacattggggcattattatctggggcattgcattattatctggggcattacattattatctggggcattacaaggctgggaggaccagccttgccttggctcagctgccactgtagcagaaaacagcactcctgagggaatgggatgaaggacacccaccatgaggaagtgctgggagatggggctggagagcagcgggaggtgcatgcccttatgcagggcctgaggctctgcatacaaatccccgcctgctacaaagagctgcactggagtgagaagaatgaaacacctgatgaaaacactttccaacattcctaaatcaacagttcaattgtgtgctaggaaaaagggttggaaaatgcaggcatcttcagagctgatgatatttcagctaaagacaggaaaagaagcagtcaggggctacagaagaaagtcttaggacaaagaattggtttatttttccttcttgcccacatccttccaccccatccttctccatccaacacacactgccaggaggaacagggacaaatggccccagcggtcacagggtgaagatgtttaaaagcaggattagatcctcgttggtccaagtgacttagctctaaaggcgagagggtggctgtcttgtccacctcacactttggaggcacctctaccccatggatatgcttgctcctctgagaaatgcccttctccatagtgagtgccaaatgcacataagtctgaatagacctacatcaaattgaagatattttcatgctggggcttgagcctggcaggcccaggaaatgtgacccagtggaatgattttcatttattcaagtaatcatatacagtagctgcttttatgaacatggtgttcacttggctcgagtgcgttcttcaccagagctgaggggccaacattcccaagccatgagaactcaaagctcagggctctgatgaagatgaattaaggggctgggtcttgagcatcactctgggcatcgggaaaatcccatcagcctgaagcattcagaaaaaatgcactatctctccttcatgccacaggcctcctggccttccaaaccccacagatgtgggtgctgagggcggaggagagagagcagcaaggggaaggttagggcttctaacacaagcttcctctactagttgtcttttttcactttagttttgtacaggattctggggaaggccagggatatgagacaggctagagaaaagggcagaatggaaagaaaaaaaagtagtaaacttgaaaaaaaaatagaaacagaaaaaaaaaaagtgtgtatgttgagggggagtggatttgaatgatccaaaatcgaatgaccagagaagcaaagtacaatctacgcatccatggtcatgcatgcttaaacaatcatgttttaggagatccagatgtttaggagaggctgggttctcaaatgggcacattctaggcacggggaagtgggcaatggcttgagagtttcttgtccaagtcactcagttcctcccacttccccttcctccacctcaagatttcatttcctcactagagcttgcaaacaacacacgaaacctctcccttaaccaccatccagatcagaaataaattctctggaactgactgggcgggttactctccagggacatacaaagttagaacaggggggaggctggtgggtggagaggggccgtgacccaacaagaaggagaccaccagtttctgatcaaaatgttttctcgcttcgtttcctggcccatttgctaccctaaattcccttcccactttaaataatttacgtacttgactaggtaacacaggaacatgttttaaggagaaaaaagtatcaaagaatattctatggaaagtctcactcccaccattgtcttgaagccactgagttcctccctagaggcagccccagttaccagtgtttcattccagtatatcgttccagaaatagctaacgcacacgtgcacgcaccggtatcatcttttttaaaaaatcacacaaacaagagcgtactatgccaacactttttcaaaccttgtgtcttcacttagcaatgtatctttgaggccatttcatgtcattacagagaggcttcttatcttttcaaggcttatagaattccatcatgtggatctaccataattgagttagttactcctctttttttttttttttttttttttttttgagatagagtctcgctctgtcaccaggctggagtgcggtcttggcccactgcaatctccacctccccggtccaagagattcccctgccttagcctcccaagtagctgggactacaggcatgcaccaccatgcccagctaattttttgtattttggtagagatgcggtttcaccatgttgaccaggatggtctcaatctcctgacctcgtgatccacccaccttggcctcccaaagtgctgggattacaggcgtgagccacctcagctactcctctcttaatagatacattgtttttggtcttttgttatttaatgctgtagtaacttttgtgcgtgtgtgggaatatatcagtaagataaatttctaggagtggaattgctgatcagttgctatattcatcctttattctggtagatgctgccaaattgctctttatagagattataacagtatacacatcagaggacattaaatgagaattcctagtttctgtgccctcactaatgagagcatagtgtcaaacgcttttctctttgaaatctggccactaaaaatgggatctcacagttataacttacatttctcttattaggcatattctcttctgctcaaatgccattgatagttcttttcctgggaattttctgttttataaatgctgttcattctccagtgagtttagggttctgaatatagtaacaaaatgtattctttgacatatgtgtattgtatgtattttcatccagtttaccatttctgttcttcttttaaggtaatatttttcaagtagaagacaatttattactttttaaaaatggttttaattttttttgtcctgattagaaagatgttcctgattctgagtttattaaaaaaaactttttctggattttaatggttcttttttttttacatttgaatctttactccctttggaatttattttgatgtaagggataaagtcatacacatcaaactttattatcattataataaaataccattcagttgttccaacaccatgttttctctagtgatttaaaataacacttttactttatattcatttcagattaatttcattttacatccatgtatgtgttgggatctactgctggactctatgttgttcattgacctgtactggacttctcattagtgtagctttacttggaatgtttcaatcagttctgagctgaatttttcctggtgctgctgctcccaagcttgcccaccaacgactgaagtcctgtgcacagggcaggaaaccagggtccagagaggctcctaatgaggggtcttggttcagagccagcgtcagcctctgcccttcctctggcttcctgctcttccatgcaagcttactgtctcccaggcactccatcaaaaaccgcagagcttaaaagctaaattgtccagtaacccccagcaagtcttatgggactggtgatccagggtaaggcagtctttcgaggcttttaatgtaaagtagttcattatttacttggagaagaatactagtactactaatttgtttttaattctactgtatagcaagcattgttcccaggactttccatgcataatttcaattaatgcttactccagttctatgacacaatttttcttactgttcttacttcacagatgagggaattgaagctttagaggttaaatgatttccccaggctcacgtagctaagaggctattgtcatcagtctaaccttaaagctgtggcacaaatatgttcttgacctacattgattagttcatcctttttacctttaagacatcccttcattcatccattccacaaatattcactgagcatcctaacgaggaaaacaggaaagcttatgaaaaacccaccccccggtgtggcattaacctgttgacatggctagtgaacgccttcacatttatctcaagcaagttaacatcagtgaaagtgctttgtaaataagctgcaagcatgagagaagaagatggggaaaacatatgagggcagtttcaccgtgttcccataggcaaggctgtcccctcacccacgctcacatcacattgaaagagccacccatgcaggggtctccttatgtttctgtgctgtccttatttacttatttatttattcttgagacagggcctcactctgtcacccaggctggagtgcggcggagcaatcatggctcactgcagcctcgacctcaagcggttctcccacctcagcctccagagtagctgggactacaggcatgcgccatcatacctgccttttttttttttttaagcttttgtagagacaaggtcttgctatgttgcctaggttcctctcaaactcctgggctcaagtgatcctcctgccttggcctcccaaagtactggattacaggtgtgagccactgaaaccagccatgttgtcgctattaaaccaccatccactcagcatcatgtaccaagcaagacacagtcctcatctcagggatcttggagtctattgggaaagaaagtatggctgttctaaatgttgccagagaggtccactgaaagggctctgggagtcttggggccctgaggagcaagctactaaccagcccttcagaacagcaagaggttctcgtccagctacactgccagcaagatgggacactagcagtacgattcctttacagaaggtcagaggacacctctggcacagcccagtagccatcgagcgggtttttttttatactcaagcaagaaggagtcagaagttatcctccatccatttctcattctatatttcttttcaagagtagatcccgggtctctggctcccacctcgctctctgttcttctagccccgacccagctgcttccccacaagagcaggaaatccccgcatactcccttagggcagccacccaggcaggttgcagaggaaagaggaggacttggggtgatgtactgggaatgaatctgtgcatgcgagacaggaagtccagcgttcatgtgacaggaagtccagtgttcatgtgacaggaagtccagcgttcatgttctgaacaggtggtccacacacactctacaaaattagcatggaaagggccatttttttgttggtcccaggctccttggcctcacctgtcacattgggaaccaggtccttttccccataaaaattcctgctcctcaccatttctgttcctgcatgtccctggagaactatgattgtcttggacagcagtccccagcctttttggcaccagggaccagtttcatggaagactatttccatggacagggtgagtgatggggacatggggggacggtttggggatgaaactgttccacctcagatcatcaggcattagttagattctcagaaggagcaggcaacccagatccctcacatgcaaagttcacaacagggttcttgctcctatgagaatctaatgccactgctgatctgacaggaggtggagctcaggtggtcttgcaggcaatagggagtggctggaaaacaaatgaagcttcgctcacccaccgctcacctcctgctgtacagcccaggtcccgcacgggtatgggccgctgactggtatgggtctgcagcctgggggtcggggacccctggtctaggaggtaccagacctcttctagactcaaagtcaaaactgagaatgggcctttttgagggatagaaaacttgagacttaaaccaggaaagacagactgaggaaccacaagcagaaacaaagagacaggcagtgctggaaagggcttaagagatcacttgtgtctcctccccctccaccaaccgcctctctccttcttcccccaccacacacagtctgcagaaaagagaactgaggctgcaaggggaggaacctgcccaaggtcacacaattaggaagtagaaaagtcacgaaatagcaccctgagctctcatccctgctccagtagactccctctcagagtggacttgagaaaacagcttgtgtcatttcctggtctgttctttgaatggaataagttaccatctagggacttagtagaaactactctggaagtcaggacacctgagtggtagagcctcagctctaccccatgtggcacagaccatcccctgtgtccctgggccttggtttccttatcgtaaaggagggaaggtgagaggaaaccatgagagcctgcagcctcttcccatcctaacctttcaccattctgttcacccaggatgctcagacctcacggtggttgtctcacaaagagaagggaagggcacctggcagaggggcctactctctgcggcccagctggcatctgcagcactcctcatttgtaacccagtctctgctgtttgcccatgtcttccacagcccagcttccaagaagaatgcaagttcagagaaaccctcctgcccaacaattacaatgcctacgagtcagacttgtaccaagggacctacattgccctgagcaaatacggacgggtaaagcggggcagcaaggtgtccccgatcatgactgtcactcatttccttcccaggatctaaggacccacaaaagaaggctcacagatttaaagcatcatctgttcgattgaaattttgcaccagcgaagaattccccttgccctccatggcttctgaatcaggcttatcctgtgcttggggagacctcagttgttttccttggccactggaccccacggcatgtagcccattcaaacgagggctaaaatcagcaattttagaatggcaatttatcccatgctctgacctccctcgaggagagaaggtatcggtgacacttgtggaatgtgaccatgtgcataggaaaaggccagggtaggagtttgtgtgcattgttgtatatccatacagctttatacacattctcagagcaatggcatttcaaagcatcaggtttctttctcctagcatcatcgctgcaggaatctgcctgtaagaatgtcacttgtcaaaccagcaagattgatgtgtgctcccattctgcctctttccaatcatctttccattcagaggccactaactacatgggttgcataggtcagcagggagcagctgtcctcaaagtgcagagacggcagagtgagagggtgtgaggctgaactgcaaaccagaaagagagtgatcaggcacttcaagcttcctgccagagagggctctggggacactgggatgaactgtcagggaggctgggggagaagcggttcccttcttggaggaaaggggtagagcagcatctagggcagctgaggaaggcttgtggaggcagcagaagggactggatgttctaggagagccactctgcctggagaactcaggctgtgcatggctccaggaacaagcaggggccaggctgcctgcccataacgtttcctcactttgaactggtcttattttaacctcagatgacaaggatcctaataatggcaacctctttggcgaggagtagggggacaaaatagggcatgaaggaagtagagaggctttggactacagatggtaattcctctccaactatgtccaagaaacgcacccaagttctcatctgataccctcacttccttcttgctcatcctcatctcacatacgcgctgtgcctggatgcagcagaatgggcaccgtgacctccagagtttgtgctctcttcctccctgcagtagaagaggagtgataatcccacagagtcaagcagccaagctgaagcagctccttgctgcacagtgccttctgcctcctgtcctttgagaatatttaaagcagaggttccccaagtgactataaatgttgtctgcccggagccttcagattcctgaaccattggaatgttcctaaatctgaaaccagagagagccatatcagagtgcaaatatttttggcatatgtgaaccatggagttacaaaatgacctgatgacctctgcgactcttgggggccccggcctgcaagacaatccttcatctgttgcaaataccttcatcttcaacatacctcgctatttgcagttgcatccatctatagatagatctgggttgagggattctgagctgaagatgggaggttggcaatcgaagggggagacaccttacctgccacctcctctgccctgcaaatgtcagggaggacatgtgctgggtgaggaagaaaaggccacacccaggtacatgaagatggaagagactgtagaagcctcggaacacgtgtgcacatggccaacccttggatgttgtagaaaagggagaaaactggtccatcttgattccgtggaatgttgaagtgtgggtctgcttggaggcggggataaagctctccactgttttttagggagtcttgtccagtgcaatcagtctcttgaacagggtccatcagaaatgcaggcactccaaacctgaggtgcatatcagttcctagtggagcttggaatgtgggatggctggcggacggcgtgactgtgatccagagaaaaaaggagaaggaagttttaggtcccatagcatgctttccttttttccaagatctttcagctcacgtggcaggaaaggagccatcttcaagagagtctccaaagccttgggctgccagccttgtccttcatctctct

SEQ ID NO: 13891 - DNA, 36302 bp, Human; identical to SEQ ID NO: 11998
  misc_feature (1)...(36302): n = A,T,C or G

SEQ ID NO: 13892 - DNA, 16562 bp, Human
aaaaaaggtggccacagtcgtcttaaagctattaaatcaggccaggcatagtggctcacacctgtaatcccagcactttgggaggctgaggcaggcggataacctacggtcaggagtccgggcggggaggcgggtacctataatcccagctactctggaggctgagacgagaatcgcttgaacccgggaggccgaggttgcagtaagccgagatcgcgccactgcactccagcctgggcgacagagcgagactccgcctcaaaaaataaataaatgttgactggtttagctaattcaggtacagcaaatatttgttgagttcttttgtagggctgtgggaagatatgggaggcttttcattaacacaacactgattttacattctacttttcaaaaatacagttgtacaaagcatggtttaaggtggggtcccagacacctagaataaataagcttagaatatccaagaagtgccaggggcggtagttcacgcctgtaatcccagcactttgggaggccgaggcaggcggatcacctgaagtcaggaggagaccagcctggccaacatggagaaagcccgtctctactaaaaatacaaaaaatagactggcgtggtggcgcatgcctgtaatcccagctacccgggaggctgaggcaggagaatcgcttgacccgggaaggggaggttgcagtgagccgagatcgtgcctttgcaccccagcctgggcaataaaagtgagactgtcccaaaaacaaaacaaacaggctgggcatggtggctcacgcctgtaatcccagtagtttgggaggccgaggcaggcggattacctgaggtcaggagttcaagaccagcctggccaacatggtgaaacccgtctctactaaaaataaaaaattagccgggggtggtggcacacacctgtaatcccagctactcgggaggctgaggcgggacaactgcttgagccctggaggcggagattgcagtgagccgagatcgtgccactgcactctagcctggccgacagagcgactcaaaaaaaaaaaaaaaaaaatccaagaagtgcccaaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggagggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaagggtaaggggtcacagccttagaacctgtaacaccgttctccctgtgacaagcaagtgttggacttaaaacaccgtctttcccctcctggtaccccaaagtcggcaaacgtagtccaggaggccccagcccagccagtgtgagtattaggagtggagggggttcacagtagcgtctgaagtctcccatgatcgagagccagcccgggatcctctccctcgggttgagaatgcagtgggaattgctggccttgatagaggcgtgagggtcacatcatatttacctcttattcccaggtgctttggggaaggttgtcaccaaacaccctcacgatttttttctaacagccctcctcggagtttttaagaatacttatctccgggttgggcaagtgaatgtatcccaatcaatttaggcctcctttttattcccttccttcagaaatgcccggcgaagccacagaaaccgtccctgctacagagcaggagttgccgcagccccaggctgagacaggtaggtttccctaccctccttgccattaattaaaattaaccctaaagccatttggtgggcaaaatgaccaaggggaaatacactttttaggaggatggggttgcagctttaccaaggaggatagaccgtaaaattactatcctggagatacttctttagggatttggagtaaaaataatatttttaagattcgtggacgttaaaagtaccctagcttgctttctatgttatgcctgtcgcctcaaaagaagctctcctgtggaacccccacctcacataggaaaactcagcagggaatgggctcagtgattcttacctattggaactagatgacacaggccaaggagcccggagcatttgtgaaactccagccagcaagttgcatcaaggttttagttagcagagcttggcattgtgcctttatcacatgtctggatgagatgtgtgctggtggtaaatgtgtcctactgggccccagagtcgtcctaggtcggataacttgtttatgggttggtggtgctgagatacttctagtgtgctggaatagttcctgcatcattgtgtgaaacccaggattgaaataaatccttttatcctcagcgtcgaaattaacgactgtgaaggctaattttaaattctggttaaaacatatctctgtagaaaacttaggaggaggtaatgaaaagttcttaaaatgatagcctttctgagtcagttgtgcagcgttaaatgaaggaaatcttcaggctgtaattttcattctcacctttttggttttttttaaatttcatttgttatttaagggcaattcctgtccctttttggagttacagtagagttgcttatagttgaaagcataaagtttcttcccacctgtttgattttaacagctgaagggattaatacagctgctaggaaggacaatagggggctctaagctggagtataaacaatatgaaattcttgaagtacaaggggcttaaggaagggaaaaaataaagtactgttctctaaagattctgtaatttcagtacaaaacgagattttagagattgtgtcattgaacaacttaattttacaaatacgaagatttgaaattcagatgaatttagaataatctgattcaagcttcaaaactaatgcatttacttctgaaacagtccttaatgctattaaacgtattcctgaatagtctgagttgcatagtaggcttatattaaggaagtaccaatgataaatacacaaggttttatctgtaatgatagtctattagaatgaagaaggaagctcaaggaattgttgatggtgtcaaagcaagtatttgagtgcttattccatttgaggtccagtcagaagaaaacatattccatgtttttaattctgattcattatgtttggtagtgttttcctgtaatcgttagactttggcctacccactctccaggaaaaactagttgagccaccttgtcttttccatggtaggatgccataagaacttcagaattactggttgagtgaattttgaatttgaattttggtaccacgggcttcccccccgccccccttaacattcccttctaagcattgagcatttgttgatccaattctgtgttacctcctgaatgccagagatactgtcttactgtcatgccaaacattggtgtattttgacataatgaaacacttaaattccaagttaaggagtggggatccagtgtattctcgccactccaattgtcttctttggtttgttttgttttgagacggagtctcaccctgtcacccaggctggagtgcatgcagtagcgcgatcttggctcactgcaacctccacctcctgggttcaagccattctcctgcctctgcctcctgagtagctggtattacaggtgtacaccaccacgcccagctaatttttgtatttttagtagagacggggtttcaccatgttggtcaggtcggtctggaactcctgacctcgtgatccgccctcccaggcatcccgaagtgctgggattacaggcatgagccactgttacaggctctccaattctcttcttccaaaatagcaccacaatctggtttaacaagttaggttacagtttcataatacagtccctacccttgtgagtaagctctctgcctggaggtctaattcatgtctaattcatcttggattgatgtctgaagaattaacatcacctaggaaggtttatagagactattacagtccttttgtggttggttttcttgtttgggttttgtgagtaagtaaactggtaaggtataaagaagctaagtgactttaatacttgatattaaattctgaagtgtttcaactttaggaagaactgaattgtgctgtgcacctccttcccaaaactattctaacagagtcagatgtttcctagcctagtggaagcctgaaagtataaaagcctgtgttttcttattcagttcagattccccatcatcgtcactgctcactaacttctttgttccagttttcagtatcttttctgttcatgatatttgggtggacagagtagcacagctgttcttctcgtgggaattctgttggctgtgagaaagacttgggaatacagtccatttcaagaagtaaggggagggcacaactgggaaaggatagaaagcatgttgttctcaacctaccaagagtctgtgctccccatttagagataggctgctcttagactgttctcctcaccctaaaatagttggtttactttggtagaacttggggaagtgtgagaaattaggaggggaatgtcttctcacttgaccactgaaaaatgtttggggaaggttgttgttgcctgtcacctttatctaatcctgcgtggtgacttagactgtcagattttaaactccagtgtttcctaggaggcatgttgtaccaagttgggctgcataactcaccttttttctcctccccctccccctttctttatctccttttgcctttctccagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagagaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctcttcttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctataggtaagccagccagcagtatgacctcccctctgggtgttaactcctcggcctctgtaatcaagacagattcttatgcaggcccagactctgctggtccgcttctcaaaagttctctcattaccccaacagtggctgcatttcctttggaaagtgctgaccctgccggggtggctcccacaactgccaaaggtacctcaacttatacaactacagccagcccttttctagaaggaactgtctctttagctcctaaaaaccacccagttaaggaaggtactcttactactttacccttggttcctacagcttcagaaaattgccctgtggctccatccccccagaatacctgtgctcctctggctaccttagtgctggcccctgaaatcccaaagtctgtgccctcaccctctcttcccccagctgggactcctccaggtacaaaaaaggttgatggtatttctcatacttcagcattggcacctgttgcttcctctcccaaagagtgcccaactgaggactctggtgcttctgctactgcatcttccaaaggaactctgacttacctagctgattccccatctcctttaggggttagtgtgtctcctcagactaaaagacctccaaccaagaagggttctgctggccctgatactcctattggaaatctctcatcccctgtttctccagttgaagcttcatttcttccagagaatagtctttctttccaaggctctaaagactcaccagccacgacgcattctcccactcctccatcccccaaaggggcccctactccctcagctgtgactcctctgtctcccaaaggagtaacactaccccccaaagagacccccactccttcagtggtgaatttgcccttccccaaagagggtccagctactccagcacccaaacaggctcctgctctatccatgacttcttcctcccccaaaaaggcccgagcaactccagcccctaaaggaatcccagcttccccatcccccaaaggggcccccacacccccagctgcaactcctccctcccctaaaggaggcccagctaccccatccccgaaatgggcccccacacccccagctgcaactcctccctccccaaaaggaggtccagctactccatcccccaaaggggcccccacacccccagctgcaactcctccctcccccaaaggaggtccagctactccatcccccaaaggggcccccacacccccagctgtgactcctccctcccccaaaggaagtccagcagctaccccattccccaaaggggcatccacacccccagctgcaactcctccctcccccaaaggaagtccagcagctaccccactccccaaaggggcccccacaaccccagctgcaactcttccctccccaaaaggaggtccagctaccctatccctcaagggggcccccactcccccagctgcgactcctccctccccaaaaggaggcccagctaccccatcccccaaaggggcccccatgcccccagctgcaactcctccctccccaaaaggaggtctagctaccccatcccccaaaggggcccccacaaccccagctgcaactcctccctccccaaaaggaggcccagctaccccaccccccaaaggggcccccactcccccagctgcaactcctccctccctaaaaggaggtctagctaccccaccccacaaaggggcccccaatcccgcagttgtaactcctccctctccaaaaggaggcccagctacctcaccccccaaaggggcccccactcctccagctgcaactcctccctccccaaaaggaagcccaggtaccccaccccccaaaggggcccccactcccccagctgtaactcctccctcccctaaagggacccctactctcccagctacaactccctcctctaaaggaggcccaactactccatcctccaaagagggccccactcccccagctgcaaccccctcccacaaaggaggtcccgctatgactcctccctcccccaaaagaggaccagctatcccatctcccaaaggggaccccacttccccagcagtgattcctctctcccccaaaaaggctccagcaactccagtcaccagagaaggcgcagccaccccatccaaaggagatctcactcccccagcagtgactcctgtctccctcaaaaaggccccagcaacttcagcccccaaaggaggcccagctaccccatcctccaaaggggatcccaccctcccagcagtgactcctccttcccccaaggagcccccagcccccaaacaagttgccacttcttcctctcccaaaaaggccccagcaactccagcccccatgggggcccccactctgccagctgtgattccttcttcccccaaagaggtcccagctaccccatcctccagaagggaccccattgccccaacagcgactcttctctctaaaaagaccccagcaactctagcccccaaagaggccctcattcccccagctatgactgttccctcccctaaaaagaccccagcaattccaacccccaaagaagccccagctaccccatcctccaaagaggcctccagtcccccagcagtgactccttccacttacaaaggggccccatcccccaaagagctcctcattccaccagctgtgacttctccttcccccaaagaggcacctactcctccagctgtgactcctccatcccccgaaaagggcccagcaactccagcccccaaagggactcccacttccccacctgtgactccttcctccctcaaagactcccctacttccccagcttctgtcacatgtaaaatgggggccactgttcctcaagcatctaaagggcttccagcaaagaaaggccccacagctctgaaagaagtacttgttgccccagctccagaaagcacgccaatcatcacagctcccactcggaaaggtccacagaccaaaaagagttctgctacttcacctcctatatgcccagatccctcagctaagaatggttctaaaggacccctttccacagtggctccagcccctctactccctgttcagaaagactcttcaaagacagcaaaaggcaaagatgcttctcattccccaaagggccccttggctcctcctgagtctaaggcgtccacccctctaacagcagctgcctttgagaaggtccttcctaaacctgaatcagcatctgtctctgcagcacccaccccaccagtctctctgcctcttgctccctccccagttcccactctgcctcctaaacagcaatttctgccgtcctctcctgggctggtgttggaatcaccctctaaaccccttgcccctgctgatgaggatgagctgccgcctctgattcccccggaaccaatctctgggggagtgcctttccagtcggtcctcgtcaacatgcccacccctaaatctgctggaatccctgtcccaaccccctctgccaagcaacctgttacgaagaacaacaagggtatttgccttggtttgccgtgtgcatggtgtgtctgtcgtccacacccctcttgggcgctacccaccaatactaaccctgtgatgcgccgctttctccagtgaatctgcttgggtttggatgtagaacatagaatgataattttaaatgcaaaagttctaggaatatgaaaccaaatcttggttttcattacttcagatagatacatagtacattgtgtatcatttttgtgtaatgtggccgggactaccctgagcctgccatgccatctattttacctaattgatctgacattgaaaaccaagacctgccagaccttttcatttgctctaatccctaccacatcactaactaaccttgtccctgggcctgagatttggtaaaattattggagaattgaactatttgtatttatttttccattattagacttagtaatgaccagttgcccagggactcccttttcataaaaatgtagaaatctgtttttcctagcctgaaaatggtgcaggtgtatgctttttttcctcagtagtctttactgatgcttggcctttgaattgaaagaaatttatgtgaattatgtttggaaaaactagagatataggtcatcatcattgagaatcttctaattatattgattagatcacattgctggggtgaatggtttgaaaatgaggctgaatatgtgtacgtgtctgcttttgacttcctccaacccagtttaaaagttgaggggaaaaccacccaacctgttgtgcctccacggtgtgattttggttttttcacttaagtgtatctgggggcaccttctgacagaactttacagggataattggactattgggtaaaattttagagtcatatgggtcattatttgcctgtgccaagaaacaaagaccttgagggaaagaaagcagttacagtatattaaactgctcagctatttctagtgattactcctcatttctggggttagggctgggtctttactagatgtgtacccgctagttagtgactaagttaggggctatcaagctgacttcacacaagccagttggtttacatttaacattcttaggtctagcatgaggcattcacctctagtccagggcaggctgtggtgaagtaccttctcttataatttctactataaagcagtaaaagttgtttctcatcttagggtctggaacagaatctgacagtgatgaatcagtaccagagcttgaagaacaggattccacccaggcaaccacacaacaagcccaggtgggtattctcttactaactggtattgggtcaaagaagcagggttgatcagggcaacttttgtatttggaactgtgaaccttcataaaggaaaacccacaaggagattgtgctatccagatcttagattctggttaactaatagctgttttatcttcttagctggcggcagcagctgaaatcgatgaagaaccagtcagtaaagcaaaacagagtcggagtgaaaagaaggcacggaaggtaagatttgaaaaggatttcaggatcttatgaagcacctttatacagagtggaactgtttatttccataggtttttggggaacaggtggtattttggttatacaagtaagttctctagtggtgatttttgagattttggtgcacctgtcacccaagcagtatacactgaacccaattcttagtagtggtagaatcccgttgaaagtaacagaagtagctaggttggtggctcacacctgttatcccagcacactggaaggccaaggcagatggatcacttgaggtcaggagttcaagaccagcctggccaacatggcgaaaccccatctctactaaaaataccaaaaatatatagcagggcatggtggtaacgctcctgtaatcccagctactaaggtggctgaggcacggcaattgcttgaacctgggagacggacattacattgagccgagattgcaccactgcactccagcctgggcgacagagcaagacctgcctccaaaaaataaaaaataaagtaacagaagttactacggcagaaaacccattctctattcttgtatgaacttttctcagcctggggaaaggctttgctttggatgttgtattatgttccttgcttctttaggctgcttctaaagaggttgaaaacctgatactattttctcttctttaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaaggtgagtaaacttttcttgggcattgttccagaccagggtttctcaacctcagcactgctgacattttgcgtcagatagttctctgttatggaagggctatccattacatccagttttgattacccaaaaactccattgccatatatctcctgggagacctaactaccccctagttgagaaccactgctctaaacctaaacaactactctttctactgtgagggcaagcagtttaaagctgtacaataagttacctgaatgggtttacagagagttgtgaaactatatgatttatttttcaaagactgctaatctactcacatggatctgtattttctaccctgtagatcgaagatttatcccagcaagcacaactagcagctgctgagaaattcaaagttcaaggtgaagctgtctcaaacattcaagaaaacacacagactccaactgtacaagaggagagtgaagaggaagaggtatactaggaaatctttcataatttaactctcgctgtatagcattgtgttcgtgttggtgagctatattaaaaactagattcaggagactccaaagaactgctgaaattgttcttgcctttaatttactgctttttccctctcatctctcaggtcgatgaaacaggtgtagaagttaaggacatagaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacaggaattaacaatgtaaccatatggaagcaactttttttggtgtctcaaaggagtaactgcagcttggtttgaaatttgtactgtttctatcataaataaagttatggcttcttgttggatgaattcagtcggtgactggtctcttccccgccacccccccacaccaaaaaaaaaaaaaacttaaaaaggttctagtaatttattaattactcctaaggcctccctcatttgataaggtttagtgccacagatttcccacttagaatctcagactttatacctcttttaagaagttactggccaggcgtggtggctcacgcctgtaatcctggcactttgggaggccaaggagggggcagatcacgaggtcaggagattgagaccatcctggctaacacggtgaaaccccgtctccactaaaaatacaaaaaattagccgggcgtggtggcgggcacctgtagtcccagctgcttgggaggctgaggcaggagaatggtgtgaacctgggaggcagagcttgcagtgagcccagatcacgccactgcactccagcctgggcgacagacagagcaagactccatctcaaaaaaaaaaaaaaaaaaaaaaaagttactatactaggctgttaggaccttcttaacttaaggaaatacaacttgactataaagtttctcatttctgaccaggcgcgacggctcacacctgtaatcccaacactttgggaggccaaggcaggtggatctctttagcccaggaatttgacaccagcctgggaaacatggcaaaaccccgcctctacaaaaaataggatcactgagtaatccctgagatcacaccactgcactccagcctgggcgacagagtgagacactgtctcaaaaaaatagtttctcatttccactttctttcccagatgttaactgttagcagatcccgattcttctgtatctagtaatcagccccttcactgaactccaatctttctgaatgcacactggggcttttgtggcctctgaggagtttacattggttacatatcgacatgtaagagcttggtacagggttgaagagaaagttggaggtacatgaaaaagctacctcctgaaggggaagattttgagtatattgtaaactttctgctcttaagcatattctctacagacattttaatctacaaagtagcttctgattaggacagccataattacatattaggacaataaatgaaaactaggactctcccaggctaactaaaacataacagttagtttacagatagctacataggaattccaagaaaaactcagtttgggttgtcagagaatggtttggaggaaatcaaagggctacaatttagaaatgggaaagttacaagtaaatgtagaggcaagaatcctgaaatgaacatgtgaaaatacacctagaaggaatatgttagaatgggaataaatgtggctaacatctaaaactgggctttagaactaaaggagttaagacatttttatagaattcagtcttttggtctccataaaaaatgaggccggccgggtacagtggctcacacctgtaatcccaccaacttgggaggctgaggcaggcagggcaggcgggtcacaaggtcaggagatccaaaccattctggctaacacagtgaaaccccatctctactaaaaataacaaaaaaaagggcagcgcggtggctcatgcctgtaatcccagcagtttgggaggccgaggcgggtggatcacgaggtcaggggtttgagaccagcctgaccaacatggtgaaaccccgtctctactaaaaacagaaaaattagctgggcgtggtggcgggcgcctataatcccagctactcaggaggctaaggcaggagaattgcttgaacccgggaggcagaggttgcagtgagtcaagatcgcgccactacactccagcctgggcgacagcgagactccgtctcaaaaaaaaaaaaaaaaaatacaaaaaaaattagctgggcatggtggcatgcgtctgtagtcccagctactcgggaggctgaggcaggagaatcgcttgaacccaggaggtagaggttgcagtgagccgagatggcaccattgcactccagcctag

SEQ ID NO: 13893 - DNA, 27059 bp, Human
  misc_feature (1)...(27059): n = A,T,C or G
tgtttttgttttgagatggcgtctcactctgtcgcccaagctggagtgcagtgatgcaatctcagctcactgcaacctccacctcccgggttcaagcgattctcctgcctcagtctcctaagtagctgggattacaggtgcccaccatcatgcccagctaatttttgtatttttagtagagacggtgtttcactatgttgactaggctggtctcgaactcctgacctcaagtgatctgcccgcctcggcctcccaaagtgctgggattacaggcatgagccaccgcgcccagccgaatgttttgttttttaagatggaagatatcccagcactttggcaggctgaagcaggtggatcattccagcttgggcaacaagagcgaaactctgtctcaaaaaaaaaaaaaagaaaagaaaaaaaaagagagaaagaaaccctaggtaaaagtctgagccccacctcccaatcacctgatcacctcaaccactgtcaccaggtggatgaccttggagaggtcacacacttctagttctgtaaaatggggagttatattgcctaaatcatataatttttatgttaagtgacacattctctaaggcactaagtttgaggacatactttgtaaatgaaatgatatatggaaatgtttgtatatgttaatggttttgttgttgctattattattatgactactatacacatggtctggagaaagccaacctccccaaagcggagattctccagtagagaacaggccctctaggttgcatatcaatagggagcatgtttaaggaatgttagccggtagtctttgctaggtgtgaggggtgaaatttttctttatcaaggctcaactgttttcgaagtcttcaggcttgaagttctggagaaaacaactaggctctccgggcgagatcccgaataccagtttaagggatttgaaatgcaaggccgtctgggactccactgccacggatgggcaccaggcggcgccggtcggatccgtcccgggactagcagggctttgggcagcaacccgcagggagcccgaccgcctctggccaggtccgggcagctggtgggggaggttccagaggtccacgccattcgtggacgcagtctctagtgtcctctccgcgtcccacttcactgccccatcccctttcctgcgagagcctggacttggaaggcacctgggagggtgtaagcgccttggtgtgtgcccatctgggtccccagaagagcggcgggaactgcggccgcccggacggtgcggccagactccagtgtggaaggggaggcagctgttctcccaggcggccgtggggggcagcagaggggacggcgacaggtgcgggagcccctcccggggtagaagtggaaaggcgggctccggggtctgttcccaggctggaaaccacccccgccccccatccaaatccccgggagaggcccggccggcgccgggtctggaggaggaagcggccagagacagtgcaatttcacgcggtctctgtggctcgggttcctgggctgggtggatgaattatggggtttcgagtctgggagaaactgaggtggcctggacgtgaggcaaaaaacaccctccccctcaaaaacacacagagagaaatattcacattctgagagaaaatccaccaagtgaaccaaccggctaggggagttgagtgatttggttaatgggcgaggccaactttcagggggcagggctttggagagctttccactccctcattcattacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcaggtaagtggcgcgagagcaccggcgggctcggcacctgggagccggaacccagtgcgcgcagcctcggagggtatgggcacggtctcaggcggcgcggggttgtgggtgctgcccccggtttgccaggaccacctgggagaggggcggtcaggctcgggttatcggcgtggtccggccgagggcggcattccgggaccctcacgccacccttccccagagcgtcgccgaccctctaattggtctccccagaagaggctgaggccgaaacagtagttcacacttctgaggggccctgcagggaggggagcagggagcttcattctgtaaacaggaggtgcttggaggtgggggccttggcgggaagggtctcggtttgctcgccaaccccctgccccccacccgcgccgatttcagctacccctagtttcgttgttttgccgacagggcggagctacagaaggttggagggggttgttgttctctggtgttggaaaaacaggagcggcacctcctcttccgtgagtgagcctgccctggggaggtctgagattaaccagagggccaagttcaggtgacatcaggcaggaggcccaacagaggctggcgccccctttcctcagtatagcagagcttaagcaacatctctttgtcaagacccaggtcaacacaactcatatttattgagcatctactatacacaaggccctgggccaggagctgtaagggcaaggatgtccagcctctggtcttttctctccccaacctgaggatcaagagggcacctctgctactttctaagcctcctgccttggggagtccttcctgggctcagcttgtgcctcccgcccccattttgcttattgtctgacactgtctctaggaccctagacagagccccggattgctcttctccagtcctcccccgactcccatgctatctgagcccacccctttggggtgtctctgggaccgtggacacctgaggactgaagttctgtggatctcctcccctcccctcagatctcagcttggggtttggcacagccagggccccttccccagtgtgggagtggaagaaaccacctgtgcttccctcacagttgctgggcctaaatttagatcctgggatttttagatgtgaacactcccagctggtggaggggggtggtctggggactggcgtgggagggagcagtggagtgactgtataactgtcccatccagactcctgcaatcttcacccagaaacccaggagtaccagagtctggccaccctccctggggaggcaggaggcaggcatggttgggtctctttaccctttatctgggtcctgcagcctctgggcatccggccctgtctcagtccttctatagcccctttgtcctggctgtgatgggggtgggggatgttggaggggaggcctctggttgaggaggggctggagattctggctctatcccacccctagtgctctctaccaaaggagggcctgtgacactgcccctccctatgctcccggttcctgggtacagcagggatttttatgattcccttcccctgccctgctccccaagctgcctagctcctccccagaggtgttgtttgtgctcccttcctgcccaggccctttgccccctgtttgtgtaatatggactttaccctcagggtagcagggaactgggctacctctaacactgtagccttccaagcacagacacaaagtctgcacaaacacttatgggcacgtgggatagatggggccacctgaaatacttcctgcaaggaaacccaactatagattcctgagccagcaggaccaatgtgtacgtgttcgtgtgtacattgtgtgtgtatgtgtgtgcccacactactacttccctgtgcagaaagcttggctcctcccttatctggggagaagtgttggcactataacttgggaaagggggtatcctgccaggaaggggattggggtggggctgttccagaaatgactaaccttcctagtctctttcatttcaacccaaggaccctggagttcccagctcctctggaactagctctctttgctgggactagccaaccttcatggggagtgataaggagccctccaaggtcaagaagtcagactaggggtgtatgttataggagggattggggcctcaccagtctccctccctccattcccactgttgcctcccactgagctaccaccgcctcagggaagggtggctggaacaggtggtatctaccccctactccccaccccacacatggtctttccctgaaccagaggaaagagactggggtagggcttcagagtccaggacttcccatagcccgttgtccaccacatttgcaaagaagagtgaactcccaaggctgacatgccatgtacctctagtctaggctctcccctagtgtgggtgaggattgccatggtgaaaggctttttcatgaacctcttctaacaatgaaattgtgtggaggctcaatatggggcatctgctactatctctctccaggttcctctgtatttgctgaaaaatactctagggctggaaagtgatgctgaggttgctagagtgtgttgggatgggggagagagtgagaaggaaaccctgagtttaggaaggcggggaggcaactagctccttatctttcagctttaaagacaaagctcccattgaccccccctcaccccagcactgccagagctcccccctctactgaggtcacttgtctgagcccaaggcttgagggtggaggggagtgctgctgaggacggggtgtctagggacagggtggggcagcccccctcctggatagaatcgcctcattgtgggctggactgtggccccaggcactgcccccaccctctgcccccatcccaccctcagtagacacaataggggctgtgtactagtcccaaagagatatttattccaggacctagagagaggcaggatgagggtagagaagtgagtgccctagttggagggggagaggagggtaatcaaagttgcggccttttcctaacttctcttttctagggagagaaacaaattccctgtcttccttctcagttaaccccttagtacccaaaagaagcacagaggggtcccaggttgaaaaaggaaatcttttcaccttcccattcatggaatggtaaggggattctgagaagagagaaagctctcaggccactacagcttctgcctatcgcttgtgggagggttggaggcaaatgccatctgatcctgtctaatgtaactggaagagggcaaccaagggggtgatctttggggatggcagatgggctgagaatttgtgtccagccctcagccactcttccctctgctttgaacagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcaggttagtgagcccaccctccttcctcaacctgctcctctttattctcccctagaaccctccttccttcttcagggctaccttctgctggagttcacccttcctaagactcaggagttcctaagattcaaaaccgtgtatttatggggacagtggctgtcatctgggacctatggtctcactgttgtagccagggatatatagggggcagggtcaggggcaggtggtgttctgtggatagtgcaaggtcagcagggactagtgcagagagaaacctgaggaccaagaggttacctggggagatgaggaaggggccctactggtatgaggcactttgaggagaaagctgcctgtcttcactcccagaagtgacacagcagtgtgacacagtctactccctactcccaaataggaattagcaagagttaaggccaggtgcagtggctcatgcctgtaatcccagcactttgggaggccaaggaaggcagatcacttgaggtcaggagttcaagaccagcctgggcaatgtggtgaaacgctgtctctacaaaaatacaaaaattagctgggtatggtggcatgcacctgtagtcccagctacttggagggctgaggtgggaggattgcttgagcccaggagtttgacgctgcagtgagcgagattgtgccactcgtaacagagcgagaccctgtctcaccaaaaaaaaaaaaaaaggccaagctcggatcacctgaggtcaggagttcgagaccagcctgaccaacatggaaaaaccacatctctactaaaaatacaaaattagccaggtgtagtggcacatgcctgtaatcccagctacttgggaggctgcggcaggagaattgcttgaacccgggaggtggaggttgtggtgagccaagatcgcactattgtactccagcctgggcaacaagagcgtaactccgtctcaaattttaaaaaaaagaaaaaaagaaaggaaagaaagaaggaagaattaaaacagttaaagagtctttaatgcctgaaggaggagaggagattgagattattttgccctgttgtctctctcatttacataatctgctctgtcacagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaattagctggctatagtggtgcgcacctgtaatcccagctgttcatgaggctgaggcaggagactcgcttgaacctgggaggtggaggttgcagtgagctgagattgcaccactgcactctagcgtaagtgacagtgagactccgtctcaaaaaaaaaaaaaaaaaaaaaaaaaagcctgggcgcggtggctcacgcctgtaatcccagcactttgggaggccaaggcaggtggatcacaaggtcaggagatcgagaccatcctggctaacacggtgaaaccccgtctctactaaaaatacaaaaaattagccaggtgtggtggcgggcgcctgtagtccgagctactcgggaggctgaggcaggagaatggcgtgaacccgggaggcggagcttgcagtgagccaagattgcaccactgcactccagcctgggcgacagagcgagactccaaaaaaaaaaaaaaaaaaaaaaaccaaagtacagtatacctggatgtccctccttccctaggaattctacctttactctcctaaaccaaacccctatgagctggaggaatataggggttaaaaaccacctgtccatcttctgcttctccatgtcccagtcagttggaaaacatatgggcagggcttgggggagggaatgttgagtcagaaatctctccctctctcccttcccctcccccactagctaaaccggatctggacaggtgactgaggaggcaggagtttcttttggcctgactcctcatcttataaagggagtcttctctgcagcttagatttaattggacctatctgtctgcctcattctcccactcctgagtctcaggtgtccttttggatgggtggagaggtaaggaagaggcgttccgctgcggcccttaaccctgtcacttctttccctacctcagagattctgtcagggggtgtttatattgagaagaacgataagctttgtcacatggacacaattgactggagggacatcgtgagggaccgagatgctgagatagtggtgaaggacaatggcagaagctgtaagtggccgtgatcaagattgctccccagtcccaccaaaccagagtgactcccttctttccatcatccttacattcctgatctgaacccgcctccccagtgaacaaacacctcaggtccctgactcagcagcccaccagggcagaccattccagtctcctggaatctaaaccacagaggaggtgtttcaagaaaaggagcaggccgagcatggtggctcatgcctataatcctggcactttgggaagccaaggtgggaggatcgcttgagcccaggagtccaagaccagcctgagtaacatagcaaaaaatctacaaaaaattaaaaaaatcagacaggcgtagtggctcgcacctgtaatcccggctactcaggaggctgaggcagaggattgcttgagcccaggaggctgcagctgcagtgagctgtgattgtgccattgtactctagcctgggcaacagagtgagaccctgtctcaaaaaaaaaaaaaaaaaaatccctgagtactaagcagggaagccagatctttagactccacatctgttactcgttccactagaatatactcccatttccttggagcccaccttcccctgaccattcacatgcatatattcctgcatatattcagtttgcccaggaggaactaagttcctgggttgggactaggactaaggttggcatttgccccagtccctccccttcagctgcccagtgggtggtgtggaggcgtggccgcgccccttgttgacaggtccacttgagcccagccctgctctccaagggcagggagggacacagccctggctttttgcttcccgggattgaggtgcctgtgtactgacatcataccccgttgattaaaacaagcctttcttagccctgatggccccttgtgttgccttccttcccaaccaggtcccccctgtcatgaggtttgcaaggggcgatgctggggtcctggatcagaagactgccagacatgtgggtttgaaattccctccaaaaacttcactcatacgctttcatatcccttcctccccaagcctgggtcaacactgtgggggaggcatgagcagtggcctcagaattcagtcctaggagccctaacagccatgctttctctccttccatagtgaccaagaccatctgtgctcctcagtgtaatggtcactgctttgggcccaaccccaaccagtgctgccatgatgagtgtgccgggggctgctcaggccctcaggacacagactgctttgtatgtaccctttccattgcctgggttctgaaattgggatgtggcctttgaggaggaggtaggggtacacacgtaacataaatctgatgagcctccttttttcccaggcctgccggcacttcaatgacagtggagcctgtgtacctcgctgtccacagcctcttgtctacaacaagctaactttccagctggaacccaatccccacaccaagtatcagtatggaggagtttgtgtagccagctgtccccgtaagtgtctgaggggaaggaacaatgatcaacaatagtagatccaagattttagacaaaattgtggaagggaaaaagaatccagttggtgataaatagggagattggtgaatggttatgatcatctaaccactccagtgagtgacccttacgtccagtcctcccatgacttcagctatcacccttacttctgctccttgtagcaacaaatagtgaagagacttttgaatctagagggcagcacttaagggatctagggtggcagatggggacaaatccagtgcagagctggagggagcctaggcccagagcaagggttccattggtagctggtgatgttcctccctcatctctaatggtgtcctcctcctcttccctagataactttgtggtggatcaaacatcctgtgtcagggcctgtcctcctgacaagatggaagtagataaaaatgggctcaagatgtgtgagccttgtgggggactatgtcccaaaggtgggtaggagatggtaagaagttgtaaagagacagcctttcctctgagcctgcgcagaccacccccactgaacctctcttacatttgcagcctgtgagggaacaggctctgggagccgcttccagactgtggactcgagcaacattgatggatttgtgaactgcaccaagatcctgggcaacctggactttctgatcaccggcctcaatgggttagagatcctgccttccctccttagaccccagcccacgcacccctcacagttcatttcattggccaaaactttcctatgtggagctgactaggaatcaaagtcataaaattctagcctgttacaaaggacctgaaagaatgcttaacacatcctccatccaggccttcggtcccctcaggaacatctttgagcaattcaatatcgccctgccaaggaacaagggacaggaacaacatatcctccttcttaaagttttcttttttattcttttttcttttttgagatagggtcttgctctgtcacctaggctggagtgcagtggcgtgatctcgactcactgtagcctcgacctcctgggctcaagtgatcccaagtagctgggactataggcacacaccatcatacttgactaatttttttgtatttttttgtagagacagggtcttgctatgttgcccaggctgatctcgaactcctgtgctcaagcaatcctcccatcttggcctcccaaagtgctagggatcacagcacccaacctccttcttaaagttttgtaaaagttcttccttagatttggataaaaatctgtctccaggctgggcccggtggctcatgcctataatcccagcactttgggaggccgaggtgggcggattacgaggtcagatcgagaccatcctggctaacatggtgaaatgccatctctactaaaaacacaaaaattagctgggtgtggtggtgcacatgcctgtaatcccagctactcaggaggctgaggcacgagaatcacttgaacccaggaggcggaaattgcagtgaaccgagattacaccaccgcactccagcctggcgacagagcgagactctttctcaaaaaaaaaaaagaaaagaaaagaaaattctgtctccccatgacttttagctgttttcactcattctgctccttggagcaaaaagaacaaagggactttctagtctataggacagcatttaaaatgtgtgtgtgtgtgtaaaaaaaacccactatgaccacctgttttttttttcctttaattttttattttgacataattttagatctacactaaagttgcaagaatggtataaaattccccatatactttttttttttttttaagacaaagtctcactctgttccccaggctagagtgcagtggtgcaatcttggctcactgcaacctccgcctcctctgcctcccgggttcaagcaattctcctgcctcagtctcctgagtagctggaattataggtgtgtgccatcatgcccggctaatttttgtatttttagtagagacagggtttcaccatgtaggccaggctatctcgaactcctgacctcaagtgagccacccgccccagctaaacaaaggtttgtaacccctacgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccttaaaaataatattttcttacataaccacagcatagttgtttgaatcggaaaattaacattaacacaaaatattatctaagctacagaccttattcagatttcactaattgtcctcctaaggtttgggatcatacattacattcagttatcgtggcacttcaatctcctttataacagctcctcaggttttgtttatctttcatgatattcttgatgagtatagattaggtaatgggcagcatgttcttcagtttggattagtttgatgtgtcctcatgattagattcaagtttttgtagtttttttttgagacaaggtctggctctattgcccaggctggaatacagtggcatgatctcagctcactgcaacctctgcctcccgtgctcaagcgagcacctcagccccctgagtagctgggattacaggtgcatgccaccatgcttggctaattttatatataaatataaatatatatatatatttatatataaatatatataaacataaatattatatactatttatatatttatatatgtgtgtgtatatatatatatatatttttttttttttgagacggagtctcgctcttgttgcccaggctggagtgcagtggcgtgatctcagctcacgcaacctccacctctcaggttcaagccattctctatagagacagggttgcaccatgttgtccaggatggtctcgaactcatgagctcaagtgatcctcctgtctcagcctcccaaagtgctgggattataggcatgcgccgctgccaggctggagtttgataagaacaccacagaggctgtgagctcagggcatcctattgaggatgtacgtgatgttgatttgtcccagcactcacaatgatgtctctggtcacttagttaaggtgatatctgtcaggtttttctactgtaaagttactatttttccattcacaattaatgaatgtcttgggataattgcctgaatcaattattgttatgatagttgccaaatgataattttctaattccattattccttctgcatttgtttgttggcattctactgttaggaagagtctttccagctgagcacagtggcttatgcctgtaatctcagccctttgggagccagtgggaaaattgcttgggcccaggagttcaaggttacagtgagctatgatggcactactgctctccagccagtgcactcactctgcacaacagagtgagaccctgtctcttaaaaaaaaaaaaaaaaaaaggccaggtgcagtggctcatgcctgtaattccagcactttgggaggccgaggcgggcggatcacaaggtcaggagttcaagaccagcctggccagcatggtgaaaccctgtctctactaaaaatacaaaaaattagccaggcatggtggtgtgctcctgtattcccagctacttaggaagctgaggcaggagaatcacttgaacccaggaggtggaggttgcagtgagctgagattgctgccactgtactccagcctgggcgatagagcaagactctgtctcaaaaaaaaaaaaaaaaaaaaaaaaaaaaaggtcttcctttcctatttactcttatggatacttattttattctagtcaatggttataatcctttacaatcattatttattttagccagcccctccaagttggctcctgtgttctttgggctgtacccttaattctttgagtcttgtcttgtttgcacaagatgctctgggcttatattatatttcccccatcccagccatttctccaaggaatgtttccttttagtggagaatgatatttagaaaccaaatgctgaggctgggtgtgctcattgccattgagttatacctttaccttattgactggtttctactgttctattcagagacccctggcacaagatccctgccctggacccagagaagctcaatgtcttccggacagtacgggagatcacaggtgagtggcagagagtttgccctttctagaagaataggtgaaccactggcataaattgcggtataactacttgagaaaatcacgtcccaagttataggggaggagccaggagaacccaagaaagaagaaggctccctgcccatatgcctctctccaacccctcaggttacctgaacatccagtcctggccgccccacatgcacaacttcagtgttttttccaatttgacaaccattggaggcagaagcctctacaagtgagtaaagggtatggaggaaatggcatcttcaggcaatgaagcctgtgtcataggcattctttagtaaaatacaaggcactgtctcatacagcagtgcctcaaaaccaaagggtttcagagtttcacgaggaaaaggcaaaaggagggggattccctctcagtggatctgactagcactgagcaaatttcttgactaacatgaatcctttgaatagttaatgttcccttagtagtctctcctctcatcctgtctccttattctcagccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcggtgagggaaagggtctgctaggtggtgagaatagggagtcagggaggagagggctgaaaggactattctgccctagacgtgggagtagggttgagggatggaaccaaggagaagggggctgttaggctggaagcagtaacgaggaagaataatgaagagagggcttgctgggagtcctcagactcctctcctaacccaccccttcctttccagtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttctgcatgtgccttggtgggattgaggtaggagacctgtggttgtgagatcggagcatgaaggtcaggacttggaagtgacccccccctccctttattccccactacagggagcctcgagaatttgcccatgaggccgaatgcttctcctgccacccggaatgccaacccatggagggcactgccacatgcaatggctcggtatactagtagcaccaggatctccaagggagacagagaaggggcaatacttggagcatctggggaatgatatggctaaggatagcacagagaggccagataatgctagggcctgcagatagaagatcctgaatgtctgggttggtctttgctgggaggtatggaattgaccttgggatctgattcttcctgaccttctctcttccactcagggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtcagtgatgggataataaggagagggggtcaggtggaagggtaggagcacagaactagagtgagggaagcagaaagaagagagaggctgtgattcaagaatcactcccagctggccgggcgcagtggctcacacctgtaatcccagcactgtgggaggccgaggtgggtggatcacctgaggtcgggagttcgagaccagcctgaccaatatggagaaaccctgtctctaccaaaaatttaaaattagcccggcgtggtggcgcatgcctgtaatcccagctacgcgggaggctgaggcaggagaatttcttgaacccaggaggcagaggttgcggtgagctgagattgcatcattgtactccagcctgggcaacaagagtgaaactctgtctcaaaaaaaaaaaaaagaatcactcccagctgtgtagcgaaggattggagaaagggaaaatcagtaacagcacaaaattacaccacagttttgggaacctggaataacctcagttcaagggagtttcacagaagaggggcttggggagagctagtgagctggaggtggaggccatgtcttgggatcagctctgggctccaggatgggatgccacggtaagttctgaaacaagcttttatatgttaggctgttgaaattgagcctctgctgtccaagctctcatttaaggtggtgactttcttccctaggtgtaaaggaccagagcttcaagactgtttaggacaaacactggtgctgatcgggtatgatggggttggagattctggaaactggggatatttgggagttgggagagaggtggttacctggagagaagagggaggctgtcttcattctggccttttatgtatgcagtccactatcactggacacttgggactcaagaatgcaggcttctggacttcccttcctaaaattaactttcagtagtctaagactggtccagatttaggttggtcccttcagtgcttaaggatatatatgtgaatgttaatttcttgccccaggtcagcatcataccttcaacacaagtatagttgacatttgtaaggaagatgcaaacccaggataatgttgggtttctatatatcccatagcaaaacccatctgacaatggctttgacagtgatagcaggattggtagtgattttcatgatgctgggcggcacttttctctactggcgtgggcgccggattcagaataaaagggctatgaggcgatacttggaacggggtgaggtgagtacttagcttacttttgttttttcttttctttttttgcatgtcctggaagtctctttatagcttaattttgagtggtaccctgtgcacccaggggtcagtgatgggataaatgtcactcccctcctctttccccagagatttgatccctttcttcaaggaagtagtgtggtcccctagaagaacactggtcagagaaatgggaggcatgcattctagtcctgattttgccattaatttgccacatgactttgaagaagttacttatcttctctgtgcctcggtttatgcatctatacagaggaaataacatttgtccttccaggatggctgtaagggtaaagggggatgatgtatgtgaaagtgctttggaaagcacagagcactgtataaaaggtactcaaggtggtaatagtactaccaactctccctagctgtccccttccccactttgtgctcctccatcaaagggaaaacccaacccctttgattcctgatctcatgagcacaaataacttcctcagttctcagggtctgtacctcaatatgcctataatccattccaggactaacggtgcttcctcttcctgccctttcagctgtgctgcttttggcattcacctatgaggagcgggttggagtgggacatgggaatggcctttcctgagtaactccttcccatttgctcctcagagcatagagcctctggaccccagtgagaaggctaacaaagtcttggccagaatcttcaaagagacagagctaaggaagcttaaagtgcttggctcgggtgtctttggaactgtgcacaaagtgagtgacccataggaattctggagaggtggggaaggcatctagggcaaaggggtgaaagatttttgcataggattgacctagggagaatgaccttatgccaactcctgccccaaacttcccagggagtgtggatccctgagggtgaatcaatcaagattccagtctgcattaaagtcattgaggacaagagtggacggcagagttttcaagctgtgacagatgtaagtgaaggaaattctgtatgccgctaggagagaggacaatattagatacaatcatgtagaagcagggtcctgtgcttctcagcagctactatgttagccagaatgttgggggtgggggggcctgggctggctgtgcacatgctgagtgtatgtgaacctgttggtttcctagataataccttttgtgtctcttagcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaaggtgagagaagcctggaggaattctgtgataagaactgcttgtctgggggccagccaggaaaaagtgagaaggttgaagttctgagaggtgaggtccccaacccccgggctgcagactggtaccagtccatggcctgttaggaaccaggccacagagcatgtgagcggcaggcaagcgagtgaagcttcatctgtatttacagtcagtccccatcacttgcattaccgcccgagttccgcctcctgtcagatcaggggcagcattagattctcttaggagcttgacttctattgtgaactgtgcatgtgaaggatctaggttgtgcactccttatgagaatctaactaatgcctgatgatctgaggtggaaaaatttcatcccaaaaccaaccctccccttcccctggaaaaactgtcttccacaaaaccagtccctggtgccaaaaaaggttggggaccactgctgagaggtaccttcaagatttgggggaattccagatctcagtgactgattcccccaaccttaagaatactttcttcccctatacctacagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaaggtgaggagacacaaagggtaaggaggcgggggtggagtgaagcatggggatagggagcagccagtggtctcttccagaggcaagcagatgcttcatggtaagttcaaggagagaaggctgcagatgccagatattttagttcagagggcaacaaataaaataatgatcaagaacttgggactggccgggcgcggtggctcacgcctgtaatcccaacacttcgggaggccaaggcgggtggatcacaaggtcaggagatcaagaccatcctggctagcacggtgaaaccccgtctctactaaatatacaaaaaaaaaaaaattagccaggcgtggcggcatgcatctgtactcccagctactcgggaggctgaggcaggagaatggcgtgaacccaggaggcggagcttgcagtgggccgagatcgcaccactgcactccagtctgggcgacagagcgagactccgtctcaaaaaaaaaaaaaaaagaatttgggacttggaaatcctaagaaaatttgtggaaataaacttgtgatacctctatctttaatccgcagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgtgagttacctgctgagcccaaccattttctctttttttctttttttttcttttttttttttttttgagacagagtctcacaattgtcacccaggctggagtgcaatggtgcaatcaatcttggctcactacaacctccgcctctcgggttcaagagattctcctgcttcagcctccggagtagctgggattacaggcgcccgccacacctggataactgttacacttttagtagagatggggtttcaccatgttggccaggctggtctcaaactcctgacctcaggtgatccgcctgcctcagcttcccaaagtgctgggattacaggtgtgagccatcatgctcggcctgactgcagccattttctgacttccctctgtactcctcttatggctctattccttttttttttatggagtctcgctctgttgcccatactggagtgcagtagcgtgaccttggctcaccgtgacctccacgttccaggtttaagttcttctgtctcagcctcccagatagctgggactttaggcgtgcaccaccacgcccagctaatttttttttgtctttttagtagagatggggtttcactatgttggccaggctggtctcaaagtcccgacctcaggtgatccacccgccttggcctcccaaagtgctgggattataggtgtgagccaccgcgcccggccatggaatgtattctcttttatgtctctacctcctacatcttatctccaggttggatgattgatgagaacattcgcccaacctttaaagaactagccaatgagttcaccaggatggcccgagacccaccacggtatctggtcataaaggtgagtagggagtaggaggtgctaaggaaatttagaaaaaggaggagttggctggaaccaggattccccctaacaatcacctatcgatatagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtggggtaagacaacttctaattacccaacactttgcaccctgagccctcacaaaccctacagatacccagattaactactcaaaggcccccatggtgaatgtagatttctcccttcatcttaaccttttccttattttttcatcctagagccagagccttttaagtccatcatctggatacatgcccatgaaccagggtaatcttggggagtcttgccaggtaagttctgttgctgagaggctgggttttaggatcagattgatacgagtagtatggaagacattagaaacctctgaggtttaatcagtgtcctgcaaaaaagaaggcagtgagggccgggcgagttggctcacacctgtaatcccagcactttgggaggccagagagagtggatcacctgaggttaggagtttgagaccagcctggccaacatggtgaaaccccgtctctacccaaaatacaaaaattagctgggtgtggtggtgcacacctgtaatcacagctactcaggaggctgagacaggagaatcgcttgaacccgggaggcagaggttgcagtgagctgagattgtaccactgcactccagcctgggtgacagagcaagaccctgtctcttaaaaaaaaaaaaaaaggccaggtgcggtggctcacgcctgtaatcctagcactttgggaggccgaggtgggcggatcatgaggtcaggagttcgagaccagcctgaccaacatggcaaaaccctgtctgtactaaaaatacaaaaactagctgcacatgatggcaggtgcctgtaatcccagctactcgggaggctgaggcaggagaatcacttgaacagggaagcagaggctgcagtgagccaagataatgccactgcactccagcctgggcgacaagaacaagactccacctcaaaaaaaaaaaaaaaaaaaaaaaaggcagtgaacaacccaatatccttctaaacaaatctctcttctttcctcatcatgtaaatttccttgcattattttctgtttattttcttccttaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggtgcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtgcctgactcttcctagggctttcctcaatttttcctcgaattctttccccgggctcctcttttttcttctctgatcatatgcctctctgtcctattaattttttcaaactttcccctaccctcatgaagttcttcacatacctagcctttcttctcaacccccaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagcttcctgtctgtcaaatgaagacatttcgtatgttagataagagatctgctcctcagcagtggatactcacctttctgtgttctgacagtgctactctgtcccatgcagctttctctagtcctactattacttctatttctttagaacaaccatagcgcatagtccttttcattaagggttttagtaggaatctacaaggcaaccaattgggaataacaaaaagaacctacgtgctttaggacttataaaaagccctataagccctccttcagaggccaaacactgaaacctccagatgcttctgaattcattatcttagaaaagtcatcaaatctttttattttttcacggtaagaactctcaacaaacatgtctttctgaacacttcccttaggtgctccatccaggtgcctgttattggaacaataaagtcatgttacttcattaggagtccggcctctagattgcgaggcctttaaatggatgatccctccggtgtctggctgcccagttagcccccgttaccagcacccttggtcttcttccacctgtctgcccctccctgttctcccagcttcggaggacgactggaccggctgggcgggtttcgccagccgacccagggatccgaagaagggcgcacccagcctccccgacctaggtgtagacactgcccacccgctgcggctccactctactccacccctgcccgctcgactttaaacctatttccccgccgtagctccgcccctctcccctcagcccgcccctctctgttactggctctcgctcagcgttctcggtggaagtggtttttccgggagagaccacgcttcccctcaagctccccaacggctccgccttcccgccggagcctgacccttcccagagtgcccggcgattccggcgtgcgaggcccttggagggcaaggccccagggcctggcttaggagcgcgagaggcaggctgggaattgtagttcgaaggccctcgagagcggctagagtctggcggccgagaggactagttgtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataa

SEQ ID NO: 13894 - DNA, 7782 bp, Human
ctcacaaagtgctgggattacaggcatgagcctgagcgcccccaattgggtggattttgattgcacatatggagaatagcacttaacagtttacaaagcacttcatcctcctaacattcagtaaaatacattttatcgaaactctccattaactataacttcctcttgcccaagtctaaaatgttcagggaaggtccatgcccttttttctcttgcatttttccttcataggaagtatgagaagatgctttttctccactcagcttgaatcatgcttttggttttgtctctgacagatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagagaactgctagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtgggacggatgcgggcggcgaggcgctgggcgctgagggttggggatggactgaagcgaaagcaatggcggagtccttagaaagggggctggtgtccgtacgggtaatcacttacgggctggaggtggggacgcaggaatcttcggtgcaggatccaaatgggccctagttattgctctcctcgctggcctcctggcctgactgagggctccctgccggcagttccctagtgcctgtagtcctcacgtaatcgccaacttacctcctgtagctgccacaaagccccgtgaaccctaggcatgcagtgctaaagtaccaacacttagggcctcacctatccacgtagagtctggggctgagccgcaagtcctgagctcgcgctcccacccaccaccctgggggaatcagagccctcaagcgctggaacagagaagcccctttgtgtcccggccatttcctggaaagtagagccagagtcacaatgaggcctttgaaagccttggggtgaggattgggggggtcagggaaaaatggagtcggctcctcacacttatgttttattcccactcaaacccaggtggagcgaccccattacgctaaagatgaaaggctggggttggctggccctgcttctgggggccctgctgggaaccgcctgggctcggaggagccaggatctccactgtggaggtaaaggcacaacgggaaaaagaagtggaggaagcagagccttgggagggcatgagatccaaggcctgggagaaggatgaatggaaatcctgggttgatcccattctcctcacaccctaccccctaccctgtcccctgctctcattctctcctcttccaccagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaaaaataaaaaatgaaaaaacagaaataagaataaaaggtcttatcctcataattaggaaattttaatcgaaaacaacacacatgtacacaaaggtgtatctaataagcaatatataaggcagtgttaagattacagtgctagcctgggcatcatggcaaaacaccaactctacaaaaaaatgcaaaagttagcagtgcatggtggcatgtgcctgtagtgacagctgcttggaaggctgaggtgggaggatcacttgagcccaggaggtcgaggctgcagtaagccgtgattgtgccactgcactccagcctgggaaacacagcaagaccctgtctcaaaaaaaaaccaaaacccagcactttgggaggccaaggcaggcggatcacctgaggttagaagttcgagaccagcctggccaacatggtgaaactccgtctctactaaaaatacaaaaaagtagccaggcgtggtggctcatgcctatagtcccagctactcaggaggctgaggcaggagaatcacttgaacccaggaggcagaggttgcagtgagccaagatcgcaccactgcactccagtctggttgacaagaacaaaactctgtcttgaaaaaaaaaaaaggccgggcgcggtggctcacgcccgtaatgccagcactttgggaggctgaggtgggcagatcacaaggtcaggagatcgaaaccatcctggctaacatggtgaaaccccgtctctactaaaaatacaaaaaattagctgggcgtggtggtgggtgcctgtagtcccagctacccgggaggctgaggcaggagaatggtgtgaaccctggaggcggagcttgcactgagccaagatagtgccactgcgtccggcctgggcgaaagagtgagactccgtctcaaaaaaataaataaataaataaaataaaataaatgaaaaccacactaggccaggcacagtggctcacgtctgtaatcccagcactttgggatgccgaggcaggcagatcacctgaggtctggagtttgagaccagcccgaccaacacagagaaaccccatctctactaaaaatacaaaagttagctgggtgtggtggtgcatgcctgtagtcccagctactcaggaggctgaggcaggagaatcacttgaacccaggaggcagaggttgcaataagccgagatggcgccaatgcactccagcctgggcaacaagagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcggtgagctatgggaatcggtagctggttcttggacattaaggggttgttggagaaccaattagaaagttaggctgatatccttgtcctcctctttggaagtgaaggcaagaggcctcttattgccctgtgtcacccatttctcccttgggttggcagtgtgagagcattgtggaggaatacgaggatgaactcattgaattcttttcccgagaggctgacaatgttaaagacaaactttgcagtaagcgaacaggtaagctgcccccactttatctcctgttctagtagctctgtggaacctgacattccctaactcacccatacacccccatcccagaaacctctggtattaggtcaagagctgtcttccatttcccttggcttagggacttggggtgttcctccacattttctgtcagctttcagaatttgtgtccccttgaccctgagatacaggtgagaggacagtggggatgttttatcatttataagcatatattctgcagaatggtggttggtgtgtgtttgtgtcagcttggtctgggaaattttcttgatactggcagatatcagtatgagaatggcatattcctttaaattgtttgccatttgcagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtacaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagccattgtcaatctggactataagtctgtccacaattctgtgtgtagagattccagactggggcatagggatgaaaacctaaaggataccttcttttgggaaattctttttttctttttttttctgagatggagtcccgctctgtcgcctaggctggagtacagtggcgcgatctcggctcactacaagctctgcctcccaggttcacgccattatcctgactcagcctcccgagtagctgggactacaggcgcccgccaccacaccggctaatttttttttttttttttttgtgagacagagtctcgctctatcgcccaggctggagtacagtggcgcgatctcggcttactgcaagcttcgcctcccgggttcacaccattctcctgcctcagcctcccaagtagctgggactataggcacccgccaccacgcccggctaattttttgtatttttagtagagacggggtttcaccatgttagccaggatggtctcgatctcctgacttcgtgatccgcccgccttggcctcccaaactgctgggattacaggcgtgagccaccgcgcccggcctgcactggctaatttttttgtatttttagtagaggcagggtttcaccgtgttagccaggatggtctcgatctcctgacctcatgatccgcccgccttggcctccccaaatgctgggattactggtgtgagccaccgcacctggcagaaaattcttaagcactctgagcttgaggtatggttgtctcagggtttcaaatggaatatctccggtcccaagaacacctcaaggagagaagacctgaataaacatttcaaaggttttaaaaattacatcattttagaatctaaaggaaccttagaggtcgtctggttcacctctgcccattttattgatgaagaagctgaggcccagagaagccatagaactttatgaagttctgtatttaatggcaaaactgggtctataagctaactttcccaagtgctgacctgatctaatatagctatagagtaccttctattttaagtcttttttctctaataataccttgcactaagcctggcgcatagaatgcatatattccacaaagctttcttgtaccaaaaatccctgtgaaatctgacaaattaactagagcacagagcaagcactctgatatttgttgtcaactaatatcagcctggtgttaattccatcttctcccatcatccataagaaatgctgtgttcgctctagttttccaaaccaactattataaagcttattttttcttctatgatgcatataagtaataattacattttttcatgtccctgaaagtatacccaaggtgctgtccatttcgtgcttcgtgcctaaaaatgcctttcttttccatcagaaagcttatcagaagt

SEQ ID NO: 13895 - DNA, 7562 bp, Human
tgttccttctgatgttcagatgtgtttggagtttcttccttctggtgggttcgtggtcttgctggctcaggagtgaagctgcagaccttcacagtgagtgttacagctcataaaggcagtgtggacccgaagagtgagcagcagcaagattcattgtaaagagggaaagaacaaagcttccaccgtgtggaaagggacccaagcgggttgccactgctggcttgggcagcctgcttttgttctcttatctggtgccacccacatcctgctgattggtagagccgagtggtctgttttgacagggtgctgattggtgcgtttacaatccctgagctagacacaaaggttctccacatccccaccagattagctagatacagagtgttgattggtgtattcacaatccctgagctagacataaaggttctccaaggccccaccagagtagctagatacagagtgttgattggtgcattcacaaaccctgagctagacacagggtgctgataggtgtatttacaatccctgagctagacatgaaggttctccacctccccaccagactcaggagcccagctggcttcacccagtggatcccgcactggtgctgcaggtggagctgcctgccagtctcggtgccatgcgcccgcactcctcagcccttgggtggttgatgggactgggtgccgtggagcaggggtcggtgctcctcggggaggcttaggccccacaggagcccacggcgaaggggggctcaggcatggcgggctgcaggtcccgagccctgccccgcggggaggcagctaaggcccggcgagaaatcgagcgcagcgctggtgggccggcactgctgggggacccagtacaccctccgcagctgctggcccaggtggtaagcccctcattgcccggggccggcagggccagccggctgctccgtgtgcggggcctgccaagcccacgcccacccggaactccagctggcccgcaagctccgcgctcagccccggttcccgctcgcacctctccctccacacctccctgcaagctgagggagccgactctggccttggccagcccagaaaggggctcccacagtgcagcggcgagctgaagggctcctcaagtgccgccaaagtgggagcccaggcagaggaggcaccgagagtgagcaagggctgtgaggactgccagcacaatgtcacttctcactaggattataagggtgagccaccacacccagctcttttattacagtataatgttataatttttttctttttctttgttttttttttgagacgtttgagacggagtctcactctgtcgcccaggctggagtgcagtggcgcgatctcggctcactgcaacctccgcctcctgggttcacgccattctcctgtctccggagtagcagggactacaggcgcccgccgccaagcccggctaatttttttttttctatttttagtagagatgaggtttcgccgcgttagccaggatggtttcgatctcctgacatcgtgatctgcccgtctcagcctcccaaagtgctgggattacaggcgtaagccactgcgccgggctaatttttctattttgttattgttgttaatctctcttttttttttttttttttttttttgagatggagtctctctctgttgcccagactggagagcagtggcgtgatctcagctcactgcaacctccacctcccaggttcaggtgattctcctgcctcagcctcccgagtagctggggttacaggcacgtgtcaccatgcctggcttatttttgaatttttgtagagacaggttttccccattttggccaggctggtctcaaactcctgacctcaggtgatttgcccgcctcagcctcccaaagtgctgggattacagacgtgagccactgcgccgggcattgttgttaatctcttactgtgggtaatttagtaattaaactataagaggtatgtatgtatgggggaaaaaacagtaatatagggtttggtgcaatctgtggtttcaaacatctactgggggtcgtagaacatatccccagtggataagggggtactactgtacttgttggctcttcatgttagctctgctaggcagatgtcatttcagagaagaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaagatgggagaaaggtgattctgattctagaagcacccatccctcctaccccattccccacccgcattacctgccatcctgtcagcacagtctgtctctgaagtgctccaagttttctctaagggcccatttggactcccactctcaagactcctcacttgcccagaaagctccttgctgaccttctctgtgtcttcctctcacccattcccttaggcctccctaatatcccctcccagggtctccctatcttgatcccagaatcttccttctacaggtctgctacaatgctgctgctgcacagagctgtggtcctcaggctccaacaggcctgcaggtaggccagcccatcccaggacttgcctcctagcccctatctgccacccttagtgtcttttacaatgtcataccttgcaaataagacagttgagagagtgtgtccagggaggacagagaaagccagatcccacttttcccacctatccctggagaaactaagttccaacttaaggaaccaatggccaaccagggagaaagaagtagaccccaagccttcactagccctttcacatgaccatacgtgctactaagaccgacctctcttccagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggtaagtagggaaagtgcttcattgtcagaacagactgggtgcagtggctcacgcctgttatcccagcactataggaggccaaggtgggtgggtcacttgaggttaggagtttgagaccagcctgggcaacatggcaaaaccccatctctagtaaaaattagccaggtgtggtggtacatacctgtaatctcagctacttgagaggctgagacacaagaatcacttaaacccaggaggctaagtctgcagtgagccaagatcaagatcgggccactgctctccagcctgggtgacagagtgagactccatctcaaaaaaaaaaaaaaaattgtcagaataaaggaatcagtcctagtaaactccacaggcaacccaggctgtgacccatgttcttgtagttaccacagagttcacagtgacgcagtcttcatgcacagtggagatgaaatctgctaatctgctaccttcgcttcccagtggccaacaccgtgggttgggtcagggtgagctcaagtgatttcttcttattcttcttcattttttcttttttttttttttgagatggagtttcactcttgttgcccaggctggagtgcaatggcatgatctcagctcaccacaacctccacctcccgggttcaagtgattctcctgcctcagcctcccaagtagctgggattacaggcatgcaccaccatgcccagctaattttgtatttttagtagagacagggcttctccatgttggtcaagctggtcttgaactcccgaccttatgtgatccgcccacctcggcctcccaaagtgctgggattacagttgtgagtcaccacgcccgaccaagtgatttcttcttaatagtctcttcccttttatcttactccttccctgccaataggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataactcttgggcctggggagtgagcctattgcaggaggaaggatgcatttgtactgggatgtataatgagattagaccaaaacaaacaaaactggggaggaagacagagaggaagtaggcttgtaggttaagaagtagggcttccggctgagcacagtggctcacgcctgtaatcccagcacttgggaggccaaggcaggtggatcacttgaggtcaggagttcgagaccagcctggccaacatggcaaaacccagtctctaccaaaaatacaaaaattagctgggtgtggtggtgggtgcctgtaatcccagctacttgggaggctgaggcaggagaatcgcttgaaccaaggaggcagaggttgcagtgagccgagatcacacccactacaccccagcctgtgcgacaaagcgagattctgtctcaaaaaaaggggggcttccttctctgaggtttggcagtatctgcagggacacctaggtgattgacctcaggataccatgaagagaggagaggtgacaaaaacatgtaccctccaactcctttccccaacagttccaatgcacttggcaggaaaggcaaagggtgctaggagtttaaaatcaatattgtcttaggaggtcgtgaaagcaaaataaatcttgaggccccagaatcactaagctaaagggaaaagtcaagctgggaactgattagggtaaacctgcctcccattcaaagtcatccctctgctcactgagataaatgcatacctgattgccttctttgagtggaatacaaccatttgcctcttttttttttttttttttgtagagacagagtcttgctctgtcacccagactggagtgcaggagtgcggtggcacgatctccgctcactgcaacctccgtctccggagttcaagcaattctgtctcagcctcccaggtagctgggacgacaggcgcacaccgccacgcccggctaatttcttttgtattttagtagagatgggtttcaccatgttgcccaggctggtctcgaactcctgagctcaggcagtacgtctgcctcggcctcccaaagtgctaggattacaggcgtgagccaccaagcccggctttttttttttttttttttttttttggagatgaagtctcactctattgctcaggctggagtgcagtggtgcgatctcggctcactgcaacctccgcctcccgggttcaagcgattctcctgcctcagcctcccaagtagctgggactacaggcgcgggccaccacacccggctaattttttatttttagtagagatggggtttcaccatgttggccaggctggtcttgaactcctgacctcaggtgatccgcccgcctcggcctcccaaagtgctgggattacaggcgtgagccactgcgccccgctccatttacctcttatctacctatgacctggaagcctcctcccagcttgagttgtcccgcctttacatatattgattgatgtctcttgtctccctaaaatgtataacaccaagctgtgctccagtcacct

SEQ ID NO: 13896 - DNA, 9017 bp, Human
tggtctgacctcaagtgatccacccgtctcagcctctcaaagtgctaggattacaggcatgagttactgtgccgggcctcatcccctttctttttttttttttttttgagacggagactcgctctgtcacccaggctggagtgcattggtgtgatcttggctcactgcaacctctgccttctgggttcaagtgattctccagcctcagccttctgagtagctgggactacaggcatgtgccaccatgcccagctaatttttgtacttttagtagagacgggggtttcaccatattggccaggctggtctcgaactcctgacctcgtgatccacctgcttcagcctcccaaagtgctgggattacaggcgtgagccacggcgcccggcctcattccctttctaatgtgtgctgtaaccctagttgattctgctgggggaggatctggaatcatctattgagcatcccaccactagaacaagagaagtcataagataccccattctttctccacttccaactctcctcagagcagcacgggacattccagaccctctcaccaccccacccccgccccttgctcctgtcacgaggcccaatcccccagagccctttcatgtgatgctcagctgagacccctctgcctatctctccagccccagaacaaaaggtctgggctgtgttcacccgtacccatcccaagaggagaggattgtatctccttagtgttcttacccaataccacattctctgactccccactttaaatctcctaccccaagagacgtttcctaaaagagtctcctgcacatttcacccctttggagcccgtgctccagctcactgccaaggaagcctcagaatcagtgccacagagaccttctatccttctgcccctccaagcatatgagattattttcaggcaaaatcccaaatctccatgtagggagggagcccaggtgcccacatcctcactaaatcaaatgagtgggagacgcctgaaatattgccgctatctcccattaggaggacagaaaccagagcagggggaattcatccccaagttcacacctgctcatgtccacatatccacacataccttttgtagcccccacagccagcaaagcacctatcacagccaaatgaagaaggcatctttttagcaccagatccattgtgttcttccctccagcaaccaaaggcactggggggactgggataggcccctatataagaaaagggtgctcatttgcatagcccttcctcttctccctcagagaaggcctgggaggggccggaggagaggaaaaaggaaaaactgacaaagggatcctggtccctagacattgctttcccatcctgctactcaatgacagtttctggtttcactgggtcactctcatcttgatgcactcccgggcaagagctaactgaaaggcagctgcgtaacacataccagacacaacagtttatcatgggagagtgaattaaaccaggaacttctcaaaaagacagaaacagaaccctgcatcccaaaacagagacagtgtcggggtatgctatgaggcagaggcaacgactcctctgaggcccaggattcctttgcaacgagattcccggcttcctggtttccaaaggaggctcctgggccaggtggaatttaaccttaggtcgatacatattttccccaggattggtgaaaatagtgagttagaaatcaagaaatccctacagactagagacataggtaggaaacttggacccaaagcaggtacttgggaagagtgttcagccgccccaccggggaagaaacttgtctagcccccaagaaccaaacttgcctggggcgggatcatttgcggggaggagcgctgggctcgccccccggctctgacgttgaccaatagaaaggcctgggggcggagccagggaaacgcgggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagtaagtatgcgtctgagaggtgatccagctggaaaggaggataagttctgtctgtacagtgtgggcatttctctctctcacacacctccatttcctcaaactttccttctctaggctgctggatgtcattcacacagaaaataaactctacctggtttttgaatttctgcaccaagatctcaagaaattcatggatgcctctgctctcactggcattcctcttcccctcatcaaggtaatgcttctcatcagctcctctcatcatgggcatgtcttgggggactggtggcaggcaattcagggtgatattttatgattttggcctccttctgagccctcatctcctatacacacacactccccttctttttgtgtctccttccctgctcattatattcattaaccctagggttggactgaacaatcaaagttgaaactctagtgagtcaacctagcaactcaggtgggaggtcagatgaaactcagataaacgggatttgagagcacttggtaaattcctccaaaaagcccttccatttggtggaagacctagctagtgagtccctattgtctattttagggctggattcttcactcccagagctactttcaatctattaacaaacattttttcaatgcacaggatgtagaaaagggatggaaaattgagtaagacttggtccttatcctctctgggctgacagtccattgggagaaatagcttgtaaatatgtaactataatccaacataataaaggctttagtagagttttaggggcacagagcaaacccagtctgctcactgtaatggagaaacacagtcctctctttctcctttgtcagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgagtccctttatgtcttttttctctgagcttcccaagaggtgttaactagggtattcacaaagttactaaaaatatctggctaacagtttcttactaggtagaaataatctcttgacatcctaaagagtcttagggtatgcatggaattcatactgtgttgctaactgggcccacacctgtaataccaatactttgggaggctgaggtgggaggatcacttgagcccaggagttcgagaccatcatgggcaacatagcgagaccccatctctacaaatctacaaaaagaaaaaatttagaaataaaattatgaccaatttgtctcaagtttttccaggaagatctcaaattaggggttcagtccagaactatggactggaaatcagtgggaggggaaagatgatggagggaaggaaactgcttgttaagaggccaagagtaagcagagtagtgttgaggaactgagatgcgggaatttccataccctataaaccaccccgcccctccctattcccgtccctcaggtggtgaccctgtggtaccgagctcctgaaatcctcctgggctgcaaatattattccacagctgtggacatctggagcctgggctgcatctttgctgagatggtatggaggcttgcccaagttccacccagccccctccctctcctccccacatccaagaacaacagaactgcttcttggcccagacctatggcccttctatcacagggttctctctctaaagtagcaccaaggggaatggtgggaaaggatgcaactgttgccctgatatcaaccacagtgttaggatatcctcaaacagccttagtacctggtatacatctcttatccctgaaataagttaaagcatttctgcagctgttttagctgtagtctgcatatatttgggagaatgattccatttagtgcctcttttatttcaggccttcatttcaaggcttgtagaccttgttgtatggtgccagcaatgtagtgaagacaactgtggtcactttacccacacctttcatttaaactgcagatttaggcagggtgcagtggctcacacctataataccagcactttgggaggctgaggtaggtggatcacctgaggtcaggagtttgagaccagcctggccaacatgttaaaaccctgtctctactaaaaatacaaaaattagccaggtgtggctacttgggattacacacctgtaatcccagctacttgggaggccaaggcaggagaatcggttgaacccgggagatggaggttgcagtgaccaagattgcaccactgcactccagcctgggcgacagaatgagattccatctcaaaaaaaaaaaaaaaaaaaaaaaaaaaaagatttagatcatgttccccttcaacctctggcttttcagactgaaggatccttgaagcctggctttatgtagaagctcccatctcctttaatataacagtacagtggtgcagtaggctgtcttcaaatcagcaatatgttttattgtcttttatcttggttgtaaccaagagcttaaagaccattagcctatacatatgtaatgtgcatttatccccccagtgcattaccttacaattgtccgtattcctctctcaattcatcaaaaaatatttgttaagcacctagtgggtacccagcaccatgctaggtgctgtggggaacacagaagaaatggaagacagagtctctgcccgctgtgctcgtatctagaagtggctgcatcacaaggttgggggatgaccgcagtgtctaccccctaccccgtgagtggcttgggatacctttgctacatgtcagtggcaccccagacattcaccccctcccagacccacccagccttggggatctgcaaagccatggttgggggaaggaaggagggggcgaggagacagatgaaggaacttcattgtctcaggttctgtgtgactgaccccatgaaaggccctggggagggagtcatggggccctgctgaccttttactgtctgtgggaactcctttgtatagaggagagttttgactgacgtcaacgtgggtcttggtatttcctctttccccattttcaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcggtgagagtgggcacctgttttccctcattcatttctcccagggaagggcttttccaggatgaaggaaggatgagaccctgaaatctgggcctcagtgtttcatttccctggttcctgctctccctgttggcacactgattcagctatgggaggatggaagtgagaattctgccttgggtagaaggagttctggtttcctgatttctgggaacacctgctgcccatttagtccactatcacatcattgaagtcaacatgcatctctccctctagcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttatagttcatctctttcctcctcttatttactgaaagaatggtgggagacagaatatgaatgtgtgtatgtgatcattgatttcagaccccttttcctaatctctctgtgcatggctgcccaccccaccccattttggctagtgctgacggtgaacaaagtggttattatcatccctatttatggctggggaaactgaagcctatatacttcctacttcactttctccacacaccagcaaacctcctttcccccagccaacataccacacacacaccacaccacacacacatacatacacacccacacacacatcatatacacacatataccacacacaccacgtatacatataccaaatacacacacaccacatacacaccatatatgcacacacaccccatacatacacacacccatgcacatacatagcggcaggaagagggctcccggggaatttgcctttcgacactgcatttcccagtaagcccgccgtttttcctttctgtttcatatcacagacagaaaagttttccaaagattcttttatttacatttacatacgattctgaaaaagcgtctccaagctaccacttcttgtagttgccattgtctcattccaccaaaaaacatctcagaccgcccgcggccaccccaaatacgcctgtccactgaagcctcactaaaaggaggaagcgctgatgtcagggttacttaaattcccaggctccggatccctagaagaggtatttccctttacgcccgcgaatttgtcatagaaggcagggcactagagccagccccagccaagtccagggggaggggcgaaggtcagtagcggccttcctaaggcttccttcaacccctccttgcctgccagtcaagtaccgtattttcgcagtactggttaaagtttcactttgacccgcctccatcactcacctgattagatgtttatgagtcaaaaggcggggtcatggggtgtcgagattttattggtggatacatacgcctgtcggcagtgtaccgccccctgtcttcaggagcttgctctttaatggctccttacctcgtcc

SEQ ID NO: 13897 - DNA, 15166 bp, Human
acgaatctagtagtcccttagggaagtgtgaataaacccagcacccagctgcccatcctgggaaatgtatggatggtggcaaatatacccactggggtagctggcctaccaggtagctcagatggtgattgagtttgctgagaaaccatctcccatgatgcttggtgtcacagttcaaagttttgggtgtccacatcaccaagaactgcaggtatgagtcttgggagcatattgaagaattaggcaaaaagttgaagaagctctcaagatcatttaaattgtccatggacagtgacaatataatctatcaaatgttccacagctattctgaagtgctttgtgaggaaaatgatccaggaattgatcccggctcatttcagctattcaatatcacataagtaatgagtctcctttcccaggactgtattcaaggatggcacacagtaagtagttagaaatgttggagaccacttaggacagatgaatgctctttatttcacctcttcccttaaacacatatgtgaccagtgttagccttgcccctctccacttagtaggtgtcagctcccccccttttttttttttaagacggagtctcactctgtcacccaggctggagtgcagtagtgcgatcttggcttactgcaacctccacctcccgggttcaagcaattctcctgcctcagcctcctgagtagctgggactacagacgcccaccaccacgcctgggtgtatatatatatatatatatatatatatttttttttttttagtagagacagggtttcaccatattggccaggctggtctcgaactcctgaccttgtgatccgcccgccttggcctcccaaagtgctgggattacaggcgtgagccaccatgctcagccgctaatttaatttttaaaatgaagagaaatgagagtatcacaaacatctcatctttcctaattctgaatttccctggctcctatcatgagcttagagtgggaatgtggcagggacatacaggaaatgccaaagaacaggactgtaggcatagaggttgagtgtgtgacaaggggcacaaggtttgagcagccagtataaatgggcaaatatttgcagagattacatccttcactgatcataggggaaagcaaatatctcctttcctcatgggacacagaactaggcagaacaggatcaggaagcgatcaaacctaccaaggcagtctcacttctcaatgactggactgtgtggtaatttggggtccctatatatgggtggaaataaaacagaagtccctggtgacctgtaaatgggggagaccaagtgggagcaactggggtgcatttcctatttcctaggcctttacctaaaaagaacagaagcttggggccaggcgcggtggctcacatctggaagcctatcactttgggaggcggaggtggaaggatcacttgagcccaaagttcagaactaggctgggccagatggcaaaaccacgtctctacaaaaaatttaaaaattagctgggcatggtgtcacgcacctgtagtcccagctgcttgggaggctgaggcaggaggatccctcgagcccaggaattcaaggcagcagtgatttgtgatcccatcactgcactctagtctgggcaacagagcaagaccctgtctctaaaaagaaagtacaaaagcttggaagcaggtgatgtatgaggtgtccccctaactgagtcttgggctcaccatcgcccttagggaaatggtttgtatgtttcggatttctcccctttctagggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtactaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtactttcaataaatagctattagccaggtgcggtggctcacgcctgtaatcccagcactgtgagaggctgaggcgggatgatcacctgaggtcaggagttcaagatcagcctgggcaacatggcgaaaccccgtctctacaataaatacaaaaaattatcctggcggagttatgcacgcttgtagtcccaactacctgggaggctgaggcgggagaatcacctgagcctgggaggtcgaggctgcagcgagccgagatcgcgccgctgcattccagcctgggtgacagagcgagaccatgtctcaaaaaataaaaataaaaaaaaattgttttcattacctcagccctcctcttcctatcccaaggcgtcgaaattccggtcccaccccttcccatggagcccttggcgtctccaggctcctcaagctagtttcggttccggggctcacgcgcgggttctcgaaaatcagctgtttcagtcttgggctagtccactaattggactcctcccctcgtagaaagtgcctacttgaacttctccaccaatcgctgaagctgcaggtgtggtttcggctcagcttgtcccgccctgcggaggggcggagttgcggcggcgccagtgagctcgcagtctgggaagggcttgactgaatggcagccagtgtcggggtggcggctgggaatgggggccgctccggacttccgctgccaactacaagggggcgggtccgaggggggttagccgaagttgtaggcggggcgcgaggttctagtacccgagctcatactagggacgggaagtcgcgaccagagccattggagggcgcggggactgcaaccctaatcaggtacgggccctgagagggtgtgctggggtaggggtgggggtgagagtgagagttcctccgagggaagggcgactggccccaggggttaccccctggagagggtagcttcggtccccagattgaaataggagctgtcgcctgctcggtcctcgatcttcttctgtccagcctatctccctaaccctaatgcccctctcccaaaactgccctgcagcttccgagacccggaatctggcattgttatgttggttcggtatctgacgtttttccctctgctctgcattattttttatcttcaccaaaaaacgatgttcaaagatagataaatctaaaaacaaagatagataaatctattatccttgttttgttaaaaagtataagctactgaaagatgaaacgattgcctaaggtcacacacaaaattcagttcatttcagaaaagcttcttgagtgcaaaatatgtgcctaagaatgagagataatgagaaaaaattgtttcagcccttaacctcagtgtttgcaatccatttggggagaccaggttttttgttttgttttcatatttgaatctttgctgacttgctcctttaatatcagacacttaaatcctcaagaattgggacctcatcattaatttttttttggagatggaatctcactatgttgctcaagcttggtctcaaactcctgggctcaagccatcctctcgtcttgtgggcctcacaaagtgctgggattacaggcatgagccatcatgcctggccacctgatcatttttttaacttttttttggtatcataaaagcaatacagatacatagttttaaaaatcaagcactactaaaagagttaaaatgaaaatagcccctgcccaatccctcccttcccttgttcctgctggaggtagaaaggcagctgatgttattcatgttagtagaagactctcccaccccaagcatttctctttattttgtaataaaatcatgtgacctttttagaccacaaatatgcatgaattctgttctgttaggctcaggctgcaacaagcataagtttcagtttcctaaatagacaccagctggcagtgagcagggaacagtggggagaaagatgcatgggacagcctgcttggtgacaggcaaaaaccaatttgttgttcttttgagacagagtcttgctttgtcacccaggctggagtgtagtgatgtgatctctgcttactgcaacccctgcctcctgggtacaagccattctcctgcctcagcctcttgagtagctgggattacaggcaacaattttaagtgaagtttcaggatctcacaaagttgataacctataatcatattcaagattcacaggtcataaacgtgtcatattcttgggattgagccacccattgcacagcatttagatgtcttctagaatggagctcctccttcctatatggagggcagtttatatggtgtacttacctgaccaccaaaaagatttggctcctaaaaaagcttcaggtggccgggcatggtggttcacccctgtaatcccagcactttgggaggccaaggtgggcagatcacctgaggtcagaagttccagaccagcctggacaatatggtgaaaccccatctctactaaaaatacaaaaattagctgggcatggtagtgggcgcctgtaatcccagctagtcgggaggctgaggcaggagaatcccttcaactcgggaggcagagtttgcagtgagccgagatcgtgtcactgcactccagcctgggtgacagagcaagactccatctcaaaaaaagaaaaaaaaaaaaagaaaaaaaaaagcttcagagccagcagggatcatgctgtaataaatacttaacatcaacactgatctttaaatgctttagcacaatcaaatataaataacaaacacacacataaatgcaaaataaatgaattagggagatagatgaaataagattgtggaaatagtaatgtttgttaaagctggatggtgatccttgtactattcactctactctagtgtgtatttgaaaattaccattaggctggttatggtggctcatgcctgttaatcccggcattttggaaggctgaggcaggcggattacttgagctcaggagtttgagatctgcctgggcaacatggcaaaatcccatctctacaaaaaattagctggcatgatggcacactcctgtagtcccagctccttgaggggctgaggcagagaatggcttgaacctgagaggtcaaagctgcagtgagccaagatcatgccactgcactccagcctgggtgaccaagtgagaccctgtctcaaaaaaaaaaaaaaaaaaagaaagaaaattcccattaaagcacaaaggcccacttattgaagctattaaaatacaggttggggccggctgggcacagcggctcacgcctgtaatcccagcactttggaaggccgaggtaggcagatcacgagttcaggagatcgagaccatcctggctaacacggtgaaaccccatctctactaaaaatacaaaaaaaaaaatcagccgggcatggtggcgggagcctatagtcccagctactcgggaggctgaggcaggagaatggcatgagcccgggaggcggagcttgcagtgagccaaaatcacaccactgcactccagcctgggcaacagatcgagactccatctgaagaaaaaaaaaatacaggttgggaccacagtggctcatgcctgtaatcctagtactttgggagtccgaagtaggtggatcacctgaggtcaggagtttgagaccagcctggccaacatggcaaaaccccatctctactaaaaaatatacaaaaattagctgggcgtggtggtgggtgcctgtaatcccagctactcaggaggctgaggcagaagaatcacttgaaccagggggatggtggttgcaatgagccaagatcatgccacttcactccggcccaggcaaaagagtgagagtccatcttaaaaaaaaaaaaaaaaaaaaaaaaaaaatacagattaggcattcctaatctgaaaaatttggctccaaaatgctccagtgagcatttcctttgagtgtcatgtgggtgctcaaaaagttagattttggaccatttcagatttcagagttttggattagggatgctcgactggtaagtaatgcagatattccaaaatctggacaaatctgaaatccaaaatgcttggaatagcagatactcaactggtagcactccctggaagaatatgcaccaaactgatagcagtggttacttctggagaggaggggaaagaaccaagattagcagtaggatcaacatatattttaatgttttctgtatttttattacttgtataatttaaacattttaaattagtaataatgaacaatcatgaaactatggatgatttagtccagcaaaatatccaattgggaaccctcatccttctgacgcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggtgaggccttcaggaagttgggggaatgaaaaaggtggttccttacttctgggcccccgggatcctggaatcattaatggcaggaaggggttggaaagcctcaggactacagtaacactgcagagacactaatacttcttattcctggtgcccaggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggtacttggaacggttgggagtgatggggtagcactgggagctgagcatagaggagtaaggtttggagaatagaatagtacctggaggtggaaagggagacgggaacaaatgtggggaaaggaggacagagtctggacttggggaatcactagcagagagaagggttgcatatacgtgacactgttgggaggatgctatggtgaaaagacaaagggctaagaaccccgaaggaggaggaaatactgtggacattggtggggagggtctagggcaataggtcattgagagtggttgaattggatcaatcctttctgtttacctattctagcccttttcccaggatcctacccagttggctgagatgatctttaacctccttctggaagaaaaaagaattttgatccaggctcagagggcccaattggtgaggacaattcagtggtaatgttggaaactcctgaagtagagaggaaccatggaaaggactcagggagttgtctcagaacaggatccccccgacatcctgtggtataatttcaggcctgaacttaaggcatgaaaggccagagttaaaacgtgctcagagcctcttttttcaggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggtgggagacagaggacagaacatgtgggcaacaaggacctggaaaaatgagggatgtggggaccctggtcctctagcgctggcttctttgtttcttcatccccagttgggtggtggagggtgaaagggagagatgctcaacactcacattatctctttcccaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggtgagaggtaccaccccaaccctcgtcctcgccatgcgctgtgatttgtaagttgcagtgccctgcatatagcaagagatactgttctctatttgtctctgctccccagaatgagccctgctccctgctgactgcagctctattctgctcctcatcctcaccacgcagggagcccagagcccagtctccttcagggaaaggaatgaattaacccacaatctggtttttccttcttttttaatcacccagaaatatatatatatgtatttttttttttactgcaacgaatacaatgacaagaaaggaaggaaggaaggaggaagagaaaattacctattacctagcttattaaacaaaaatggaatcatattgtccatactattttgaaatccatggggttttttttaagcttaacagtattttatatatatatatatatatatatatatatatatatatatatatatatatatatttttttttttttttttttgagacggagtctctctctgttccctggctggcggagcggagtcggcacgatctcagctcactgcaacttccaactcccacggttcaagccaattctcctgtctcagcctcccgagcctgggattaccaggcacacaccagcctggctagtttttttgattttttagtagagacgatgtttctccatgttggccaggctggtctcaaactcctgacttcaggtgatccacccaacttgggctcccaaagtgctgggattacaggcgtgagccaccatgcccggccaacagtatattatatttatccatgttatttcttatgtccacacaacagtcccctatatggtggtaacataatttaattaatgaactcctattttcagctatttaggttattttcaatttcttgttacctttttccaggaaacgctatattttatggtaattatattgtgttgtagaaaaatcactagtgtgtcctccaacatacttgaaaaatacctactgttttcaatattttctcatttaaaaatttattataatttagtcttttagaaatataccaggccaggcatggcgtctcatgcctgttatcctagtactttggaaggctgaggcaggaggatcacttcagtcttggggtttgagaccagcccgggaaacataacaagaccccatctctacaaaaaaaaaaaatttgttttttaattaggcatgtccggacacagtggctcacacatgtggccagcactgtgggaggccaaggtgggtggatcacttgaggtcaggagttcaagaccagcctggccaatgtggtgaaaccccatctctactaaaaatacaaaaatttgccaggtgtggtggcgcatgcctgtattcccagctactcaggaggctaaggcaggaaaatcacttgaactcgggaggcagaggttgcagtgagctgtgatcatgccactgtactccagcctgggtgacagagcgagactccgtctcaaaaaaaaaaaaaaaagattaggcatggtggcacacgcctgtagtccctagctactcaggaggctgaggtgggaggattgcttgagcccaggtgttggaggctgcagtgagccatgattataccactgtagtccagcctggacaacagaacgagaccctgtctctaaaagtatatatgtacacataccataatacccagctactgaggaggctgaggcagaaagagtgcttgagtccaggagtttgatgtcagcctgagcaatatagcaagaccctcacctcttaaaaaaaaaaaaagtagattaaaaaaataccacaattgctcaggtagattgaaaaacaggcatatagtacttatggtacaggaccagcatgcatgcatgcatgcattgattgattgattgattgattgattgagacagggtctctctctgtctcccaggctggagtgcctggccttaagtgatctgcccacctttgcttcccaaagtgctgagattacaggtgtgagccaccatgtcagctggcgaggctttttaaaagatagttccaagtgttacagctcttttaggatttgtctagcaggctttcaggtttttgccagaaaccacccccacccccacccccaccaaaaaaaaaaaaaaaaaaaaaagatagttacaaatgtttcccagaatagttgtcccaatcgaatctattttctcatgtgtagtgtatggttgttttcctgtcaccacattgctgattattattatttttaattatagagacagtaaagtacagtagttaaaaatgtgagttggggctgggtgcagtggctcacacctgtaatcccagcactttgggaggccaaggtgggcggatcacctgaggtcaggagttcaagaccagcttggccaacatggcaaaaccccgtctctactaaaaatatatatatataagttagccgggcgtggtggcacatacctgtaatcccagctactcgggaggccaaggcaggagaatctcttgaatccaggaggtggaggttgcagtgagccaagatcacaccattgcactccagcctggatgacaagagagtgagactgtctaaaaaaaaaaaacaaagtgtgagttgtacaatgagactgcctgggatcacatacaagcttcatcccttactagttgtatgaccttaagcaagtcacttaacctttctgtgcctcagttttatcatctgtaatgtggggaaaataatagtacctgcctcagagggttgttttgaggattaaatgcattaatatgtggaaagggcttaatataagttgtacatagcatatgaaaactgttatgttaaatctattagcagttttatatgtgaaaatagctttgattttcatttcttggattatgaatcatgttgaataatcctttatatgcttcctggattctttttttttcttccccccagtcagtttctgactcttcacatatttacagagagatcttggaacctggatgggggaatccaggaaactcatggattccttcttcctgaattttatcacccaggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacaggtctagaggccaggcaggaaccctgggggaaagaaggaacaagggaagccattcttacagatactgagctatatattctctccacacctctctctcctcagagcctttgtggtagaaacccagccctgcatgccccaaactccccatcgacccctcatcctcaagactggcagcaagttcaccgtccgaacaaggttggcattccagaactcattcccacttcctttttccaaccctgccactgtgtattttctggctttacagctcttcccactcttggctttttcttctctttccctgcaatctccctacctcttataatccctcttctctttttcaaacatctagtctatccggaaggttgaggttgaccactttcccctatcccccttccttcccccaggctgctggtgagactccaggaaggcaatgagtcactgactgtggaagtctccattgacaggtaaattggagcaggtgaagggtggccaggacacgggctgctggggtggaggagatactcactcttcacaacagggccctagggctatctccttcctccttccaatcctacctcacagaaattataattcatttcttttgttgaacacttactttgtgacatgcagcatgtcagctactcatttaattgtcacaccaaccccatgaataaactattaccagtgcactgtacaaacaaagatacaggcttagagagactgattacatctcttctcaaggccacatagctagtgagctcaagtcgggtttgaaccgaggtctgtctgatcccaaagacgaaactcctaacttccatactcttttgcccaatgatttttttaaatttatttcttttcaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctggtaagaatagtttgtgacctatgcttttattactatttttatttttttgagacggagtctcactctgtcccccaggctggagtgcagtggtgccatcttggctcacagcaacctccgcctcccgggttcaagcaattcttctgtctcagcctcctgagtagctgagactataggcacacaccaccatgcccggctaatttttgtatttttagtagagatagggtttcaccatattggtcgggctggtctcgaactcctgacctcaggtgatccacccgcctcagcctcccaaagtgctgggatcacaggcatgagccaccatagctggcctgcttttagtccaaaggaacaggggttgggggaagttcccagggcttgagaggtcttgaagccaaacaggggttccagggacactagggtgcccactctggcattttctctccttcccttcaattcacagactctggtggagcaacgttcaggtggttcaggaaagggcagcaataaggtgagatctggacagaggactcgaggcagggggagcttgccaaagagccttctgatgactatgtctttggctgtcccaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcatcatc

SEQ ID NO: 13898 - DNA, 7424 bp, Human
aaaaaagtaatatctcagtttatactcccaccagcagttgtaactggttctttttttttttttttgagacggagtttcgctcttgttgcccaggctagagtacaatggcgtgatctcggctcaccacaacctctgcctcccgggttccaacgattctcctgcctcaacctcccgagtagctgggattacaggtacccaccaccatggccagctaatttttcgtatttttagtagagacggggtttcattatgttggtcaggctggtctcgaactcctgacctcaggtgatccacccgcgttggcctcccaaagtgctgagattacaggcgtgagccaccgcacccagctggttctgtcactttttatcctcacctaattggaccagagtatctgtggccaaaatctctgctcttaacaccatgatgtgctaccctctctctttatcctgtccaggggaacttttctggaggcagcgtgaaccctgcatgcttcctgaggccagcagtggtgactgggatctgggagcattactgggtgagatgcactgagggttacagggccttaagtcaggagactgatgaggcttctagaatataggagattccaatgacttctagtggactgtttctcttctatgtaattgagagctccaaaccctttgggtgctctctgacctgttctcagcaactcttcctgccagtggataggttagatggaccctctaccttcactataactctctttctgtccatccccaagctgggtattatgaggagaaagcacagcccctgatctgtgttccttctctctccccacaggtgtactgggtaggacccatgctgggcaccattcttgcaggcctcacctcgaatttctgctctctggtgcttcatgagaaaagtttgtggccggtatgacttgccactatgtggagatggtagaacctatcagtatgtcccattctaccttctccatcaccacacaaccccacgcctaggtcccaagtccctcaccaagcccgagcacaactgaacctctttccccaaactttccttccccatattatccttttccctctccttgatcggctgtttccccagatctgatcccagcacacccatacctttccctggggatcaaggcttagggtgtgctgatcatggctgtattaaaggacattagaccttcccattgcttcatagccatgactgtttccttcctttcagtacttcttgctatgaccatgtgagttaggaaagatgaaatacaagctgattctaaggtttaactacgagtccctttcttattcctatccctccaaccccactcccagcccatgcagggatgatagtgtcttctctctgtcggtccctgtagtttaaaaagccaggcctagggtttgaaaagggaggtgctgtcatggactgggggtagggaacccgggctcagagaaagccagacgcagcagaactattttgtcccagagctgcagggtccacagattccagcccaaactagccaatgggagaaaggcttctaatccctgggaactaaagaattctctttagttatccaacttccctgctgaaccccactccttaccactccccccaacccttacccctggcagactcagaggaggctgaggcccccaggagctcagccccaaatgccatgaagtgagctcagcttgatggaccttccaaagagagctgaagagtattctaatgttgatgtcaatcaggacaatgaaccccaattttgacacacacagaagggcagactcttccagtcctgctgttcttcacccccacttctcgtagtctctcttgctgtgaccccaatcccaccctcactgccatggctctctcggctcatctcccagttgagaaaggcgggaaaatccagcatttttaccatgtaggggaggggacttagccctccacagctgtgaaggggttaagaggctgggcctgctacctcagcctgcccctcccagggattaagagtcctctataaaggggactgtccacccagacaaggccatgggggtagcagggacccaggcactgtgaccatcccccctgccatgtgggaactgcgatcagcctccttttggagggccatattcgctgagttctttgccaccctcttctatgtcttctttgggctggggtcctcactgcgctgggctcctggacccctgcatgttctgcaggtggctatggcatttggcttggccctggctacactggtgcagtctgtgggccacatcagtggagcccacgtcaatcctgcagtcacttttgctttccttgtgggctcccagatgtccctgctccgtgccttctgctatatggcagcccagctcctgggagctgtggctggggccgctgtgctgtatagcgttaccccacctgctgtccgaggaaacctagcactcaacacggtaatggttggctgagaggggatggggaacctggtgtcctgtctctctattgccctgactccctgactggtgcaggtgaatcagctcccctggggtctgggacaatatgtgcatgtgtgagcatgtgtgtgttgaagtggtgaggattgacaggtggtttagagctttaaggaaggcatagggccctggactgagaattaagaaacctgagtttgagtttcagctttccttccaactccttgcaggttcttaaggaaacttattttacctttcaaggcctcagtttcctcatacatgtaagtggctgcaatcatttccatcatgaaggagcactgttaggagatggtaagatgcaaatacaatgattatgaagggggttgtattatccttcctctccacggacctgatgccgtaacgagatccttgccggggaagtcttgaggaggtaacactgtggcagccctcctgagctgtctctcttcttcttcctttgcacagttgcaccctgcggtgagcgtgggccaggcaaccacagtggagatcttcctgacgctccagttcgtgctctgcatctttgccacatacgacgagaggcggaatggccaactgggctccgtggccctggccgttggcttctcccttgccctggggcacctctttggggtaagcaggaaggagagcaacttctcattcaaggattccggggcccctaaacctttcccaacttttaagggttcttcctgcctacttcactgtcaaacatgaacattgtccattgcactctctactggcacaaaggaatcaactctgccctatccctctcttgtgactgctatatctagtccttcttgaccccaaggtagaaatgaacgtatcatggctagacatgggctttgcctatggatccatagtctgttcccagacagggcatcagttgccctcaccccattgcaggaacccctggagagtcatgcaggctgtccctctccacttgctgctggctggagaaaagatggcagctctcaggggcaatgtgggttgtggggagagaagctggggtgcagtaggggggtgtctcagttacaactgtctcttttgcagatgtattatactggtgcaggcatgaatcctgcccgctcctttgctcctgccattctcactgggaacttcactaaccactgggtgagtgaagggagaggggcaagatcctgaagcccttctggatggttgtggactgcaggttccaggctggattcctgctttccttctgcgtgtgttggctgctgtaccagcactcagctaagggggctgtcagagagtttggcatgcctgtgtgagcaggattcatgattttgctagaaggagaggctcttgctcatatttttccttctctggttagtcagggagtatgcactgagtattcactggttgctgaactagcgggtatgaagagagacaactaaatatgagcagaataaattctgctctcagagatcaagatgtgttgtgagcacagatgggcctcagccccattccagttctaatacgttatcggctttgtgtgtgaccatgggcaaataatcactctgtgcttcagtttgttttactataaaatgggacattacgagaaatgtgtgaaagttatatgtgagaaacatttagcacagaatctgatataaagtaagcactcaataaatattggttatgttgatgttgtgcaagccaaacatatggaaataatttaaaaatttttcaaagctgtacacccattttcataacagcattattcacaatagccaagaggtaaaagcaacccaagtgttcctcagtggatgaatggataaacaaaatgtggtatatacataaatggaatattacctgtaaaaaggaaggaaattgtgacacataccacaacatggatgaatcttgaggacattatgctaagtgaataagccagtcacaaaaagacaaatactgtatgattacatttatatggggtatttagagtactcaaattcacagacgcaaagtagaaggatagttaccaggggctgatgggggtggggtggaataggcagttgtttaatgggtatagagttacagctttgcaagatgaaaaagttctagacataggttgcacaacaatgtgaatatacttaacactactaaactgtacacttaaaaacatatatatatttttttgagatggagtctccctctgtcacccaggctggagtgcagtggagcttgatctcaggatctcagctcactgcaacctccgcctcctgggttcaagcaattctcctgcctcagcctcctgagtagctgggatttcaggcgcctgccaccacgcccagctactttttgtatttttagtagagatggggtttctccctgttggtcaggctgttctcaaatggctgaccttgtgatccgcccgtcttgtgatccgcccgtctcagcctcccaaagtgctgggattacaggcataagccactgcgcctgtccaaaaatatttaatatggtaaattttatatgtgttttaccacaatgtataaaatttttttgaaagcaacatacaaactagtgcaaattgataacaaatagaatatacacatgctaaggtgtgggataaaggagtaatttgatgaatcagaaaataaatggtgagtttattgtggatatcaagtgtacaatatcttgttttccactaaggtggctggaaaaagagcagcgttgctgctctgtcccctccccaagcctgagtattccttttctctttctacaggtgtactgggtaggcccaatcattggagggggtctgggcagcctcctgtacgactttcttctcttcccccggctcaagagtatttctgagagactgtctgtcctcaagggtgccaaacccgatgtctccaatggacaaccagaggtcacaggggaacctgttgaactgaacacccaggccctgtagaagctccagctgaatagagggagtagaaagcttctgagtttacgtggaggggtttagccagcccctagatgaagaaagagactgtggggaggggcatgtacttctttattttttaacttatgtatgtggttgttttttttttttttttccttttgctgtgtgaaatctttcaagttgcattcatgagctggttggtgcaaacttcccttcctccccatcccaccacccttcgccgtgtgtgctgattgtgcatatgaatgtgagtgtggctgtgtctgagttttggggcatgagagctaaggaagcaaaaagaggtgccatcctatacctcccttcctcgacccagtatggtgagtactgggtaaccgacaccttaagtttctggcctttaccctgctgccagtcaagtgtgtggctcttgatttctgagggaacagagaagcagggagttactcctcacacgaggcagatggagagaagtggaggagacaaggcttccaagggctaggagaagggactcaagggaggtgggtggtgaaaacggagtattagccccagatcaggatgtaggtgtaccgaagaattggggggaagttaatgggaatatatagcctacttatcttagggatgcttgccccagggacttgggtggggaagtagctctgagaaaagtgaacactaggatttagctgttctgtaaagccacgtaaacctgtctacatccgctggctggttgtgttcattctgacataatggatctcttcagaggtcctgggccaaagagcttccaacctaaatagagcttgggcaagcctagaatctagaaaaattaagcagcttaactggtcagcctgacatccactgttgtggctgcctggcagatggtatttaagccccacaattgttccctaaggccaacacaggaaatctgattcctggagcaaataaatgaacgggtggtagtagggggcatgaggggagaggctttgactctgttctaatttatttagagcaaatcaaaacactcctcaaatggcatctttctgcttttatcactagttccgtgttttttttcttgttttgtgtctgtgtattttcatttctctgtcatccgtcctttcatcttgaagcaaatctcttctaactccctcataccccagaaattgattccttctattcaaatgcttaataattcaggagattattatttgtttgagccctatcttcttttttttttttgagagggggtcttactatgttgaccaggttggagtgcaatggatattcacaggcacgatcatcgcacactacagtctagaaatcctgggctcaagcgatcttcctgcttcagcctccccagtagctgggattacagggggccagagcacagccctattttcttttccttttggcaagatcatctcagcagaggccagaagagaccctcaactgttcaatgaatatttacggttgctttcttccttttatgagcctcttgcatactttgaaagctttaaatttatacctataatacaacggacatcccctatcccagaagaccattcctccctgtacttcagctctttacttcctcccaaataaaacctaacttttctaactaactatttaagacttggaatagtccgcttgactagaagaaggggaagaatgtttgtaaattcacctctaatcggactttgattctactataattcagcagaaaattcatagcgctgtgatttttagatcgacctcacataaaacagtccctgcactcgcttcccttttccttccttcttcaccaatctccgccccagttcgctcggagtcacgtggaccagcccggctcgccccgcctcgctcttcgcgcaggcggggaccggtccagctgagcctggtggcggaaaggctgcggccccgcgccagagggccggtggctcctccgggcttctgaggacccgcagggagcgggtgagtgagtgtgtggcgagagggcgcta

SEQ ID NO: 13899 - DNA, 15586 bp, Human
gggcgttcctccttatacttgcggaggatgggaaagggtgtttggtgttgctaagcaaagacggcgacttggacagtgggagcctatggtgacatcttgattaggccttggggatagaggtagagctgcctggggtgaaatgccgagacaggcctgggtgggaaggggtagtggagaaaatcaaggtaaggaagaggagccttggcaagcagatgcctcagcctggaacagagatctgaggggcctcagcttcctccccacaaaagagctgaggatgggcgtctttctttgctcttgtacccactattccctgctagcaggctaggatcctgccaccctggagcccgtggtcaagaaagggaaagcagttatgatgaggtgccttgcagagaagtgtggaggttctccatgttctccaagctcatggctattccctagatgtagccactatttaaaggtctcaaggaaaggcagcaggagtggaggctagcctcctttaacatatgaaacacctttagcttgtggcctgtttcccagttcctttctctccctcctgcttttcagcctttacctacctcccagttcctctaatgtgaacctcatgatttggctttgccctctgggggttcagccaatctatgatgactttgagcaagaaaatttctcagagacctaagagcagccttaattcttggctttgacagtctgggatttcttgggagtcccagacttttgagattccctcactggggtttctggggctgagagaggaactgttaaacttcctaaatcttactctagtcccctcacccctgagctagaattcaaaatccttggtgcccaagaaagcctttctgactcctgaaacagattcattatacatatattttagccccatgaaagtagacttgatcctgtttttccccttaccttaatcttagggagggcaacagcatcaaagagcctcttgaattactggtgtgactcctgcttctcttcctgtttctgggccttaattgggaaagccacaaaggatgcttttccctcagtgtttcttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccatgcccggataattttttgtatttttagtagagacggggtttcaccgtgttagccaggatggtctcgatctcctgacctcgtgatccgcccgcctcggcctcccaaagtgctgggattacaggcgtgagccaccgcgcccggccgccctcagtgtttctaagtgtacttttaaatatattttcctccacatagcaagtcgctggcctcaagaggcagcctcagccgaataagctgggaccagtgatggatttccaacaagttcactcatccttttagggtcaaggcctcaaagccaagtgccctgttcttccctgatagtaacatcaagtgatttagggcaattcagcactaataaagggaataagaagataacattttcagcccttttaaccctagtaaaccctacacttagttgaaaggatatatttaaaactggctctgagtctacaagtctcaacccacaatcctgagatgctcacttcatgatatgtgtgtggttctgatttcgggcaacatttttaggtaaccatggctcacctaaaaagccccagctgggaaaactcagattcaagccataaggctttttctatagatagtgaacatttttcctcaggctttgacgggatagaatggggaaaatgggactttaggagaggatatgaacgggaaatggtcccaaagtcctgagtggttgttttcttcccactgaccaaagctggagagggatccctcaggagggtgtgttccggatttcttgcctcaggcccaagactccaaccattttataatggaatctttattttgtgaaagtaagtatgtgcatagctgggcaattgggtaaagtactaataggtggacttcagggatgaattttaggcttcctctctctttcttgcactctcccttgctttctctttctctcttccatatttaggcctgtgtgcacacatccatgcatgttcatgttagcagataatgtagaaggctaccagtatgtttatcccaataggtatgttctctttatatgtatctacatatgtgttgtgtctctgtgtgtgtttatctacatgtatttttatttcacctatatatttgtgtagaagattgtggggaggagggatttttttaaaaaagacattcatatcttcctttaggtatgttatctgattttgaaaaacattatgaaagcctcaaaaagcatttttacaaagcaatttatcagaaaattaaaacaaatatactgagaataagttgatcacttaactgtcaatgaatatcaaatagtaaacacgtgattggaatcagatcagtaggagactttctagagtaatcaaatttttgctgaatttagaaagtctaagaggcccaattcttccctactaagattgtgaccaccaattggctgtgtaggtgctggttaaggacatggacgcttactgtctatgatcccagttccacactagcagctatgtaaccttagacaactaacataacctcttttgtacctcagttgcctcatctgaaaaaatcatgatattagcacctacttcatatagttgttgtgaggattaaatgaaattattcatttcaagtgcacagaataaagcctggcacatagtaagtactcaattaatattattagctgctatgatgattactaatattatcattagattcaaggacaattccagttacctttcctgcagatcctgaaccggctgggggctccagagaggaacagtagggaagaatgtctgtcctgaacatctgtcccttctgcagcccccattttcctctccgccctggcgcacccagcctcagccctgcttcctgtggacgtcaggcagtgatgctcttgccctcaggcctagataaaggtagggtaggcaaggcccagccactgagctcacagaaggcagcaccaggcatccagactggcgggggcacaaggtatggtgcccagcatacaacactgctttgtacatggctatgaaggaaatgtttgtgaaatttaactgaatttttttaaaagattaggcaatggacagtagatatctccagctccagctttacctgccctcttgttctctcctccaaggtagcggggactcatctctggagaaggagttcctcggggccccagtggggccctcggtgagcacccccaacagccagcactcttctcctagccgctcactcagtggtaagtgtaacctcctaccacctcctggcagtaggcaccccctgttgcatttggccttcaattcaccttccactggcaaccatttccccatcgtcacctcctgctggtctcctgcttagtctctaagagcaatgaggagcccagtgtctagggtttttctggcttctgaaaggagagtgaatagtcagtcactggcagactagggtggaattaaaagaggtatgggtgggattaaggtaaaagtttcaaagagaaattatggaattagagaagcaggtagatagaaatggtcatcagatggagttagataggaaatagagagtagaaggacctccccatctccccacagctcattctcctacccagacagggtccccatgactgcctctccccagctggccctagatctgtgacattctctaaatggttggagtagccaggaatgtaggtcggagctagagccaaagccttctcctcaatggttcctccttcctttacccctcctgccctgcctcagagttttatggaggtggagggggtagagggattcaatctaatgaggtgggagggaactgtaagcatgtctgtcttccaggtttgctctctttggcctgttgtcccccttcagtcttcctagatctgttttcccgccactgttaacttgctggcttcctgcccagggccaagccagacatctttcttcatgacaagagagtagagaaaaaagctccccttagtcgcctcctctcctcagcgacagaagacatcctatgtacccccaacttttttctttttgagatggagtcttgctctgtcgcccaggctggactgcagtggcgtgatctcagctcactgcaacctccgcctcccaagttcaagcgattctcctgcctcagcctccgaagtagctgggattacaggcgtacaccaccatgcccagctaatttttgtatttttagtaaagacagggtttcaccatgttggccaggctggtctcaaactcctgacctcaaaagaatccacccgccttggcctcccaaattgctgggattacaggcgtgagccaccacacccggcccaacttttttctcttgaagcctatttgcctggtgggtgggagaaaaggttgtctcaggttccagtaggattctgatatcagcagcagggatactagggtgttagttccatttaaggcttgaatgtctcagggcctaaagacaccctcttaaactttaagagtgccattctgggccaggcgcagtggctcacacctgtaatcccagcactttgggaggccaaggcaggcagatcacctgaggttggaagttcgagaccatcctgaccaacatggagaaaccctgtctgttctaaaaataccaaattagctgggtgtgatggtacatgcctgtaatcccagctactcaggaggctgaggcaggagaatcacttgaatctgggaggtggaggttgcgtcgagccaaattcgtgccactgcactccagcctgggcaacaagagcgaaattccatctcaaaaaaaaaaaaaaaaaaagagtgccattctggcctgggagcagcttccccctttgcctctctctattctaaacaccatcccacccctcagccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtaagtaagccagaggggctctgggaggagctcccagggtggggttgagaggcaggggcagtgctgggacaacagcaggtatggggctggaggaggtcatgcagggagtgggtagcctcagaaagggaagggtctcacccagcacattttccagctgacaaaacgaggcagggtgggggtgggtacagaatttgaattcccctcaatacctttagtttcctggcactctcctcaaccgctgttataaagaaaaggtgatatttttctcagtatatgagggaggggaaagtgtagactcaagaatgagccaatggtccaataggggtaagactcctgggtattctttgggccctcccatctaataattaaaaaacaacaacaacaacaacaacaacaaaacagaaaacaaaagccttctcttctcagcttccttgggccttgggctcctagggcagagtgggccctgtggggctcagtttttggtaacagtcttttggcctcgtgttccaggcccctctccctgccacacacctctaatccacaccttccccagggtaagaccccagggatccccaagggatcttcataaatcagggtttgtgtgcattgcacttctgcccgtcagcaatgtgttcagagcaccttcccttgggcaaggtagggcagagggtgggtgataggttcaaccttcaaagttcctcacatgcagtcctctgggatttgttctttcacttgcaggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcaggtcagtgtctgtccagtgggaggagggaatgaggctccaacacacccagtatgtagagctcagtgacttctcttgtatttggggagttccagtgtctgtcattgaggaggggggagcatttacagagcagatagggccccctgcctctctcacccatcctctgggcagcaaggcttcatgggaaatttgggagacaccttgatggggtattttacatccaccatatggatgtaaaatccatctacttggagcaaaaggaataggagcaatgttcttggctgttaacggtcacccttggcctggcgcggtggctcacgcctgtaatcccagcactttgggaggccaagatgggcggatcacgaggtcaggagatcgagaccatcctggccaaaatggtgaaaccctgtctctactaaaaatacaaaaaaaaaaaaaattagccgggcatggtggcaggcacctgtagtcccagctacttgggaggctgaggctggagaatggcgtgaacccgggaggcggagcttgcagtgagctgagatcgcgccattgcactctagcctgggcgactgagcaacactcagtctcaaaaaaaaaaaaaaaaaaaaaaaaagtcacccttccctgacttttgtttgttttttgttttttcaagacggtgtctcacactgttgcccaggctggagtgtagtggtgcaattttggctccctgcagtcttgatctcctgagctcaagccatcctcccacctcagcttcctgagtagctggaaggatactgccacacccagctaatttttctatttttttgtagagacaggatctccctatgctgcccaggcttgtcttgaactcttgatctcaagcaatcggcccacctcagcctcctgaagtactgggattacaggcgtggtgtcagccactgtgcctgggctttcctgacttttatattttagattgttgatgccacaatccatgccctattacccccaacatctaagcccctgggaaatccctcctctcactcccatctgcctcaggccccacacctgtcatcatcttcaccctccttcctcccacaccaccagaggtcttgagcaaccagtctgtcctctcctttacttccttctggctcctggaaatatccatagccctctcaaattgcaaaaaagggagcctaggacttccaaataggaaaagagtatcctatttctgttccctatcccaagaggttgtcaccttcccagaggcaagagaaagtccagagggtacctagagatcaatgtttggaacagtgctgggaaactggattaacaaggttttctagcccagtcaagactgtttgaatcagtatctgtctgaatcagctggacagatagcactttttaggcattttactaagctttaggcttttggcttggacttgggaagaggccaggagctgagctggcaggaaggagggagctcaagattgggaaaaggcaggaagaaaggaagggggaaagaattagtagggtctgtccttggaaactttcctggctatttttctcttcttaaactctcctgagccaggatttaaagggacagagcaatcatttcatcaccctctactttctccatccacttaccttgttccaggttctcccaccttgtaattgggacctctttatctctatgtatgtggagaaacagggagaaagatcatcgttgatacatgctttatatctacagagcatttcacttgtgtttctccatgtgatcctcataacaattccaaggtagatgtgattatccccattttgttgacaaggaaaatgaagctgttggggggaaaaatgagttgcgggtcacatagctattcttcagcctagctggaaccccatcaaggtccagtgccagaaatacatactccttttcctcagaaaaggggctgctccccctgctggtttggaacaaggatggcttggcccctagaattcttaccaactacacagtgaggtgaactgggtagattttggatgttgatctgtagattattaacaacagaagcagacacagatatactgtcaggtcccatctctgtgaagtgctttctgttgcaacccctattataagaaaaaagagactggatgcatgttctcactcatgtgggagctaaaaaagttgatctcatagaagcacggagtaggttgggtgcagtggctcacgtctatcatcccagcagtttgggaagccaaggcgggtggatcgcttgagcccaggagtttgagaccagccagagcaacatagtgagacttcgtctctactacaaaaaaaaaaacaaaaacaaaaacaaaaactaggtgtggtggcacacacctgtagtcccagctactcaggaggctgagacagggaggatcacttgaacctgggaggtcaagacttcagtgtcctgtgatcatgtcattgcactccagtctgggtgacagagtgagaccccatcttggggaaaaaaaaaaaaaagccaggcacggtggctcacgcctgtaatcccagcactttgggaggccaaggcgggcagatcacctgaggtcaggagttcaagaccagcctgaccaacatggagaaaccctgtttctactaaaaatacaaaattagccaggcgtggtggcgcatgcctgtaatccctgctactcgggaggctgagacaggagaattccttgagcccaggaggcagaggttgcagtaagccaagatcgcgccattgcactccagcctgggcaacaagggtgaaactccgtctcaaaaaaaaaaaaaaagtagagagtagaacagtggttaccagaggctgactgagaagggttgggagtaggtggatagcgagaggctggttaatgggtacaagattacagttagatgggaggcataagttgtagtgttccacagcatagtagaatgactgtagttaacaataatttattgtatatttcaaaatcgctagaagagattattttgaatgttcccaatacaaagaaatgataaatgtttgctgggcatggtggctcacgcctgtcatcctagcctttgggaggctgaggcagacagatcatgaggtcaggagattgagaccatcctggctaacacggtgaaacccgtctctactaaaaatacaaaaaattagctgggcatggtggtgggcgcctgtagtcccagctactgggaggctgaggcaggagaatcgcttgaacccaggaggtagaggttgcagtgagccgagatcgtgccactgcactccagcctaggcaacagagtaagactctgtctccaaaaaaaagaagaaaaaaagataaatgtttgaggtgacagatatgccagttaccccaacttgatcattacatgtcgtatacatgtatgaaaatatcatatgtatctcataaacatgtataattattatgtatcaattatcaattaaaatttgaaaaaaaagaaagcggttggaggatcattcctctcccagatgttaaactgtttccccaagggtctttgggtggatagggaccatggtgttcatttcatccctaaaatacaagagtttacagagcctgagtaaaatccagtagattgatttagtcaaggcccagctttggcatggcaaggttaggggtgaatagtaattaccagcttcctagagataccttctcctgtctccctgctcaatagcagcaagatacatcaaatatacaatacgttgtttctctccacttttttctctcctctcacaaatatctcttaagagttatctttaaatgaagtaccactctgttttccaattttctttcttcggtagaaacaagacctttataacctgttccttattacaagcacataaacaaacaaacccaaatttggtgttctcttttttttactcttctttattttcttctctgttcttttattctttttctcttttcagaattactctatcagtgatgggctttctagacctctcttggtatctcagcgtagagagacagagagacaaaataatcagtaaaccaggctagggctggaggtcaaaatacaagtaaaggtcaatgaaaactgccccctccccacattggcagatctaagggctctcatttctgtcatgccagcccaccagtttcccccaaaccaaagcagatagttcataaaaagcaaaaaatccccttgtctgataaacagcacttacatccgcctgccaaatggaaaggttaaaccacagtctgggccccagactctgagatcctgcagtggggcctgcctgtctgctagggatgatcctctacaaagtccctgggtcctcacttcctttaagcaacaatttggccatcttgaacaaacccaccaccagtctgaagccacatgccctaggattcccttgcccccataactgcacattatccttcatcatcaaatattgttcatctgtccgcggttgcagttgaagttgggaaatgaaagacaagtagaagaactcaatttagcaacatcctttccttcccatgccagtgtatacttgctcttggctgaatctgcagagccagggcacagcgagaaatagctctgatgccatctttccactctcctccacagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtagggctattgatgtactactggggagttaaaaggggatggtgagagggagtgctagacaagggtgactccagtatctcccgcactgagggatgaagtctgtggaacaggggatgattaccccagtaaatctgccaaacaccccattctaggtaacccagttggtggagagccttgtctgtggtgggtgctttagggagatcgacaggtaggggaagtttgggtctatatccttggcctaatgggagagagagaacacaagaagtataaaaccaagggccagatgtgtatgattgtccccaaatgatctgaaattttattggagtgagctttaggtagggtaaacagagcccagtttcccaggcaactggtatgtccttccttggctactgacctgctggttttctccaggcaaaggctgtggggccaatgctacccctactcaactgctactactgtctccaccttcttcccactaggtgacgaaatacgtgacctggagatggtgccagactccatgctgcactcatcctctgagcggccaactttcatcgatcgtctggccaatagcctcaccaaacgcaagcgttccacaccccagaagtttgtaggtaagaatccagttggaaagacgtatcagctttaagccacagctcaaataaatctgagctgtgtggtctggagattcggtttggggaaagaaagcagtctggtgggctgggtgcagtggctcacgtctgtaatcccagcactttgggaggccaaggtgggcagatcaagaggtcagaagatcaagaccatcccggttaacacagtgaaaccccctctctactaaaaatacaaaaaattagccgggcgtggtggcgggcacctgtagtcccagctactcgggaggctgaagcaggagaatggtgtgaacccgggaggcggagcttgcagtgagcggagatcgcgccactgcactccatccatcctgggcaacagagcaagactccgtctcaaaagaaaaaagaaaaaaggaaagaaagaaagcaggctggtggcctctgatactgaaaatctatcctcaggacaggaggaaagtaaagagggaggatgtactcaaagagagtggagaagggttggcactgaagactctcgtggtggttgtaagggacagggtcgaggcatcgggctgtctcagttttttgtttgtttgtttgtttttgagacggagtcttgctctgtcgcccaggctagaatgcagtggcacgatctcggctcactgcaacctctgtctcccaggttcacgccattctcctgcctcagcctcccgagtagctgggactacagacgcctgccaccatgcccggctaattttttttgtatttttagtagagacggggtttcaccgtgttagccaggatggtcttaatctcctgacctcatgatctgcccgcctcagcctcccaaagtgctgggattacaggcgtgagccaccgcgcccggcccgggctatctcagtttttaagaataacaagaacttcagtctgtgtgggcccttagagagtcagagagaggaaataagtatgtggttccccctatccccagcactagtcatgagctctctaaggacctggagctttatggagagtaataaaatgaagtattaaaaatcaatgggctgggattgagtccttctctaagattatagcctagagtcagggagcagtcccacaaaggacctgaccctgcgaaagtaaatgccacgtagtaaataatgttacacccagccccacaggtaaaaaaacaaagaagtaatcctgaggagagtgtaggaattctccaaacccagccctgctgagttcctcttctccacaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggagg

SEQ ID NO: 13900 - DNA, 7791 bp, Human
  misc_feature (1)...(7791): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaacccagcacttcgggaggctgaggtgggaggattgcttaagcccaggagttcaagaccagtcctggcaatatagcaagaccctgtctctacaaaaaaataaaattagctgggtatggtggtgcatacctgtagtcccagctactcgggaggctgaggtgggaggattgcttgaccctgggaggttgacactccagtgagctgtgatcacaccactgcactccagcctgggcatcagactaagaccctgtctctaaaaaaaaaatgtagtttccacaccctcaacccccaactaccaccccaaatggttatatcatggagaatgtactttctagctagggaatattcccagagcccctctctgataccctgggagcaattttaggggttttgatatacaaaaaagaatgccagggtttgagagtgactctgtatttatctttcagggagccaggtgtggggaggacagccagtgtatccccaggaaactgacgatgcctgcatcttccctgatggtggaccttgcccatctggctcttggtctcagaagagaagctttgtttatgtctggaagacctggggtgagggactcccttctcagcctatcatccacacttgtgtttacttctttctacctgatcacctttcttttggccgccccttccaccttaacttctgtgattttctctaatcttcattttcctcttagatcttttctctttcttagcacctagcccccttcaactctatcataattctttctggcaactcttcctcaattgtagtcctaccccatggaatgcctcattaggaccccttccctgtccccccatatcacagccttccaaacaccctcagaagtaatcatacttcctgacctcccatctccagtgccgtttcgaagcctgtccctcagtcccctttgaccagtaatctcttcttccttgcttttcattccaaaaacttcaggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactggtaagggtttaggaaggggcaaggccagttgtagggcaagagaaggcagggaggcttggatggactggaaaggagaaaggtgaaatgctgtgcaaacttaaagtagaagggccaggaagacctaggcagagaaatgtgaggcttagtgccagtgaagggccagccagtcagcttggagttggagggtgtggctgtgaaaggagaagctgtggctcaggcctggttctcaccttttctggctccaatcccagaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggtaagagtatcagtgcgaatgaggttcacggaggtggggtaccctactctactctgtaagtcttacccaggactcagatgttacccaatcctttgcttagcactatggtcccctcagagttctcactggcctggctataaagccctccagtctctcttaatgacatggaataggtctggagttcaggaaaccaaggtcttcccctaggccatgaggaaagagcttgttgctttctctactgctgagaacggttggcgagaccagggaacagactgtgatcatttatataatatttatagctcattttctgttcaagcataaatgcacgaaaatccttcccagattccgagatcctgatccttccatttcccaaccctggattcccatcccaaagcaaaaagggaggaatgaaacagtgatgcttaaatgagttaacacacgttgaatgtctagcctaggacctgacatagtgtggggtgtgataaacatttgaggattttttaaaactccaatgccacccctaactgtgactctggaggagtcattttcttcttctgggcctcagtttccttatctatagaataaggtttcccaggtcttatctgattccaagcctgtgactccagaatccagtaactctggttcaacctgaaaaaatgcctgcttggcctctgcctccagatgagtcatctgtctcttgatcttgcctccttgatcctctcctgccaggttccctgggccccctgctggatggtacagccaccttaaggctggtgaagagacaagtccccctggattgtgttctgtatcgatatggttccttttccgtcaccctggacattgtccgtgagtcttgcctactttggtggctgatggaggcagctgtgtgctacctagggctggtcagtggaagcacaccttgggaggaattactcacctagataggaagaatacccaaatgccagagtcctcatttgaaagcacagggatgggattggtggagcagccctggggcttttctgtctctgggcttttggggaggccaggtagaggaatcctaatttgataagcttgcaactctgcagagggtattgaaagtgccgagatcctgcaggctgtgccgtccggtgagggggatgcatttgagctgactgtgtcctgccaaggcgggtgagtgtctcactagtgtgctggtaactctttggttgactgtttctccgctctctggcatttagtgtcccttcccagatccccttatatatgctgacacttcttccaggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtaggtccttggacaagagctaagatgaggaagggagtggatagagggcagctggcaagcagcagacactgagtgaagcagtgcctgggattcttctcacaggtcaagaagcaggccttgggcaggttccgctgatcgtgggcatcttgctggtgttgatggctgtggtccttgcatctctgatatataggtaagggcctcatcacacagctcagacccccttatcccttattatcactactcacttttcctcaaggggagaagaaaccacctctccctttgaggaagcatggtgtccaggaaagagcccaggcttttaagttagacagacttgggttgcagtcttgcttgtaggacctgggggaagtagcttaacctgtctaagcctctgaaaagtaggtaaactaatacttgccctgtggggctgttgtaaagattagaaacaatgagtaaagcacctggctctgaagcaagagtgcaataattgatattaatgactgttgttaataatatgaagagtgggggcagtttgggtaaactgagttttctttttttttttgagacggagtttcaccctttttgcccaggctggagtatagtggcataatctcagctcactgcaacctccaccttccagtttcaagcgattctcctgcttcagcttcccgagtagctgggatttcaggcacctgccaccacacctggctaatttttgtatttttagtaaagacagggtttcgccatgttggccaggctggtctcaaactcctgacctcgtgatctgcctaccttggcctcccaaagtgctgggattacaggcatgagccaccgtgcctggcctggggtgaactgagttttctacctgcaagaagggcagatcccccaggcctggggtggcatggtcctcaggcaggaaagcttacggggtgagggaggaatggacagaggttaccacagaaataagagagggtaaaccctggaggtgaggagaaggggaggaagctaggatcaaggctaagcagactgggatatgggtgtgttcccttctttggagaagcacagacaagctacctttgtccattgctaaccagtttaccccttctcccaatatcaggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctgatgctggtttttctgttgcttcttgggagaatctacgtcatttaaggagtgaaggtataaaagaaggaagtgtaccacttacttagcagatcccaaaggggaaacacaagtcattttattcagatgaggcactttcaatgtatgtgttttggggtgtgtgtatgtgtgtgcgcatggggaacagtgaggtggtgcaggataataaatactgtgagggtgaaggaacactcccccaagctggcaggagtatgtggcagcaatgtacagagcctcgggagtagagtccagggacagggaggtgggttcaaggctggcttggaggccaagggtgtcccccttagctcaagaagccaaagaaattggtggagcgggggggtgggcccatgagcatgggcatctggttcttgtgggtgatcttgatctggaagggaagggagcacattcagaggcaggacctgatactttggggctgtggcttcagagatttagagggaaatctgtggggtttggggtgggttgctaggttcctagagaggccacgatagggaaaccaggggctgagaaatcagggtttaggatgaatgatgtgcaggggaagttcaggcatcagaagggtgtaaagaagctgtggaatggggatttaggatccatggagcccaagggtttaatttttggctgggatcgtcaatactcactgtacagggcgtctgcatccagggttctccgtcaatttgcatgggaagggtttttgtggtgctataggaggccaaggaacattggtgatttccttaccaatcgaataccaaaactctgcttcttaggttggctttgagaccttttgtcattgagggagatctagtaaagcccctccccaccattcccatgacccttctgctgccccagccccacaccttccctcagggaccctggtggagtcttccttactggaaggtgatctcagagcacttggccagccgacgtccagcattcttgagcttggtatagatttggcccatctcaattgcaccctccagcccaaccacttccagtctcttgtcacttaggtctggggacgaagtagggagtaaagttttacataaacagggtatccccatagggagtcacactttcccttcgtcctgcccactcagctcccaaggctgctcctctcacctggtacacaggttttcaggatatcagggtcggtgatgactttagctgtagcacctaaggcctggttgatcccatagatatccccatggggtctcctggtatcaccccagaggttggagccaccatgcatgctagggatgtttagcactgcgatgccttctagggacaggttgctcagatccagcggtttcccacagatctgagaggagggggcacagtcccagttagggagggtacagatcctcacctcatggcatgatcatagatgtgatcgctccctccaccagatgacaaactggagaaggcaggatttggaggtgtgcaaggaatggaaatagggactagtgtatcttgaggacttggagaattggggtaggagagctgggaggttaaagaagcataggttcaagaatatgggaagttcctaagggtgccatggagggagaaacttggctattaagaagctgaaaaggatgtagggttaagtcttattacacacacctcaactgtcaaagactcctccagctttttgcatgttgagaagatggattcagatgtggcaaattcgaagtaccatagcttgttcttcattctgtgtcagccccaacacaaggcccagtagggagggacaggttacacagtgctggcaggggtggtacgtgacagggaagggcatcaacctcctaactttagtcccatggggaacaagggtggctttg

SEQ ID NO: 13901 - DNA, 22206 bp, Human
  misc_feature (1)...(22206): n = A,T,C or G
accctgtcacaaaaacaaccccccaaaacaaacaacaaaatcctcaacaagcagcctagatcctccccacaatcagaaattaggggataggaaaaatggggtgagatgagtataggagggttaaaggttaaagatgagattaatttccttgcttggttaatacacatagataatttaaaacagtatctggcacataataagcactcaataaaaagtgagaattatcttcccataccttggctctaactggatctgcaatgatgtttcaatagactactcccttctagccctgtacacctcaaggaaatccagatgagagaatcctgtttcctgggtcttcggtgtaatcagacctacaaggtgtgacttctggtcatgaaatttagaggaaactctaagtttgactaatattgcaaaacagccactcacattcccaaaatgtaacccttcaaccaaatccttccctatgccctcaaaagaatgagacatgtgccaaagctctcccaggaagcctgaagttacaaaattctgaaaatgcctcacagtctagcagccaatacagtcgtgcataattaaacttcccaagatcactcccatcctcccaaatccaggggttaagaccttttggcggcttcccttttggagagagaaagtgcacgaaagaaacgtgtgagaactggggttacctttatgtgctgtgaaaggggttaaaaaagtcgacgcctgtaatcccagcattttgggaggccgaggcgggcagataacctgaggtcaggagtttgagaccagcctggccaatatggtgaacctgtctctactaaaaatacaaaaattagccaggtatggtgacgcatgcctgtggtcccagctactcgggaagctaaggcaggagaattgcttgaacccgggaagcggaggttgcggtgagccgagatcgcgccactgcactccagcctgagcaacagagcgagactcccttttaataataagaagaagaaagaaaaaaaaaaaaaacccgtcacgaacaggattcgaacctgtgcggggaaaccccattggatttcgagtccaacgccttaaccactcggccaccgtgacttccaaaaccgcgctttatcgcgcgcttacagaaggggtccgcactgcaatccgggaatgcgtgcgggaaccggaagcagggtaccggccccgacacacacacacctgaggactccccacccctcggttccttacctcctatctacgccacccaaagaaaaagagtcggatggactgggtgacccagggagggagggtctcctgcctagcgaagagtcggggtctcgagtaggagctcacacctacttaggaggcgacagcgaggcctgcggaggaagcagttgagggaaggcactgggccgccagggtggcgactaggggacttttgggttaacaagtgaggggagtgctgggtggacaaggcgcgaggagtgagggagactctgaaaagtttaaatggggagctgctgtgaatggatggaaggaaggaacttcttggggaaaggggtttggggttttgggggacgaggggcttcgtcgggttaggaatgcgcaaggtgaggaccactcgggtctacgggttggggctgctccagcgactggcggccgcctggagtgggatagcgaggtgacactcccgagctgaggcaaaaagagggaaagggcttcgcgtctggtaagagcgatctcaggagaatggcgccccctccaggaagcgtccttctccccggaggctcccgcctccgctgccggggaggccgccagggtcggcccgcgcctggagctccgccgccgcgcccggcctgccggcagggggcgcagcgcggaccggggccggcccaggcggcgggaggcggcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacacccgtgacccagttcgacaacgtgcggctgtggctcggcaagaactacaagaaggtacgcgggccgggccgggccgcgcggggaccgggggcgggacaaagggaccgcggccctgcagccccgggatcctgcctaccctccaggcgccccagcccctcccccgcggcctcccaagcagccccccgcgcgccctcctgcgctcccgcgcccctcccccagcctccctctccccgcacccccagcctctgagcccagcccccgcccccactgctgcgccctctgccccttgtttttctctactgcccggcgggccccggtgccattagcccaccttcccctcagccatcgccctcctggcttttctgggagaggcggccggccgggtgtggaccgggtgcccaatgggctcccccgcaacccggagcgtgcccgccagagctccccacggagccaggtaccagcggggctgaggcctctccggtgctttgtgtatgttcagagagagagaatggaaagcaggagggtaaacagtcacagagcaagccgttggctgctcatcagcctgaaaaaggtctccacccagggatcacctgtctccgccgctcatcccccaccttcatctaaggggcaacagaatctctcagggagccggggtataggagttcctgggtagcggccccttccgaaacctttcctcgattttacaatgaagtcaccttgcaacctagctttgcagtaccctgggtttggggtcgagaggttagggtgagcttcctatctctagcccctcacacccaaaccccataactggagatcataaggtggtgaacaaaaggttcaagaatccttacctgtcttttctaccaaacctcttcctggtgtcgtctttgtctctaggcctggttttctctggaaatggtctgcctctctttttctcactaccctcagagagggattctctttatggctttctttcagctccccagttcttcctgccggctttgcagctcgtcagaagtgtgcttagtggcttaggagaacttcctactgatgctggttgtgagcctggccctgcccttggggtctctctgggtgtgagaatcctgacaaatagctgctatttctatggcatgtctctacgcctgtgagaggctcttattcccaggcttctacctttgaccttttgcagggagatcaggctaggggcttagcctccggccttgggggaattgacagttgtgacctggttcagcttccatgctcttagctctttgtcatttacctttcccttcacagatctatctcttttcacctctcactgagaggcactgtcttctttgtgatgagtggggagaaaacgggtcaaaaagtaaaaagaaagtctcctggctcaggttcaaattagaatggaaggctaggatgctactaggtagcagagtgtggaaacatagaagtagggccagggttacttgtctcagatacagtttcctcggacagggtagatgttgtcttgctcttctccatcaggctgggtagtggatggcccttcctgtctaggagggcctatgaagacatttatacccagtcttcagaagcaaaatgcacaagctcactcagtcaacttgccctccttcacttccttgtaccttttcttgttaggctacattatagggggaatcatggctttacagagttcccctaagaaatgtctctcttagagccccagaggtattgcttccatgacctgaactttataaacctccagaattttacaaccctcagtgctgttggttaaagatgaggtgccaagataatagggtcctgcaactccaatttcagagtataactgaggaagagtagtaagcttccctgttccccccaacactggccacctgggctggtggcagcagaatttcagcttcctggttggggtgtccagggcctcccttttgccattttctttatagagactaaatggggagaagggcactattttctttgctccacatgcttccagagcccctgggggagaaatatgggagatagtggacaatttatctgagatctatttttctttcctttccctctttttccttagtatatacaagctgaaccacccaccaacaagtccctgtctagcctggttgtacagttgctacaatttcaggaagaagtttttggcaaacatgtcagcaatgcaccgctcactaaactgccggtgagtgcagaagtagcagggagggtggggggtggtggtggtgaatccttcaaactgaagagttgtattttaaaaaaagatttgtgaattttgtaatttttgaaatttgggttattttccaccatccctatccctgatcagggcattattggcttggcctagtctccagtttaccattctttttgtcttagtaatattttgtgcaacaaattatttcagagtacctgggatcagtccacaggtctctcatggcatggttaaaaggggacttgagatttggatttgtgcaggcttgtgttcaaatcctggctttgccattggatggctctgtgatcttgggcaacattcatgagtcttggttccttcatctctagatgggattagtaaacctaccttgtagagtttccttaatggtacctgaggtaatccagtaaagtgttagcacaaggtggtgctttctgtgtgttggtttctttcactcccctcttccaggccacatgatgcaatggcacaagggttaaagaatttcagctttgaggccgggcgtggtggctcacgcctgtaatctcagcactttgggaggccgaggcgggcagatcacctgaggtctggagttggagaccagcctgaccaacatggagaaaccccgtctctactaaaaatacaaaattagccgggtgtggtggctcatgcctgtaatgccagctactcaggaggctgagacaggagaattgcttgaacctgggaggcagaggttgcagtgagccaagatcgcgccattgcactccagcctgggcaacaagagtgaaactccatctcaaaaaaaaaaaaaaaaaagggagatcaattcagcatgggattttgtgaaaggattattagattattaagtgatgagagaatttacagtggaaccttgacatgctttttccgtatcttgattttgtagatcaaatgtttcctagatttcaaagcgggaggctccttgtgccacattcttgcagctgcctacaaattcaagagtgaccagggatggtgagatgattctctctattcttcttatatttagtttagaggaaatccccctttttgattccctgggatctttctggggtagaaattcttgtgagtctctttattttgctgggtcagtagacctgacttactacgtcaggaagatggttgggagtcagagccaaaacagtctccaagagtgagtgtgtgagtatcactgtgtgttttgtagaggaaaagggattcttaggttggcatctcaaacctttttttgtccctttgaagtaagcacagagagtgattcatggagttgagatcagtgaacctcagatcccaggtgatgtttggcaatagctgtgagcaagcttgcctcctaatttcccatattaagaagtcatggctgggcgcagtggctcacacctgtaatcccagcactttgggaggccgaggtgggtggatcatttgaggtcaggagtttgagaccagcctggccaacttggcaaaaccccatctctactaaaatacaaaaattagccgggcatggtggcgggcacctgtagtctcagctacttgggaggctgaggcaggagaatggcttgcacataggaggcagaggttgcagctggccaagatcgcgccagtgcactccagcctgggcaacagagcgggactccctctcaagaaaaaaaaaaaggccgggtgtggtggctcatgcctgtaatcccagcactttgggaggccgaggcaggtggatcacctgaggtcaggagttcaagaccagtttgaccaatatggtgaaacctcgtctctacttactaaaaatacaaaaattagccacgtgaggtggtgtgtgcctatagtcccagctactggggaggctgagacaggagaattgcttgaacctgggaggcagaggttgcagtgagccgggatcgcgccactgcactccagcctaggtgacagagcaagactccatctcaaaaaacaaacaaaaaagtcacgtgccctcacctcatctgcagacctgagctataccactcactagattattgcctcttcacaaggcggcgttacgatttccagaatccatcacgcatggaccgcaatgtggaaatgtttatgaccattgagaagtccttggtgcaggtaataggcatataccctatttatctcccttccctcagtgagaatctaaaacacccctttcctataatctcattctatttcttctctccacagaataattgcctgtctcgacctaacatttttctgtgcccagaaattgagcccaaactactagggaaattaaaggacattatcaagagacaccaggtaaatggtctggtgaggagaggtttcagaaactccatgactgttttcccagtgttttctataccaagcagcagccctgaattaccatgttttctgcttcagaggtggctctgtctacttggaaaaagacttgagttaaagccttgagtctgtctttttctgtctgcttctcccatttttcagtcctgacaggtttgcattactgttctagagactatgttggcctggggaaaaatagtatccacttctactgagctagagattgcgtgatctcagataaatgaaattcctgctctttggaactttatagtaatgaatagatgtcattgataaggatgtacagtggactttaaatttcccatgtatagattatctgttcagaagattatttttggcaatttttaattctttgacttttctccattattagcacaatcccagctgtttccctctgccacttagctggtgtgtgcttagagaatacaaactaactttaatactattataagcaaaatatggttaggaaggcagctctgtggctaaaccttgagtaattcagaggggaccataatttacccgcttctccttttaccatccagggaacagtcactgaggataagaacaatgcctcccatgttgtgtatcctgtcccggggaatctagaagaaggtgagacctgggttttcctgtccacttgagtggatggtttggactaggaggcagaggactaagatcaccattcagtacctgggctcctcctcttctttcaatcttgaatcctcttaccaccttaagttcctattaccaagtcccctgctacaacaggagagtgcattagttagggcttttgtacagtattttttttgtgtccccctttagcttatatctctcccttctcttcctctatccccagaggaatgggtacgaccagtcatgaagagggataagcaggttcttctgcactggggctactatcctgacaggtgaggatgggttcctggggcaggtttaagtataagagccagacccagaagccctaggacatctagcagagcaagaggccactctttcagagttatttttagatcacttaatttgttttcctctcacctagtaagtgaacctctgtcttgggggaggtttggacttagtggacaagccttgggctaaaaggattgaggctttatgtgtgaattgattatcccagcatcattttcgataagtaaatgttagaaacaatctaaatgtctaacagtaggaaaatgtttcagtaaatttgtatatctactcagtggactattatgcagtctttaaagtgatataacatggataatttataagtgaatattattaataattgcaaaaagtagcatgtaggcctggcatggtggctcacgcctgtagtcccagcactttgggaggccaaggcaggcggatcacctgaggttaggagttcgagaccagcctggccaacatgctgaaaccccgtctctactaaaaatacaaaaaaaaaaaaaaattagcagggcgtggtggcacacgcctgtagttttagctacttaggaggctgagaagcaggataatcgcttgaaccggggcagcagaggttgcagtgagccaagatcacaccactgcactctagcctgggcgacagagcgagactctgtctcaacaaaacaaaacaaaacaaaaaatagcacgtaggctgggtgcagtggctaatgcctataatcccagcacttggggaggctgaggtgggcagattgcttgagcccaggagtttgagaccagcctaggcaacatggtgaaaccctgtctttacaaaaaaaaaaaatacagaaattagctgggcatggtggcatgcacctgtagtcctagctacttggggggctgaggtgggaggattgcttgagcccaggaggttgagtctgcattgtgccatgattgcaccactgcacttcaacctgggcaatagagcaagaccctgtctcaaaaaaaaaaagcatgtaaaatatcatctagtatggttatgattatgtaaaaacatcatctagtatggttatgattatgtaaaaagaaaattgtggaccaggcacagtagctcactcctataatactagcactttgggaagccaaggcaggaggatcactaaaggctggaagttcaagaccagcctaggcagcaaagtgagaccctgtcttaacaaaaacaaaaaccccagctggacgcggtgtctcatgcctgtaatcccagcactttgagaggccgaggtgggtggatcacgaggtcaggagcttgagaccagcctggccaagatggtgaaaccccgtctgtactaaaaatataaaaattagccgggcgcagtggcaggcacctgtaatcccagctactcgggaggctgaggcaggagaatcgcttgaacccgggaggcggaggttgcagtgagccgagatcgcgccactgcactccaacctgggtgacagagcaagagcaagactctgtatcaaaaaaaaaaaaaaattactgtggaggaaaaacagatatacaagtatcaagagtagttacgtaagggtgattctttttgttctctatttttgaaatgtttcgtaatgtgcttttactactttataatgaatagaatacaaaaaaaataagccaagaacccaatactttctgtaaatggaaagggtaaaagatctgcactttacttttccacaattctatcccattgattctactgtgtgctcaatttcccatggcagttacgacacgtggatcccagcgagtgaaattgaggcatctgtggaagatgctccaactcctgagaaacctaggaaggtgagcttttcttgtatcccctcttccccaaaaagaatgccaggaccagtctaccctttggaagtgaaacagaggcttgtatgcccttgagctttttctgttaagggtccccagacagagctgtggcttccaggcttctctgcagcatgatctgcctttgtactttaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgacaaatcctgttctttttttcctggcgcccttagcataagtctcagaacaaatcttcagtggggattgtaggctgacatttgtcctgattctccatcctataggtgaacagcccagattcagatcgacgggacaagaaggggggaaactataagaagaggaagcgctccccctctccttcaccaaccccagaagcaaagaagaaaaatgctaagaaagggtgtgccagcccctagcctgcccccgtgttcaccattctctccacatcatgttgaaggaaggaaagacaaatcccttcctataaccacctggccctgacctgggtgtgccataatactgcaggtgtcctgagagggaagatgaggagatctttagctgctcagttgttagttctggttctggccccactagtacatttaaagagagctttatcaagtgaaaagcctttgccacttcccattactgtgtgattactggtttctgtttgtactcagctctacccttggaattctctgtcacttcccttcccttgaacttcaacttccagggactccttgtccaaggatgactgggttctctttcactctctttccttcccagtccctcaacaccttacactaagtcaaagcgtggccacagagaagaggagcaagaagacctgacaaaggacatggacgagccctcaccagtccccaatgtagaagaggtgacacttcccaaaacaggtacaggccaggctgagctcctgggatccacccccactccccgtcttgactctcctttgccaaaccccaagtgagctgatttctcaggtccacctcccagtctacaggatcttttccttaaatttagctggttattggaattacggtcattaccctggaaaatcctctaactgtatattcatatctgagttgtggactgtgctttgtgcctgatagtagttgtctccaaactctttgattatgtgtttctgacagtaaaatatatttgagcatggccaggcacggtggcttatgactgtaatcccagcattttgggaggccgaggcgggcggatcacctgaggtcaggaattcgagaccagcctggccaacatggtgaaaccccatctctactaaaaatacaaaaattagctgggcgtggtggtgggcacctgtaatcccagctactcgggagaccgaggcaggagaattgcttgaacctgggaggtagaggttgcagggagccgagattgtaccactgcactccagcctgggcgacaagagcaaaactccatctcaaaaaaaaaaagggccgggcacggtggctcatgcctgtaatcccagcactttggcaggccgaggtgggcggatcacgaggtcaggagatcgagaccatcctggctaacatggtgaaaccctgtctataccaaaaatacaaaaaaattagctgagcgtggtggcgggtgcctgtagtcctagctactcaggaggctgaggcaggagaatggcgtgaacctgggaggcggagcttgcagtgagctgagatcacgccactgcactccagcctgggcaacagggcgagactccatctcaaataaaaaaaaagaaaaaaaaatgtatatatgcattaattatgtacttgtactgttaagccgctaccatgggaacgttttaaaacacaaacatatctaaaaaattgaaaaatgtaaagaatgataaaaacaaacatgaagaatcagggcgcggtggcttacgcctgtaatcccagcactttgggaggccgaggcaggcggatcacgaggtcaagagatcaagaccatcctggctaacacggtgaaaccccatctttacgaaaaatacaaaaatttgccaggcgtggtggtgggcgcctgtaatcctagctattcgggaggctgaggcaggagaatcacttgaatctgggaggtggaggttgcagtgagccgagatcgcaccactgcactccagcctgggcgacagagcgagactccgtctcaaaaaaacaaaacaaaaaacatgaagagaagttctgtattctctccctgagttgcagtggatcatcttttgcgtcctatgttagaaccccactttggagacattgctccaccaatactggtttacagtctgtattctgtagactcaccccaggtattccagaagtgtatttcaggggtaggattagggctgccaccaagaagagttctggcttctacctcctcatcaatcagctctctctcttctctatgtttgctcctgagcatatgtatatgaattcagttgaggaaagtatcctctgctttcaaaaatgtttaacacttaaccattcttccacagagtgatttggtcagattcagtatcagaccattaaaagcttacagatacatagatggagataaaggcctgtcaaagacaagaatcatttatgaatgtacatagagaaataagttaaattaatttttggttggagaagtggggaaagtagcaagaagtttgaagccctagaataattgtgactggagagaattactatattttgcaatcaggtggagacaatttttggagaaagtaggatgtctggaactattaaattgaaggcttgaattaggcaaaatctgtctgataaaatgactctctgttttcgcagtcaacacaaagaaagactcagagtcggccccagtcaaaggcggcaccatgaccgacctgggtaagacaggagcctcttgggcacggcagtcagagccaagggaaggggagggctcagctgcccccttttcgctagcctgatgggcttttggtagggctttcttgcccctcaggaggctccagccttacatcttggtttttctctttcagatgaacaggaagatgaaagcatggagacgacgggcaaggtggagccagtttagagaggccctacctctctatgtgattctgatttgtgattataaagttcattctgcccaaacttttcactgcccagactttacccactgtagactaattccagctttgttcaaaactctgaccctttcagagtcctggggcccatgactgctcagtcccatcacccatctttagtgtccacattcctggggtgtgggagaagcagagggttgctagggaggaagcaggaatgctgagtgtccagcagcctccatactcgtaggatgaggatgagaacagtacggggaacaagggagagcagaccaagaatccagacctgcatgaggacaatgtgactgaacagacccaccacatcatcattcccagctacgctgcctggtttgactacaataggtatggttgtccccaacttctcactgagtccttatttccctgcctccaggggtcaacaggctgttcttctccctgcctcctccaaataagttattttttcctcacccaaatagaccagagtacactttagttttaggggagctccttgtgtccttttgagtcttacagcctgtgggatgttctccccaagcttctaacttcagcaatttcgagctcttttccttctttgccttctaggcttttcctccctttggggcccccatcccttcaccaatgccttcttctgaaaccattctggcttttcttgcagtgttcatgccattgagcggagggctctccccgagttcttcaacggcaagaacaagtccaagactccagagatgtaaggaaatctcatctcatgattctccttctccctcctgtccccacattcacccttcctgatccagtaacattcagtttagcaaacatttcttgagcatcttccatgagccaggcactatgctaggcttacaaaggcacaatatctgcctttaggcagccctggcctagcatgtagacacatgttctttaggatttgcccaagggtgatattaagcatgttctatacataacaagtacctactccagtgcctcaacttctttttaacagggtatagagcctttaaatccatattactgatatcgtctatactgcagatattcctagcacaaaagttttgattaaagtgtaaattactattaccaggctggttcctgagagtaggttttaatagaaaaacaagagaaggaactaatagaagaccagtttatataaattaagggatggagagggctcactgggaaagaagtgtaggagccacggtggctcacgactgtaaatcatcccagctacttgggacactgagacagaaggattccttgaggccaggagttcaagaatagcatgagcaacatagcaagactcccatctctaaagaagtgaaaaaaagttagctgggcctggtggggcatacctgtggtcccagctacttcggaagctgaaatgggaagattgcttgagcccaggagtttgaggctgcagtgagccatgatcacaccactgctctccagcctggctgacacggcaagaccccgtatctaaaaaaattaatgaacaaggctgggtgtggtggctcacgcctgtaatcccagcactttgggaggccgaggcgggcggatcacaaggtcaggagatcgcgaccatgctggctaacatgatgaaaccccatctctactaaaaagaccaggcgcggtggctcatgcctgtaatcccagcaattcgggaggctgaggcgggcggatcacccgaggtcaggagttcgagctcagcctgaccaacatggagaaaccccgtctctactaaaaatacaaaactagctgggcgtggtggcacgtgcctgtaatcccaactactagggaggctgaggcaggagaatcgcttgaacccgggaggcggaggttgcagtgagccgagattacgccattgcactccagcctgggcaacaagagtgaaactccgtctcaaaaaaaacaaaaaaacaaaaacaaaaaaaattagccgggcgtggtggcatgcatctgtagtcccagctagtctggaggctgaggcaggagaatcacttgaacctgagaggcagaggttgcagtgagccgagatcacgccactgcactccagccggggtgacagagcgagactccgtctcaaaaaaaaaaaaaattagctgggcgtggtggcaggcgcctgtagttccagctacttgggaggctgaggcaggagaatggcatgaacctgggagacagagcttgcagtgagccgagattgcgccactgcactccagcctgggcgacagagcaagactccgtctcaagaaaaaaaaaaagattttgcctcaggccaaacctgcttggctttggataagacatggcagtcttctttggttaggaatacttcaagataaccacattgatgaggtgggtgagactgagaactgaacaagttttcttcccagctattccacagcttcccctctctgggggtccctccgtgttttttcttcatagcttgctatggttctctcttccttctcttcctggagaaagcagtatgtgtgaaaagaaagtagtgatcaggtgaaatgaattcaacatgacatgcaggcagggttggagtaggaactgaactcttggtataaaatagtaaatgatggctgggcatggtggctcacgcctgtaattccagcactttgggaggcccaggcgggcagatcacgaggtcaggagttcgagaccagccaggccaacatggtgaaaccccgtctctactaaaaatacaaaaattagctgggtgtggaggcacgcacctgtaatcccagctacttgggaggctgaggcaggagaatcacttgagcccgggaggtggaggttgcagtgagccaagatctcatcattgtactccagcctgggcaacaagagtgaaactccatctcagaaaaaaaaaaatagtaaatcatgataattgcctgcatctattgagagcttagtatctcccaggcactatactaaatgtccaacctacattgagtaatttaatctttacgtcaaccttagaggtagatatcatcttcagttgacagatagggtatagaggagtcaagtcacctgcataaagtcacagagctagtaaataaaaccaggatctgaatcctttaatctggcccatgatctgaaactttacactgtaccacatgatagctgccatttttttgagcccctacaatgcgccaggcactatactagtactttatagacctctcaacagacattccattttacaaatgaggaaactgaggtttaaaaattcgaagtaaattgccaaggtcctcatggtagaactgggatttgaacttagatcttttcaacttcaaaacatatgttttttaccgtggtatgctgactagctatatgcatgaataaggacttccttttaacatctgagtttggaaatgagtattttcttaacttctaattccttgtttaaaaattgtataaaatggctaggtgcagtggctcatgcctgtaatcccagcactttgggaggctgaggcaggaggctcacctgaggtcaggagtttgagaccagcctgaccaacatggagaaaccctgtctctactaaaaatacaaaattagccggccgtggtggcacatgcctgtaatcagagctactgaggaggctgaggcaggagaatctcttgaacccaggaggcggaagttgccatgagccaagatcatgccattgcattccagcctgggcaacaagagggaaactccatctcaaaaaaaaaaattgtatgaaatatccctaagtatagccaaggagataattcatttaaagaaaaccccatcaaggaaaagtaagacatatttgaaaccctttcatctagcacatagcaggcactcagcatgtagagtcaaataatctacttttttccatctttatcatgcaggagaagtcattagctctcttaccattttttcctttagccctttaacaaacatttatttttcttcttcttgtttctctctctctttcttctaagctacctggcctatcgaaactttatgattgacacttaccgactgaacccccaagagtatcttacctctaccgcctgccgccgaaacctagcgggtgatgtctgtgccatcatgaggtgggtcttgtggctgaggggaagggggtacatgaggatgcctgcctatggatgtgttttggcaacagtagagatgccagcaaggaacacagaggagcagacagaaaaaagcacctctagagaaaggtgaagtacaggtttggggaatgaatgacttgagggattagcaatggcattctctgaagtgtagaatataggacaaagaaggagcatgtctgtaattgaaagatactggttcaggccaggtgtggtggctcatgcctataatccaaacattttgggagaccaaggtgggaggattgctggagcccagaagttcgagaccagcctggacaaaatggcaaaaccccatctctagagaaaatgcaaaaaaattagctaggcatggtggcacgtgcctgtggtcttagtgactcaggaggctgaggtgggaggatcccctgagccctggaggtggaggctgcagtgagcggtgatcacaccactgcacttcagtctctcttagggaaaaaaagaaagaaactggttcagttttactagctattcaggaagaaatgttcggtaggtaggtagatatagagattggcccaggctgaagatgtagacttgggtgtcactggcatttaggtgataaatgaacaactggagtaggtgagatttcttaaggagtacaatgaacagaggaaaaggccggggttgggtggggagggggtttatgccccttctaccccccacttttcctcttcctcgtgcacctttctggctatccgtgtgaccctgtctctgcctctctctgcacagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcaggtagggtgaggtgctatggggatggggcgggttgggaagattgggcttctttgaacttttctttttctggtttttagggtaatggttcaggagtgttttgaggcttcttccttttccatgggatgcaaagggtcacgggaatcagccccatgtgtttagcatcctctctcagcctttgtacctaaggctgtaattgctgagggagaagagattatccttttactcaaggagtagacaggctaatgtaggggagtcaatagagaaaaatggcttaaaattaacttgcatgaaatttttaaactttgtcatctttgccacattttttcatttttgcctcataattatcatcttcatttttttttccatttccacttcatccattacaaaaattaggaagaaggttatgtggcttgcccaaggtcacagagtaccaaatctaggattagaacctaattgtccagctcctaagagaacctataaagataatgtgaatatgtatggatatcatgccaacgacatgtcttattaatcatgaagggaacatggaacagtggcatgagtgcccccagagcttgtgggccgcccagcatatggtcttgaggcctccagggccttggcctggtcatttcctgcccagcctccatgacgccaagctctgtcccccagggccgccaggttgatgctgataccaaggctgggcgaaagggcaaagagctggatgacctggtgccagagacggctaagggcaagccagagctggtaggtggggtgcagaccctgctgggctgctcattttcccctttattggggggcccctgcccgggaagaagagacatgagagcagaggaactacagcagtaagggaggaagtcccacccaggggtgtccctggctttgggaaagaagctccttctgtctgttttttctctctgtcagcccctggctcccggtggtcacttgtactcacctgtttctttccctccacaaatagcagacctctgcttcccaacaaatgctcaactttcctgacaaaggcaaagagaaaccaacagacatgcaaaactttgggctgcgcacagacatgtacacaaaaaagaatgttccctccaaggtaggaggtgcgggccgactctaggggtagagaatgttcgctcctcagaggtcacaggctcctttcttctcacctgcctgtgtttcccctgcagagcaaggctgcagccagtgccactcgtgagtggacagaacaggaaaccctgcttctcctggaggtaattggggcaaagaaaagagagtttttctctgaaaacagaagtgggctccgtgtagaggctcacgcctgtaatcccagcactttgggaggccaaggcaggaggatcacttgagtccaggagttcgagatgaacctgggcaacatagtgagactccgtctctacgaaaaattttaaaaattagccaggtgtggtggcacacacctgtggtcccagctactcaggaggctaagtgggaggattgcttgagcctaggaggtcaaggctccagtgagcttcaggaccagctccaggctggggatttgggccatttcattaacttcatatcctttcttagtgctacttcaagatcccccttggacctagcagagtacacaaataccagaacatagagaactttgaaaccagctgcccttagtaggatggggggagtcagccttcgagaaaagtggctaagtaagcggagttatgtctccaccactaccaccaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctaggtaatgggggtgggtggttccacctggccttcttagtttgcttttgaagggctagttactcagactgtgaatcctctcaagtttggctgccctgctggccttgtctgtgcgggcctcagctcaggcacctgtctaggctccatactagcttagatgaagacatgggcttgtgagtaagcttttgcagggattgccagaactgttccactgtgccgctcccagcctcattctttctgggtcttgcagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattggtaaggccaggcaggttcccagatttcttgcctttcacaagatccagagctacctggcctcctgtgccatttctgcctcaagttggcattagagcacaacatgaatgagaacattggtagggtttttattttccccatgagtttacctcaggggctctggagccctactagtcctctcatgaagattttgggtagaaaaatctttgcttgtagaaggggctgttagaaaagtcttgtgaaggccgggcgcagtggctcatgcctgtaatctcagcactttgggaggccgaggtgggtggatcacgaggtcgggagttcaagaccagcctggccaagatgctgaaaccctgtctctactaaatatacaaaaattagctgggcgtggtggcacgtgcctgtaatcccagctacttcagaggctgaggcaggagaatcacttaaacctgggtgccagaggttgcagtgagccaagatcaagccactgcactccagcctgggcaacagagcaagacttcgtctctcaaaaaaaaaaaaaaaaaaaaaaaagtcttgtgaaggctgggtgcagtggctcatgcctgtaatcccagtactttgggaggctgaggtgggcagatggtttgagaccagtctgggcaacatggcaaaatcccgtctctacaaaaaataccaaaaaagttagccaggcatggtggcatgcgcctgtagccccagatacacaggaggctgaggtgagagaaccacttgagcctgggaagtcaaggctgcagtgagccatgattgtgctactgcactccagcctgggcgacaagagtgagaccctgtcacaaaaaaacaaaaaacaaaaaaaaacaggtgttatggagaagctgggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13902 - DNA, 24257 bp, Human
attttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttatagttcatctctttcctcctcttatttactgaaagaatggtgggagacagaatatgaatgtgtgtatgtgatcattgatttcagaccccttttcctaatctctctgtgcatggctgcccaccccaccccattttggctagtgctgacggtgaacaaagtggttattatcatccctatttatggctggggaaactgaagcctatatacttcctacttcactttctccacacaccagcaaacctcctttcccccagccaacataccacacacacaccacaccacacacacatacatacacacccacacacacatcatatacacacatataccacacacaccacgtatacatataccaaatacacacacaccacatacacaccatatatgcacacacaccccatacatacacacacccatgcacatacatagcggcaggaagagggctcccggggaatttgcctttcgacactgcatttcccagtaagcccgccgtttttcctttctgtttcatatcacagacagaaaagttttccaaagattcttttatttacatttacatacgattctgaaaaagcgtctccaagctaccacttcttgtagttgccattgtctcattccaccaaaaaacatctcagaccgcccgcggccaccccaaatacgcctgtccactgaagcctcactaaaaggaggaagcgctgatgtcagggttacttaaattcccaggctccggatccctagaagaggtatttccctttacgcccgcgaatttgtcatagaaggcagggcactagagccagccccagccaagtccagggggaggggcgaaggtcagtagcggccttcctaaggcttccttcaacccctccttgcctgccagtcaagtaccgtattttcgcagtactggttaaagtttcactttgacccgcctccatcactcacctgattagatgtttatgagtcaaaaggcggggtcatggggtgtcgagattttattggtggatacatacgcctgtcggcagtgtaccgccccctgtcttcaggagcttgctctttaatggctccttacctcgtccatcttcgaggtttctccctcgctattggcttgtggccccgcctgtcgcgtcccttgctcgtacttgttggtgacagcgcccaaagagactcgcctttctccagaggattggtggatgagtgcacatatagcccaccctcgaaggtaggcgggtaatcgagctattggctggagccccgccccagggcgaggaggagaaggaggggcaggagggtttggttgagctgcagctgtttgtctgttcgacacaggcttggggccgacgggggagacggagccccaggtaccgagctgatggagcccaaagggcaggggcggaagcgcccgggagatgagagcagcctggcctgagagcggaggcgggtctggtcctaagcgaggggttagagtggcccaccggagaggggagaagggggccgggccccggcaggcctaatgggggtcgctgaggaggggactgggcggcctgggaccccgaagttggtgagtcgggaaggcggctgggctgtggcggcggccaggccgagggccgggggctggaggcctggagcttgagtgagggcaggggcaggcctcattaagcagcgctgaagagggaggagctggggaaaggaacagggcagcgggtgaggtaagcccatttgccgggaggtgaggagggtcagacctgtcgcccgagccccgggggtgactggggctgggtccctgcagagaggttcattggaagggcctgagaagggttcttagttgggtaagaagcgttcttttcagggaaagtgcctattgtaaaaagaactgagggtgctatggtgttgagctgagagagatttgggttcagtgagggagaactggggaaaatgaagaaggctgtattaatctagaagactaaggtagttgaagtaatggaagcagggcctggtatcagttatgggaacttctgggaatgctgaagggtgggctgggggctctgggtcttgggagtacacactcttttgttccctttagtgtttagatgtggtaatttgaagctttttaaaactcccagggtagggatgaagatcaaagtaatttttttttttccatgactgttggctgctccaaactcagcccctacactttctgttggcctcatagctggtctatactgcagtctgtttcttaacttactgtttcatgtcctatgaaagagctaagaagttggattgggggcatgttttgtccacttctttcccacttaataatgtggtctatagcaaataccatgtctcctagaactgagaatctatttcatatctatttcattatctacatgggaaaggggcttagagatcctcagccatcaggagatcttctgatcatagttggtgaaacttttgtgggacttagacttgacttgggtatttcccaggcaggtaatggagttaacaggtccgaaactatgcggtgatatcactgaggaagagatttggggaagagtgagaaattccatttcaaaagcttggcatcaccccttgttctttgtctacttcaaaagcccagatttctgtgctgttagaaagttgggtcaaactatgaagtatctggggaagatggtgagtagagaaaaagatacagaggtgcagtagcccacgcctgtaatcccagcactttgggaggctgagacaggaggatcacttgagcccgggagttcgagggtgcagtgagccatgatcttcccactgcactccagcctgggcaacagaatgagaccctgtctccaaaaaaaaaaaagacaaagattgccaaagcagaggagtggagtaccctcctccccacatatttttaatggtctgctagccttcttagtccctcatagattggagcctattggattttcccttactgtacttcctccttttctgcgtctctaccaatatattttatcactacatttcttttttttttttttttttttttgagacggagtctcactgcaacctccacctcccaggttcaagagattctcctgcctcagcctcccaagtagctgggactacaggcgtgcgccaccacgcccagctaatttttgtatttttagtagagacagggttttaccatgttggccaggatggtctcaatctcttgacctcatgatccgcccacctcggcctcccaaagtgctgggattacaggcgtgagccaccacacccggccatcactacatttcttaattacaaaagttaatatgtacatattttaaaatatggaaggtgtacagcagtttaagaagtgtaaatcctcccacacataccttattcatatttcatttaggaaggtcaaggatcagagacagcaaatcagactaatcttgctttgctttgggggatgtgtcacaaaaggcaattgtgttttcatgttctcatcaaactctagtcttattctttctacagttttcccttctgggatgatactctgttatttattgtgttcctttcacagttcattttgtcttctaccaagtccgacaagcagagggctgtactgtgtgttattcaccttgagtacacacaaacacacacaccccaagttgtgtgctgggtgtcctaggaagtgcccaaagagatggaacaaaactttatggggagaaaggatcattttggttgggataattgttggcatctctgctaaagaaaggaatttcagacccttatctcaaattcatggtctctggatgttcatggtctctgcatgttcacattacttgactatccctttcttatccatgatgatgatggttctcctaagaggcccctgtatttgtctttcttttcttttcttctatttttagagacagggtcttgctttgtcacttaggctggagtacagtgtgtgtctttctgtagggatctgagaagctccaagcttatctggatttgaaatcggttttcctctaaatctcagagtcagagtacagctggggcatttcatactaccaccttattaattgaatttgtccttactagctttaaaagccctctgttgtacccagcctttgtacagcgcccattggaaacctcggttttttcccccaaggaacttttctcacctgcaagccagtcctagagacagttgtgtaggagtatgtgtgtgtgtttttagacggagtttcacttttgtcacccaggctggagtgcagtggcatgatctcggctcactgcaacgtctgcctcctaggttcacgcgattctcctgcctcagcctccagagtagctgggattacaggcgtgcaccaccacgaccagctaatttttgtattattagtagagacgggatttgaccatgttggccaggctggactctaactcctgacctcaggtgatccacgtgcctcagcctcccaaagcactgggattacaggagtgagccaccgcgcctggccgtgtgtgcgtgtgtgtgtgtgtgttttaatcctatctaatttttccaacagttttttgcatcctaagagagtttaggagtagaattatcaataaggaatttcatacatagacctggagttgcaaaaatatatttggagaagagagctttcccattgcccttcaagtcatacctcatatcttttaaaatttttttcctggacaatccctactgcataacatacctcatatcttctaactcttactttacctgggagcaaatattgcttattggtatgaattttacttctgagaaggaggcatagggtagaagaagcaagcgtatagtttgctccctaatcctaaagcatttcagattggaaggtaaccaaagtgtgagacaatgaacttataataaggaaatgcagcagccctcttggaggaaggataccataaaaccctacatggtatactcccacttccgttttgggaaagatttagccattgactcaacagtaactgaactgaataaggagctacccaggtgaacaaagtatgtgtacatttctgggcaaggttgtagcttctgttcagggacagtgggtaccttttcagagtgtctcctggttctgtggtgttatggctcctttttttaaacttgtgtttctcaagtcaggaattaatagatagtggcccaaagcttttgaccgttcaacatcaactgaaaattcagcgaactttgtttttagctatagttgcctcagtgtttgggtgggagggccacatattgggtgtgattaggccatctgaggcatagtaacgggtgacaggaaaagcagttagcccatgcgagttgcaatagtaccttgtgggcaagatcccaagggggccctccatccaagggagatcacagaggagccagggagagaattgattctgaggcctattaaaaatattcccaaatggggccgtgtgcggtggcatgcgcctgtaatcccagcactttgggaggctgaggcgggtggatcacgaggtcaggagattgagaccatcctggctaacacggtgaaaccccgtctctactaaacaaaatacaaaaaattagctgggcgtggtggtgggcgcctgtagtcccccagcttctcgggaggctgaagcaggagaatggcgtgaacctgggaggcagagcttgcagtgagccgagatcgcgtcactgcactccagcctgggcgactgagcaagactccgtctcaggaaaaaaaaaaaagaacccaaatggaattgagtaagatctgtccagatggtacagaaagggaggagttgattgggggagagaagtagaattacttagccttaatttagggagcatttaatgagcacctactagggatcaggcagcatgctgtgctctgaagattttaagataaactcccacttttaaagaagttcatagtttagcagagcagacagacacaatttatatactgtgataatgtgatacatactattatagaaatacagtctttttttttttttttgagacggattcttgctttgctgtccaggctggagtacagtggtgcaatctgtgctcactgcaacctccgcctcccgggctcaagcaattctcatgtctcagcctcctgggtaactgggattacaagcctgtgccaacatgcccagctaatttttgtatttttagtagagacggggtttcaccatattggccaggctggtctcgaactcctaacctccagtgatccatctgccttggcctctcaaagtgctgggattacaggtgtgcgccaccacacctggccagaaatacagtcttaatactgtgggaccctacgggcctctagagaatgattaattctgtgggggagagggtgattatgtaatttcactgaagtaacatttgagcttggtcttatgagatatatagaattttgctaggcagacaagtagggacgggcattccaatcttacctaggtcaataatagggagtttgtactaccatactgataagaggtaagtatgctttttgcctcttggagaaatataagggaaagggtgcgagatgtggaaggaatctcatttaatccaatgactcattaggtaacactggatcaacaaaatgaagagctgagccaagtggtagaactctcatttcaagattttggtgacttgggtttaaacagagttggagagggagatgaaggtatttactggtttctgctctatcttccctacttagtaaaactctcacattaatcgcagggcccaccaaattctgcaaaagttaccgcttgttttcctattgcctctcattgaattgcttctatttcaactgtcctggcagggtttggtcatagaccttctagaaaagagtagtgatgaattaattcttctgtcagaaagatatgggactgcatcccagttgccaaggaaggcctgggtcttcttaatttgtttttagtcccaaagcaagtacttacctaaactgaatagaggcaggaactctatccagtctaagctctcgatcctgtcctggtgttctctttagagttcagcatttcctgcttccttaagaagtatagtggtataagaggcaggagtacctgactaggagtcctacatttactgcttagcagttggctgtatggtaacacttgacaagttgactaattttattttattttttatttatttatttattttttgtgcaaatggtggcctttaataccaagaaagaccatgacaagtgacagaacaggagcaaattccctagtgtagtgccgagctagccctttgcaggaccctaaaacctgatctagtaacagaataaatcagtgtatttacatttatgtttgccctgaaaacccaggtaaggtctgaagcctgaggcatctctccttcctttcctcctccctctcttcctacctccttgccttcgttcacttcctcaattcattcctctcccttctcccttcctctcttttccttcttttcctttctgcttttcccttttctcctttttctcctcattctctttaccatctacctatgtgtccctccaagcccctctgctatttctcccctgctcactccctctgctgttgtctccctcaggttcagcttccggggtggggaggcaagaaagggtcctcagctcagggagcacttgttggtgttctttatgtcacaagttttcaggtcagtactgggaggcttgttgccgtttcctgatctccggcctcctgacttgagcaagatgtcccgggccagggaactaaaagcctcatccacattcatactggatttagcactagtttcgaaaaatcggattccatgctctcgagccaacttatcggcctgctccttctgcaccttcctcttggcctccatgtcacatttgttccctagcaagaggtgctccaccccagctgaggcattctccatgatgcttttcatccagttctgaatattctcgaaagatttctcatccgtgatgtcgtatgctaggataatgcccatggctccacggtagtaggcagtagttattgtcttgaaccgctcttggccagctgtgtcccagacttgtagtttgatcttcttcccctctatatccacagtgcggatcttgaaatcaattccgatggtggagatgtaagtgttgttgaagttgtcctctgcaaagcgaatgatcagacaagtcttgcccacccccgagtccccgatcagcagcaacttgaagaggtggtcgtaggctttggccatggcggacaccgggggagccggggaagggatggggctatttatttatttttgagacggaatcgctctgttgtccaggctggagtgcagtcgtgtgatctcggctcactgctacctctgcctcccaggttcaagcaattctcgtgcctcagcctcctgagtagctgggattacaggcacgcaccaccacacccagctaatttttgtatttttagtagagacaggttttcaccacgttggccaggctggtctcaaactcctgacctcaggtgatctgcccatctcgccctcccaaagtgctaggattacaggtgtaagccaccacgcctagcccaaattgactaattgtatgtgtctcggtttcctcacctataaaatatagagactggactaaatgacctctagactggctctgatctgcctgactgaccttaaggctgacaactggtactgggttggactccagtggctatatataccgagaactctgtctctgttgataggtgatagacttctggagacttcatatgtatttggtttagggactcaaagctaacaagtggaagggggcttgaggaatggagtcttactctagctgggactgctaagacacttttactgttatgcctactttgctgcactgcttgggagagttgcccacattaaagaacatcctccatgggtctcctgcatctagtgggctaacccatggtcaggcctcaatcctccctagttaatgggtcattttataagtcattcttgtagagccgtacttctttttttttttttttgatggagtcttgctctgtcacccaggctggagtgcagtggcaaagtctcgacccactgcagcctctgcctcccaggttcaagcaattctcctgcttcagcctcccaagtagctgagattacaggtgtcagccaccacacctggctaatttttgtgtttttaatagagacggggtttcaccatgttcgccagactggtgttgaattcctgaccttaggtgatccgcccacctcagcctcccaaagtgctgggatttcaggcatgagtcactgcacccggcagagctgcacttctaagggaagttaaatctgatttcttctcttctgagctaaaaaggttgaaaggaagagaaacctgccccatctcccttttttttgtctcgggtttgaaggtaataatcatcataccacttgactggtttaccaaaaaaaaaaaaaaattagtatttttgtgggaaaaaatgagaatagaaaataaataattgaatcttatatgtattatttcatttctgtaccacagaatttttgagagtctagctattatattttttaaatgatacccttataaacatgataagattaaagatcaaagcttagaggtggctcaacaattgctgtgaacagggaggaaggcaggacatattctttctttttcagaggtgggatctcactatgttgcccaggctggtctcaaactcctgggctcaagtgatcctcctgccttggcctcccaaaatgctggtattacaggcgtgaaccatgatgtgcagccagaacatactcttaaggctacatattagggtacgaggtagtcttttctaagtcagtagttactgatctctgagaatccaaggttgcttagtagcaagaaagcttgctgaccacatctgggctctggcttgacttcccatctctgagagttagtgacagagactttgcaactcaagcgtgtctgcaattgtttcctgtctttacactcccccagagctcaagtgatatgtttagccatgagaattcagtccattctaactcccacattttcctgtattgtagagtagtaacattgaggcttaatattctaccccttggatcacatgctttgaaatacataaaaatgtaagggagtaagttgaaaaaaccagtaactttttctattgtttcttgagagtatagcatatatatgtcacctgaaggaaacttgatcagcttatcatctgtccttttttttttattatggtgtcacctgtcttctcttttatttattttttattttgagagacggagtcttgctctgttgcccaggctggagtacagtggcataatctcagctcactgcaacctccgccctctgggttcaagcgattctcctgcctcagcttcccaagtagctgggactacaggcatgtggcgctacacccagctaatttttgtattttttagtagagacggggtttcactatatgttggccaggctggtctcaaactcctgacctctcaaacaccagagtgagactctctctaaaaatggaaaataaattttaaaatgttataattaaagatactcatttaaattgaataaatttagctttatgaaaaatttgctgtatcatctttattttgatcctttcgtcataggccattgaaaacttaatcataaaatggtacatgtatatctgaatttttaagactgactgaccaaggggactacagaatacccagtagaatcaaagtaattgtcatgttcctctgtattaatctagtctactttgggaccttgagttctcacctctcattcttttgctaacttcctctttaccctttagttatgtctccttttttttttttttttttttccagagatagcgtcttgttctgtcgcccaggctggagtgcagtggtgtaatcagctcactacaaccttcaactcctgggctccagtgattctcccaccacagcctctggagtagctgggattacaggcacataccaccatgcccagctaatttttttaaatgttttctagagactcagtctcgctatgttgcctaggctggtctcaaactcctcacctcaagcaaggcttccccttttatctcccaaacccctgggattacaggcatgggccgctctgccaggcctgttttttctctttttctttctctgtaccactttcatattgtggcttcttccctgcccccgatctcccccctacccaccccaggtggagtcttgctctgttacccaggctggagtgtggtggcacgatctcggctcactgcaacctccgcctcccgggtttaagcagttctgcctcagcctcccgagtaggattacaaatgccggccaccaaccacacccggctaattttttttttttttttttagactgagtctcgctgttgctctgtcgccaggctggagtacagtggtgcaatctcagctcactgcaacctccacctcacaagttcaagcagttcacctgcctcaacctcccaagtagctgggactacaggcacgcgccaccacgcccagctaatttttgtatttttagtagagacggggtttcaccatgtttgccaggcttgtctcaaactcctgacctcctgatctgcctgcctttgcctcccaaagtgctgggattacaggcgtgagccactgtgcccgccttttattttttgagacggagtctcgctctgtcacccaggctggagcacagtggcgcatcagctcagtgcaccctctaccttctgggtttaagcgattctcctgcctcagcctctggagtagctgggattacaggtatgcaccaccacacccagctaattttttttgtatttttagtggagacggggtttcaccatgttggccaggcagggctcgaacttctgacctcaggtgatccacctcagcctcccaaagtgctgggattataggtatgagctactgcacccaggctgtggctgctttttaggaatatattgataacaactaatattgagatatattttaatagctattagcactatgctaaacacatctttcacttattatttgtagctatgaggatggtattttttccattttacaaaggtagaaggtaaggcttagagaggtagagaaattctctttatatcatattagtaatgattagtagcttaatatttatttagcacttagtatctatcaaatacttaaaatactttagttatttatatgcattatctcatttaatccttacaacacccttatgaagtaggtgcttataaggctattatctcattttacagatgaggaaatgaatgcacacatatatttagtgacttgctcaaggttcatagctagtaagtagagctgaaaaacaaacgtggagaattggactccagagcctttattcctctgaattgcctcctgtatgattttctgtctttacgatctagtaagtggggttactgaaaatttttaaccccagtttaactccagtcccactaattgtggtgacaaaataatgatgtttccccacatatgccatagagtatgatgtctgtgaagtcactaggatctgctttggaaaagcgaaagagtaatttgaacaagcaaagtacaactctcaagcaatgcttaggtttgggagagaggtttttgcatgctctgcctatgctaacttccctttgaatttcatagttcctttccgctcagagtcaggatgatgaaatgtattcagatttagacgattagaatctcaaagtcccaactcttctctctgttccctgccccaccagcagctttcttagccctcttagaagatagaggagctgattcagtctattctttcatcaaatactgattgcttgcagacttaacgccctataccatcctctggagacttctgcatgtctttagaaggtatacctttctctgcctctaatttggagggctacagctgttaggcccctttggtgtggagggtaatctaatccctaggcaccagcaagacagctgcaagttgagagtaggtcaagcttactgattcttgatagactttcagatttggaaagatggcagaaacaaagtgaaaaaagagttgttaatgaaacaaagagttgataatgaatgtgatctgttggttgtatttctctctttaccttcaaccaaaaatgagaaaggatagattttgtggcaatgggaccctggttagatctttagaaatgtcttatcagggagaccggtcatatataaaggatacagcagcaactacccttctgcccttaggagtggtgactcttatcccacacccctagagtgaatctctcattttgacaaagagctaaggaaaaatgaaaagaaggccaggcacggtggctcatgcctgtaatatcagcactttggaaggccaaggcgggcagatcacctgaggtcaggacttcttagactagtctgaccaacatggagaaactccgtctctactaaaaatacaaaattagccaggcgtggtggtgcatgcctgtaatcccagctactcgggagactgaggtgggagaattgcttgaacccgggaggcagaggttgtggtgagccaagattgtgccattgcactccagcctgggcaacaagagtgacgtctcaaaaaaaaagaagaaaaggaaaagaagagcacagcaccaggatgccaaggagatactggggatctagggtaccggtgggtggatctggatattcttcaggccagctaaaggttgatcactttgtgtgactcaaacaaaaaactttgaagacctggtggggaattactggggaattaaaaactctcagttttcagtctctctatttcggctcccttggcagttagagattatgtggtagggcagactccagaagcagttcttattttgctcttcccaactcttaccactgaggatcagctgcctgggaccttctcagagctaagtcctcatagaagcaaggagatgaagaggttctatccttctctgaaaagcgattgcagcttcaatggacgtatgtttaattttattcacttttttttcttgcaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggaggtgagtgccttggggtaataggagattgaatgtttggtaagggtttttttttttttagatggagtcttgctctgttacccaggctggagtgcagtggcgcaatcttggcttactgcaacctctgtctcccaggttcgagcgattctcatgcctcagcctcccgagtaactgggattacaggtgcacaccgtggcacctgtctaatttttgtatttttagtggagagggggtttcaccatcatgttggccaggttggtctcaaactcctgacctcaggtgatctgcctgcctcggcctcccaaagtgctgggattacaggcgtgagtcaccacgccgggccggtaaggcttttgaaaagagatataagacctgattatggagctggccctcttagtcccattcttttccccagaaatggaaaccctttataaaaacagaggccggtcccagtggcccaccactttgggaggccaagatgggcggatcacctgaggtcaggagttcgagaccagcctgcccaacatggcgaaatcctgtctctactaaaaatacaaaaaattagccaggcgtggtggcaggcgcctgtaatcccagctactcgggaggctaaggcaggagaatcacttgaacccagggggcagaggttgtagtgagccgagattgcgccactgcactccaccctgggcgacaagagcaaaactccatctccaaaaaaaaaaaaaaatcaaaatctggtaaaataggctgggcatggtgggtcacacctgtaatcccagcatttgggaggccaaggcaggcggatcacttgaggccaggagttcaagaccagcctggccaacaaggtgaaatccccgtctctactaaaaatacaaaaaattagctgggcgtggtggcacatgcctataattccagctactcaggaggctgaggtaggagaactacttgaacccaggagatggaggttgcagtgagccaagattgcgccattgcactccagcctgggtgactagagtgaaaatccgtctcaaaaaaacaaaacaacaacaacaacaacaaagattagccgggcatggtggcacatgcctgtaatcccagctacttgggaagctgaggcaggagactcgcttgaactcatgaggcggaggttgcagtgagccaaaatcacgccagtgcattttatcctaggcgaaggagcgagactgtttcaaaaacaaaaaaaaatctggtaaaatagaggctggaactaatgcaaaatacaaagggtgtctgtctttctcatctttgctacctttttccccactactaccccaaaatagggtgctaattcaataaaggatcttttatgagaacttccaaattattccttccccttgttatttttatttatttatttatttatttttgagacggagtctctgtcgcccagactggagtgcagtggtgcaatcttggctcattgcaacttctgcctcccaggttcaagtgattctcgtgcctcagcctcctgagcagcggagattacaggcacataccaccatgcccggctaatttttgtatttgtatagagacagggtttcaccgtgttggccaggctggtctcaaactcctgacttcaagtgatccacccgcctcggcctcccaaagtgctgggattacaagcatgagccaccgtgcctggcctctttcccctttttattagtcatcttggaaatgtattcctggacctgcagcagattatatgaaaaagtaacagccaaataatattgataatgatgggacttgccatcaagctttaaaatcttctaattaattcttttttttttttttttttttttttggatactgagtctcaccctgttgcccaggctggagtgcagtggtgcagtggttgcccattgcaacttccgcttccccagttcaagcacttctgctgcctcagcctcccaagtagctggaattacaggcgtccatcaccatgcctggttaacttttgtgtttttagtagaggcggggtttcactatgttggccaggctggtctcgaactcctgacctcaagccatccacctgccttggcctcccaaagtgctgggattacaggcatgagccactgcgcccagccaatcctctaattaattcttttgtttgtttgcgtttgtttgtttgttttttgagacggagttccgctcttgttgcccaggctgaagtgcagtggcgccatcttggctcactgcaacctccacctcccaagttcaagggattctccagcctcagcctcccgagtagctgtgattacaggtgtccaccaccacgcctggctaatttttgtatttttagtagagacgggttttgccgtgttggccagactggtctcgaactcctgacctcaggtgatccacctgcctcagcccccacctcccaaagtgctgggattacaggcgtgagctaccgtgcccagcccaatcttctaattaattcttgatgtgacttttatctgaagctattttctctgtcatttgttattctcctattttggttagaagaaggatgactcgtataagtgccagttcttctgtccctcttagtttatgatgtacccccattccttagctagtgacatttctggcaggaaggacttagccaagggcagtcttaatcctggtttcaagacttacatgtaaggagaactcaaaaccttttcctgtagctgactatcctgggtggtgactggtcttagtgtagggcagttacattttgaagggggggagggatgttcccattcatcctcccacttacagcatcttcccctccattctctcatccatagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggtaagtgagctaagaagactgtccttgttggctggacatggtggcttacgcctataatcccaacactttaggatgccaaggcgggaggatcatgaggtcaagagattgagaccatcctggccaacatggtgaaaccccgtctctactaaaattacaaaaattagttgggcgtggtggtgcgcgcctgtagtcccagctactcgggaggctgaggcaggagaatcgcttgaacccaggaggcggaggttgcagtgagccgagatcgagccactgcactctagcctcggcgacagagcaaaactccgcctcaaaaaaaaaagaaaaaagactgtccttgcttatatttagaggagttagtttggggcagggggtaagggggcagaaaacgggttcttgaaatagcaaataagagtacaaattatgcttccaagtgctaagaagacagataatgaattatcagagacctgtggtttcactgagggaagaccacctagaagaggtgaattttgagactcattttaaaaggtgatggatatggattggcagtcattccagcctactcattctcttcatgttttcctaggaaacctttgcccgagcaaagacatgggtgaaggaactacagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagccctctctgaaaacgtcaacagaggacattcattgtctcattccccagttctacaccaagttaaatacagcaacactgtgaccctaatgacagccaggagattttcaaaggagtcaggagaaaactccagagcagagggttagggaagtaccagctgtgggggtaccagtgtgaaaacaggaaggagggagcaattaaatttgtggtaagggactattcaagtgtcacaacccaaaagcccccaactaacttaccctctcccctataattaagctttctgacatttgtgtgttggactgagtggacatggggtcatcttgagggagttgtcattaaattatgcatctaggctagctggctcaaaggggtattaattaaggggagggaacctaggattttgcctagctgttgtgctgcatgggagtggaaaggcaatactcgttcccaccctacattctgagcactaatacatcccactccttgcaggaggcccaggcatatgcagatgacaacagcttattgttcatggagacttcagccaagacagctatgaacgtgaatgatctcttcctggcaataggtaaggtcagaacatcctgaggtcctcctttttccctcgtttataggcaaaattatagctaacccaaatcaaggataggtgcgagtatctccttttgcaaaaactttaggtatggaaataccttaactttctgttatgacctccatccttggctgcagctttagctcccttgtcttcaatgtgtaagtttgccggccaggtgtggtggctaacacctgtaatcccagcattttgggaggccgaggcgggcggatcacgaggtcaagagatcaagaccatcctggccaatgtggtgaaaccccgtctctactaaaaatacaaaaattagctgggcgtggtggcgcacacctgtagtcccagctacttgggaggctgagccaggataatcacttgaacccgggaggtggaggttgcagtgagccgagattgtgccactgcactccatcctggcaacagagcgagactccatctcaaaaaaaaaaaaaaagtttgcaaatagtgaaccctcccatcttcagaacattcttttaatctctcaaattctcccttttccccaattcagtagccgtttttggcgggtggaggcagaggggtagggaagtaaagtctaccatactttgttctcttctctttttatctctagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcattggagtgttgcttttttttattttattgttattattattattatttttgctatttgtcaggtactaggaatttggaagaaaggatacccagtaatgttctactgaatcagaaacacacctttccctgcatcttgatacatctttattccctttaatcttttcttaaacatctagtttagaaaatagcccttctattgctatttaatcacccctcttctaaggccactagattgttcatcaaatcaaaccctattatatctttttaggccctcttaacagaatgtatatgtgtagggtatggtctgtggatctttgggcccactgatcagattagagagaggggtgctatttgaagtagtatacaaaaatgtatgtgcatatttctttttttttttttaattgagacggagtctctgtcgctagcctggagtacagtggcacgatcttggctcacagcaatctccgcctcctgagttcaagtgattctcctgcctcagcctcctgagtagctaggattacaggcacgcaccaacacacccagctaatttttgtatttttagtagagacggggtttcaccatgttggtcaggctggtcttgaactcctgacctcgtgatccacccaccttggcctcccaaagtgctgggattacgggcgtgagccactgcgcccggccgtatgtgcatatttctaggatccatttctatatgtttctcaaaggggtccatgacccaaaggttgaaaaacatcactgagttagttttcttgtagcttccacctcaacgggaaaatttcccctggatctgctcttgactcctagtgtacttcaaacccttcagtccaccacagtctaaaggtcgagggaagggaaatgaaataggattatgtgtggttgcagtaggctttaaattccaaagaatctgaaggtggataggaaagaggactggtgccagacaaatctgacattctaggcctgtctctgtcaacttaaccagctgtggccttgatcaagttagttagtgccttccgcctcgtttcttcatctgtaaagtaaaagctgaagattaaggtcaattatgtaaagtatgtgtgtcacacaaaagtagatgacactattaggaaggaggcttttagatagtccctaactgacttctctgtatcttcctttggctgagacttttttttttttaggttgaagctcgctttctctctctctccctctttctccctctctctctctctctcactctctctctctccatatatatatatatatatatatatatatatattttttttttttaacaactggtaggataggttgggcattagccttcttcagtgatttgattgtatacagattgaaatcctttccatttccaaacacttaagagccaaagccaacttgccaacttttcactgtcggttcccttaccttatatctcttggtaataccccccacccccgttccctgattcctggtaaaagctctagttggagagccgaaaggaaaggaaatgatctttcaaaattaaaggtgaacaccttcacttaaactgattaaaattgcagctccaccgtccggcctctagagggcagtgtatggatacatttgtccagattgggggactaggtttgataaat

SEQ ID NO: 13903 - DNA, 45840 bp, Human
gggcgcggtggctcacgcctgtaatcctagcactgtaggaggccgagaagggcggattacctgaggtcgggggttcaagaccagcctggccaacatggtgaaaccccgtctctactaaaaatacaaaaaaaaaaaaaatttagccgtgtgcagtggtgcgcgcctgtaatcccagctactctggaggctgaggccgcagaattgcttgaacccgggaggcggaggttgcggtgagtggagatcacgccactgcactccagcctgggctacagagcgagacttggtctcaaaaaacaacaacaacaacaacaacaacttctaaagccagccagccagctcatctccaatggaactaatataatatgaaagactaattataaactaatggaaccgtgcactgcaaataatttggcatttctgttctctaaatgctaagcctggtcccgaggccactctcaactcctctgcccaggcaccacccaccatgcacccagattcccaccaccagggtgcccgtgctccctctggaaggagatgagggattaaacgaagaggaacagacagtaagatggaagggaaggcagggacactggagaagagtctaaggaaggagcgagtgactctgacagtcactatcagcaagtcagccccatgaggacaggactttctgtgttttgttcactattcaatgcccagcgtctaaaaatatttctggaatgcaaacgggtgggagggggagatgctaggaagtaaaagaaataggatattcccattcaacaaacatttcctgattacgtactctttgtcaagccctatgctgggtctggtgtgggtggaaatcaaacacaaaacacagatccccccggaggccccagagcgatgaaagcaacaaacaagatacgaccagagatgggttttgaaggatgaataggagttagctgagctgtcaatagtaagaagtaaggttggtccaaggcacagcgctttctgaaggaacaggaagtgaaaggaaggcgagcggctatgagagaccgcgttaagcggcacggggcgctttaggcgctgcccagtcccggcccctccagcccggggcccgccgctcaccacacgcaccggaagcgctcggttctcccggaggcagaccggccagcacactaccatccagtcacgttccgacgcgacgccgcggccgccagccaatcagtggcggcctctgccccgcccccgcgcgaacagccaatgacggcgccgtcgggccggaagttgttccgtccggacggcgtttccacggacgcccaggagacagccggttgctgagccgggagcgctgactggcccggctgggcagggtaagcgaggggagtaaggccggggcggagtgaggaaacaagggagggagtgatggagggacgctggcgcggcgcccagtggcctggccctcccgggagtatccttagagcccggcttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtgccgcctcggtgaacagatgcggggaatttacagtttccctttccaccgcccacgactacacaaaatcagtcacactgacgctgagggtggggaacgggaagagggtggggaggttatttggaggccagcggggggtgaggggtggctgatgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtatgtattgccatctttgccaggcttagagcttgttcgtgtttttagcaaagtgctgaaaaccttggtttagggggtcaggacttgtgtcttaggattagggtgttatgcattttacttcttccattgacccaaagttcaggtgattcactgctcccatagggaacagagatcctggctgagcagtcgcgggcttggatccgtagcttgcctctcagcaccgtcatgctgtctgtcataattttcactgatgcaccctccttctgtgctcaacatcagaacgtattgtcattcttattgtgacacccaaaagtgtctcgtgcctggcttcatagaaattaatgtctttgccttttaagataatgttcatgctgttatttggcggggaaagcaatctttcttttagtgtttaaaaaaaatggaacatgatgggtcccaaaaggtgtcaagaaatccttgctctaaagaagtcattttcttgtcctctgggaacttgccagtccaaaggtattgtcacctacactctggggccaagatagaaaggatggtattctacctcctggtggtattccagggatccagaaacactcctgggccacattctcttctcagctgctccagaattggctgtcttgatgccacccttccccagattgcagaatcagcgtgtcctgatctctgtgagatgattttgatgcaacccaagtctttatcatgttgttctgttaaacaattctatagtcctttccactcctcatcccaatacaatacccagtttctttaagtgcctattatgctcctccaccgcagtggaaactttcagaatgagcacaagattcaagttcttgaaaagggggaactgggggttaattttcaagaggctttttagctttctccttgaaggtctgctgtgatctgctgtggagtaggcagttttgctctttacacgcccagtacttttgtttagggaagataatagagtacttcactggttataactgcatttctttgtttcagagtgtactatttgttaaacaggtgaatctacttctcttaacaaagtctcaatgtcctatttgcaatttatgtggtaaacactgaagacaatggtccttaaccttttggcatctcagcctcctttcgaaaggtaagaaagccaggagactgctcaaaaccatgtacataccaatgtacttgcaagcattaatgtaatttcagatgttcctgaactccaagttgaaaaacctctgaagttcaactcaattctgaaagtcaacaaagaaataaaggaggatgtcaataggtagggggaagaagaacatttacacaagaaatggggtaaactcataaatgcgtgaaatgaggaagatggtagttccattctccttgtctctgaccacacagaaagttgcatcatacacacacacacacacacacacacacacacacacacacaagatttcaatagtgtggatgattcccacgcaaagtatatgccttgtgatcatgatcatctgctatttcctcagtctaatttcattcccatgtgcttcttaaatggagttctgatatttatagacacatgtttttccctgcaacatggaccctaaatgcaagtcctgtttatctagctgatcctctagcaaagaaacagttatctattctattgcagtgggagattggctgtcctgggatcactcaggcattctacctggcactttcccctggaatttttaaggataatttttatacttgattgacttcaaaaccttactgctgctgccttgttgccttcacgcggggcaccacattttttggaaggacagggtaaaccaaaaggaattccaaaaatagtgaccaggatggtgggcagatgttagcagagggtgaagaaaacagactaaggttgggagacctggaggagaccccaagagaccagcctggctctccttagatgtgggaaagctcaactcagtaccaggacgttaaacaagaggccatctaaagtccagctgggggaatcagtcttcaactggaacaagtaaagacattctaaggataaaccttagaggaaaaagttgaactagatgactaaggagattcattcattaggtaaatattttttgataagctgtgtgccaggtactagaggtacatggaagaataaacccagggcttacctttgctgtctgctggggaagacatgaataactaaactgcagtgtgagtgctttcataaagttactaaaggagtgtttggggatcacaaaggatggagcaaccaacttgttcccagaagcataggtgtcaggagaggctgtgaagagctgaggttcaaattggaaagataatcaatcagcagagttcaggcagagaagggtgtgagacatttcaggcaggcaggcaggcaggcagcagggagcagcagggattctgagagagcacatgagcaagggggcttgggaatcagattctggcttagctactccctggtaatggagccatcagcctcttgtctgctattgcagggcacatagagtaacacccagctttgagagttgggagaattcaggataggtttctggacatgatgattgatgatttgtggctagaagtaattttcatgagtttgatcgttatttgatatggacagagaccttagagagaaatggatttcgactgatttgctcagcttgttgctggggagggaatgggagagcctgagagttctctctagccctaggcagagggtactccggcattcctccctaaactggatgctttcttatctgagtcagttatctcaccaaacctccctttctgggaactgaggtggttctcatcaaggaggagaaagaaactggctgctgtcctgtcccggttttcagtattatagtttcattgaattaaataagttttgatttacatacttttttttcaatttttgtttttttattttataaaaattttttggagagacagggtctcactatccatgttacctttcactcgtgtcactcgtgtccgtgtgaagagaccaccaaacagggtttgtgtgagcaacaaggttgtttatttcacctggctgcaggcgggctgagtccaaaaagagagtcatggaagggagataggagtggggccgttttataggatttgggtaggtaaaggaaagttatagtcaaaggggattgttctctggcgggcaggtggcaggggtcacaaggtgatcagcaggggagcttttgagccaggatgagcaaggagaaggaatttcacaagggaatgtcatcagttaaggcaggaacaggccattttcacttcttttgtgaaggaatgtcatcagttaaggccatctggatgtgtacgtgccggtcacaggggatatggtggcttagcttgggctcagagacctgacattacccaagctgctcttgaactcctgagttcaagcaatcgcctctgcttcccaaagcacttggactgcagttgtgagccaccgctcacagcacccgtgatttacatactttttggaattttttttgttttgagacagagtctctctctgttgcccaggttggagtgcagtggcatggtctcagctcactgcaacttctgcctcccaggttcaagtgattctcatgcctcagcctcccaagtagctgggactacaggtacatgccaccatgcctggctaatttttgtatttttagtaaagatggggtttcaccatgtgggccaggctggtcttgatccaccctccttggcctcccaaagtgctgggattacaggcatgagtcaccacacctggcctactttttttttttttttttttttttttttttttttgagacagaacctttctgtcacccaggctggggtgcagtggtgtgatctcagctcactgaaacctccacctcctggtttcaagcaattctcccacctcagcctcccaggtatttggaactacaggtgtgcgccaccatgcccagctaatttttctctatttttagttgagacggggtttcaccatgttggccaggctggtctcaaactcctgacctcaggtgatccacccacctcagcctcccaaagtgctgggattataggcgtgagccaccacacccagccaatttacgtacttttaaagcaaatatttaacaaatggataggatagagtaaaataaatgacaccacaaatgtatatgtttggttcataaagataagtcatttgtaagataatggttgaaagtgtaggctctagagtcaaactactagagtctataacgcatctctgccatttccttgtgatgttaacatgggcaagttttattttattttatttttatttttagagacagggtcttactctgtcacccgggctggagtacagtggcgcaaacgtagctcactgaagcctcgaactcctgggctcaagtgatcttcctgctatagcctcccaagtagctgggattacaggcccaccaccatgcccagctaattttttttttttttcatttttttgtagagtctcactatactgcccaaagtgccagggttgcaggtatgagccaccatgcccagccatgggcaagttttttttaacccctctgtgcctcatctataaaatggagattacaaatctatttcataggactgctgcaaggcttaagtgaattgatacatatacggtgcttagaacaataacaggtacagaggtgttcaaagttagcagctcaggcactagccttgtcattttccttctccaaggttttacagcaagttaaaatgaagctggagttcagccaatctttggaatcctaagaaacacaagaaatttaataacagcactcgtaacgtagttacatcttgctttacagtttacaaagtgctaccatgccttttttttctcattttgttctcataagagcctggggtagatgaagttcctggtggcgccattttataggttaggaaacttgactcttaggaagtgattgagccaagaaaggtttgatggcgatacagtctctgtctgccatgtccccacttcctgcaagggttataatgaatcatgactaataggaggtgcagacacaccttctgcaaaggcttgtagttaaataaggcagcacgtggaatggacagactggagacagtccttacctcatgtggaacctaggacaggtaaggccctgtcctccaccccagagctcactttgtctgagagcagctgaccagcagtggaagacatttgctcagcgatatattagttatggctgcaaaagcccaagaattcatccccaaggcaattaagataaaccacaaatagaggatgggtgccttggctcacacctataatcccaacactttcgggaggctgaagtgagaggatcacctgaggtcagaagttcaagaccagcctggccaacatggtgaaaccctccctctactaaaaatacaaaaattcgctgggcatggtggcaggcagcctcaggaggctgagacagaagaatcgcttgaaccccagaggtggaggttgcagtgagccaagatcacaccattgcactccagcctgggtggcagagcgagactccatctcaaaaaaaaaaaaaatcaaatagtaatttgccaaaagtttttagcaatgaacttaagttcattaaaacacattggtatttataccctgagcaaacaggagtcctcctgtgttctgggcactgggtgggggcacaggggcatcaccagatgcaaacttgatcttgactaggagggcccctcctagtcaagtagattcacaccttaagtcagtaaatcctagccactcctttagtcttcatcactggcatttgatggttttcctcttcttcatggccccaaatttctggttctctttttattatattatctatgtcctttactgtaactcacctcacaaccttttcggaaaaaaggactcaatacaggaaaggaaaaacagccgcgatgttgtgttaacctctggtttttcctctctctccttccccgcccccaccccagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggtacatgattttgctgggttctccacgaaggcagctgagcctcccaagtctgtagggttgtgttcctctagaatagatggtttcctcaatgactgaggtgttttggttataattttttattttttgagagggaatttcactcttgtttcccaggctggagtgcaatggtgcaatctaagcttgctgcaacctctgcctcccgggttcaagtgactctcctgcctcagcctcccaagtagctgggattacaggcatgcaccaccacacccagctaattttgtatttttagtagagatgggggtttcaccacgttggtcaggctggtctcaaacccctgacctcaggtgatctgtccaccttggcctcccaaagtgctgggattaccagcatgagccaccacgccagccttggttatagttttaaatgtatttttcctttatcaacattgggatgcctgtggtctaaagagtcaggggttctcaaagcctttgtgaaatacagtggccctccagcccacctctccctatttcctgctcaattcttttagccgatcttttggttatgtactccccatatctgtaaatattctgcttatcatattgttccttgttgattttcaagttggggtctttcaggtggaaatgaagcattcgtaccttcacaaccacttcccgtccaggcagtctccccatctgtattgcagttgtagttaggtcagtatctgtacactgacattattatgaccatggaaatagacgtggacagctgaaccatcacggatagaatgagtactctaactttctcgcccagcttttgttttctctggagttaatatttgtcttaatatctgtttgcttgacttttttatgtcaatgatactaatgataatgtatctccaagccctttccctgtccagtgaatctcctttcaacacacatcaactagtctatcaagttcatcttcttgaggcgatctctcccaaaaccttctgcctgcttccctctgaagtgggggctcttgcttcctacactgcccatcttggcgtctttcttcactgtcgacccaaggggttctttcacccctgtcgattgggtgccccgtttcctgctcctgcatctttattcctctttgctttactctttgggcagagcaaatcttccaattgtttctgaaaaaaatattgcaaaggaaatatttctagggggatcttgcccatctgaaagcgtatttattttacctaaaacatgattgatagccaggctgggtgtagggttctagcatggaagtgatttcccctggaaatgctgaagccactgctctattggcacctagcttctgggcttgctgcagagaagtcagttgccattcctttgttttttctttttggaagttagcaggatcttctttgttcccgtgttctgaaatttcatgggatgcaggttcagtatgcctttctttttttttttttttttttttttgccaccccacccccgccccccgagatggaatctcactctttcacccaggctggagtgtggtggcacaatctcgactcaccgcaacctccgcctcctgggttcaagcagttctcctgtcttagcctcccaagtagctgggattacaggcatccgccaccataccaggctaatttttgtatttttagtagagacggggtttcactatattagccaggctgatctcaaactcctgacctcatgatctgcccacctcggcctccgaaagtgctgggattacaggcgtgagccaccacactcagcctgccttttagactagaaactcatggccgttaattctcagaaatcatgatttctttgatctcttctgttttctctcttcacagacttttttttttaattcagagactgtttctctgattttctaaccctcctattgttttccatttctgctatcatttttaacttccaggagcatgtatgctccctgaagtttcctcacagcactctgccctgactcataggtacagtaccacccttttctctctgagatttttttttttaatcttattttactgtattaaatcttactaatattctgtaagggacaaaccagacgagtaggctacagtgaagaaatcttattttggagagttaagaaaccactatgatacttccaggtattatcttcagtgatgcttcttatctttattcagggactccaggtaatattcagctcctacagctaccacaaatgcagcaaatccccatttgaatcctttaaacaatacatcaaaaaaggaaacactctttgcaaagccacccatgtatcttcaagcttcattgtggccccacggatcccttagccctttttcagccagcttcttctggatagtttctaatggtgtcccttctgtcttccgttgtctgtaatctagaagttccattttacgatgtccatgctcatgtccatgtccatgggccatgtctgacagcaatctgacctctcaggacactcaactctctctctctgagatcttaatggtagttttccatatgtcctctacatcctttataacctcagtttcttccatcttaatttgttttctacctgcctttcatattagaggcaattctcaactgtttggtgtttcttggctatttgctggtgttttggggggtgcactgaaagctgctggatgcactcttcattggggaagagcttatcaacataggttccacttcctggagagtgaccaggctgctccccttttgttggggaatctttcgtgtcaaggtctttagatcttttctttaaagttaagtgagattccccagagaaagctcccccagtccactgttcagagggggtgagtcccgctgccagagttctacggctgagtgggagagaagggctgggctgtgggatccttccccgaagctccctattctctgtgtgctgccagtgccccaactgtgcagactgcccccagtctaggcacctgtaactctgtcctctcttgacatgaaaccttggaatggaggggaaactgtgacactcccttggccgaggggagagggattctcaataactgcttcttgaagagacttcaaccagcgctcctgttttcataacccgctttcctgcccccactcctgtaagtgcgcaaggtcactaaggcccgaacctttgggtgattccgtaacagtgtacactcggtcaccttccagtatttccatgatgtcttagcatttgtttttctctcatgctgttaggcactgatcattcatcagctttctggcttctgaaaccttgttgctgtcatcctcttcttgtttcctttgtccttgtgggattatgctttaaaaaaaaaaaaaaaaaagaagatctctgcttttgttgtagtagatttcagaaatatcatcatcaatacgcatctttaactagaacataagcatttcatttccttctggggtgactccactccggcttctccatgacttccatcactttttttttttttttttttttgaggctgagtctcactctgtcgcccaggctggagtgcactggcacagtcttggctcactacaacctctgcctcctgagttcgagcgattctcctgccctggcctcgtaagtagctgggactgcaggcgcccgccaccacacccggctaatttttgtatttttagtagagagggggtcttgccatgttggccaggctaatcttgaactcctgatctcaggtgatccgcccgcctcagcctcccaaagtactgggatgacaggtgtgagccaccacgcccggcccgacttccgacacttttaactcctgttatctgttatcttttcaaacaccttgcttgtcaccagattgtgtcaaccatctcacattccccagtagtttactttgactatttgggaccctgatttaaatcattatttgtgtgtgtgtgtgtgtgtgtgtgtgtgtgtgtgtgtgtattttttgagacagggtctcgctctttccacgttggagtgcagtggtgcaatcctagctcagtgcaccctcaaactcctgggctcccaccttagcctgccaagttgctggaattatagatgcaagccactgcacccagctcatattttaaaggaaataaatagtactgaaagaaagtaatgtcaaaaaaaagttacttttttacagaaagagatttactcaccaggtaggcctcaaacgattaaaccaagttgttttaaaacaaaattataaaataaataaaagacccagtggggttatgtaagcccatcattttgggaagttgacagtggtatttttgtccatttaatattaaatttgaataacatttagtaaatgtttttagttagtaattcttagtgactgcagttatgttcattattttagtcaacttaatacattttataataactcttccaagtgtattatttgactaatgcaattggctggcacacgttgaagacatcagaggttgcacaatgagaccagagttaagtggtgaaaaattcagaagtacatttgtatctgaccctgaaatgtcttggtagtagaagcacttgatgttttggaaattttaaaaattaacttttagcaaaatagtgtgagccacattgggagtgccagttctaagagagggcaccttgagctctttcttctcctgccatttatctaggccatggaccttgaaggtcttttctgctccagtgtatctaaagaataagatccacatccttcagtagcagcagctcattaaagcggcaagtttcctagggggaaataagtcagcatctgagggctgtgaggggaaatagtttgagcaggactaaagaagcaatgctaggtcttaggtattaagaaagagagcagagcctttttcttcttctcctttttgtttaagtaacttctaaaatcaaaatataccattcatatagaaaaacatgctgatcataagcacaagcaggcacctcactgaattttcacaaaatgaccacacctgtgtaaccagcacccaaatcaacagcaagcagagagcacctagaagccaccctcacgcgcctcagcctctgccatgactcctcccaccaggggtagctctacctgggtttgaactgtatgtaatacagtcttgtgtctggcttttttttctgaacatcagcttttggcgaggctccgtggctcatgcctataatcccagcacttaggaggccaaggcaggaggatcgcttcaggccaagagtttgggaccagcctggataatatagtgagaccctgtctctacaaaaaatttaaaaattagccagacatggtggcacacacctgcagtcccagctactcaggagactgaagtgagaccctgtctaaaaaaaactgatgttctgggttttttgtggggtggggatctcacttcatcacccaggttggagtgcagtggtgcaatctcggctcactgcaacctctgcctccctggctcaagcaatcctctgacttcagcctcccgatgagctaggaacacaggtgtgtgccaccacacctggctaattttttctatttttggtagagacagggttttgccatgttgcctagggtggtctcgaacttatgagctcaggcgatccgcccgccttggcctcccaaagtgctgggattacaggtgtgagccactgcacccagctaacatcagcttttgaatcctgtttcagtgtcctggttcagacactgattaagactgattataagaaaatagacaaggtaagcctgcttgtcttattttggtgctattccaaaatgcagatggtccttgagcagggacattggttaaatgtttgactttcgcagagcctcctagttacaagcagaattagaccagatagagtatgaaatgtcaacaaagctagttattaagtgatattgactgcagtgtacttcaaagcaaggtaagccttcccatagataattggatagattatacgtactaaactgttattttttgcaagtactgagcctaggtactacagaaatgagatgggtggaacatacttaactatctaacctgggcaaacatctcatctatgaatcgtatccattgggttactgattccacaaatctggctcattttaatgatgagtctcagataattttgtagtttgaaacacagattactccagaatcacagtcctttatggcccaagtgctatatctgatggaatagttatctctgaatggaggttggtgtttatagaacattctgtatatggtaaaaggaatttaaggagatttaaaagaaagaatgttctgtataaactgtaagtggaaatgtttgtatttcccttggtaagcaaattgggctgtgtatattctttgtttgtgatctaatccagcaaggccaattaccagaatagagctttagggcatagcatgactaatcagcttaattaggcctgcttttctaaacaccaggcttccaggggtggccactatggactcctgcaaaagagtctttaatacatttccagactacccaagggtacattttacctttgttttttttttttcaagatagtttgataagactccaaaatgtgatgatgtaactatttcccagtgaatccctccttaatttataacctgagagcctacattttttgtccttgcttttatctgttttagttgctcttactatccttagtggcatcattggttaagttaacgtaaatattcatctcaacctgtgtggtatgtaaaaactagttccaatgcagaactccaggaatctcaattaaaggagcttgtcacacacgttctctggcatcagtggtgtttgagaaatctttagcatatgaactttgtcataaatgacagtgtatattgtgtcactgctactgtcccaaagtgttcatggtagcactagaataacagataaaaatgaagtgttttcgagccaatgacttgctgtgattctatgggtaagctcctctacctctctgagtctcagattcttgagctggaaaaggacagtgacaacaatacctgccttgtagggttgtgacactaactaaggtaacacgtgtaaaagcatttaacacagtgcctgccacagaataggcattcagcacatatcagctattagtaatacttttagccatcccttttatttcctctctcaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattggtacgtcctctgctttcttcccagaaaaagctgcaacttttagaagtggtcccattgagttgattccattgatgtttttaaattttgaattaatcataaattcagtgaagcttcaatgccaagaaaaaatggatactaaaatcttttggttgtgcattatattcccaaaggattattttaaaataaaataacaatataaaatatatttcaaaataatgatctatagtagacagcttaatagaaggttttccctttttttgagcacttcagaacttgggaaaggtctattgaaatggccatttataacatttagtggctacaagtcaatcatagattacttaggtttcacctccagtgatactgactatggacctagaaggctggaagtcagcttaagagcagtgacttctcacatcgggcaagttcttactgtcatgcccttccttgagggccttcctgctcaggaaagactgttgccattccattgaagtctttactctgagatcattgctaattatcagagaagaaacagaactgaaatgttttcatctaagtcaaagccattttccatgatttcagtatagactatcaatgagggaaaattcacttgaagaccgacattaattcagttcaacaaataaagaatgtgagaaatcatggttgtcaatgaatataaattttaccttaataaacaaatatatatatatatacctatttatatatgtatatgtttatattttgttgtcaaaagttgctagctggactgcattctgaatatgtttcccatcagaacccagtctcaggcaaaacagcattttgtgttgtaatttatttcctgttttgttggttgtgttgatctcagctgttgttttaatccaaagaccttttacttcatgttgggggtaaggacctttagcagaaggcctaaagaggtttgtgttcattaagattgtgcatggatcactcacttttcatcttcatttcagtaatatctgatcactaaacctcctgccacctaagaaagtcatcttttctttttttccagttcggtttggaagtagtaaaattgacaaagagctaataaaccgaatagagagagccaccggccaaagaccacaccacttcctgcgcagaggcatcttcttctcacacaggtcaggggctcttcaccacaggccttctcacctgtcctcttcttttagttcaaaaaaatcgtaagacactctcttcataagccacctggtactgtgggaaaagtgatggccagctgtggtaagactgagatccatcctctgtcctgtcagtaacccactgtgggatcatgcttgtccatcaccctcaggctcttagttttttcatttgtagactgcccacctcacaaggtgggaatcatattaatagcaggtgagattcttcccagattacaggctgtaaagaaattataaaatgtcatgaaaacaaaagagaataatatgtccaagatcagcatttcccacatgacaaacagtaggcttcctgaaattccaaaccctcttcctcctattgtattgacttgctcataaacaataccaacagacaaaccaacagagaatgcatggaacagattatctgtaccttaggccgtaaattccacgcagataacgtcaagatatgggcaggttccaaaagagtttctgcctctcccaacctacagttatctgggctgaggcagccccctttttgaagctgtgtccatggaatttatgatctgatgtagggttgttctgttctactggcacttcacggttacaggagaacaaccccaggacagagcccagcagtctgcccaaacacttcaaattctacctgcaaagaactccaggccttgctcaacccactttctgggtggaatataataaaaaattttccttaattcacatactataaaacttatttttttaaatgtacagttaagtgggttttagtatattcacaaggttgtgagaccatcaagactatctaattccaaaacatttcatcaccccaaaaggaaacttctacccattaacccatttatgccagaagttgtaaaaattttttgtgaaaaatcagaccttggcaatcaccttgagcagtaagatatcaataactcccacaagtttagcattccaattttggaacagtaggtaggcataaatgggttaacagtcatcccccatttctccctccccactggcaaccattagtctgctttctctatatctagatttaggcattttatataaatgggatcatgtaacatgtggccttttgtgtctggcttcttttacttggcataacattttcaaggttcctccatgttgtagcatgtatccatactggattcctttttattgccaaataatattccattgaatggatatacctcacattttgtttattcattcattagttgatggacgtttgagttattttcactttttggttatcaacaatgctgctctgaccatttgtatacaagtttttgggtggatatatgttttcaattctcttgggcatatacctcgaaatagaattaatggcttatatagtaattccatgtttaactctttgaggaactgacagacttttctacagcaactgtatcattttactttcccaccagcaacataggaagcttcccatttctccacatcttcacccactcttgttattttccatgttgttgtgttttatagccatcctaataggtgtgaagtagtatttcattgtggttttgattgtatttccctaatgacaaggatgttgagaatcttttcatgtgcttattaacaatttttatatctttagagaaatgtctattcagatcctttgcctactttttaattgggttgtctttttattgttagttataatagttctttctatattctggatactagtttcttattcaaatattacttgcaaatatttgctcccattatataggttgtctcttcactctactgatagtcctttgaagtatgaaagtttttaattttgatgaagtccagtttattttatctttgattgattgtgtttttggtgtcatatctgagaaaccactgactaatcgaaggttgtgaagatttacacctatggtttcttctcagagttttgtggttttagctcttacatttcagtttctgatcctttttgagttaatttttgtatatttgtgaggtacagctccaacttcattcttttgcttgtgggtatccaattgtcccagcactgttttttgaaaagactattcttggctgggcgcagtggctcatgtctgtaatcccagcactttgggaggccaaggcaggcggatcacgaggtcaggagattgagaccatcctggctaacacggtgaaaccccatctctactaaaaatacaaaaaattagccaggtgtggtgatgggcgcctgtagtcccagctactcgggaggctgaggcaggagaatggcatgaacccgggaggcggagcttgcagtgagccgagatcgcgccactgcactccagcctgggtggcagtgagactccgtctcaaaaaaaaataagaaaatgtgagtactcaaacatggttctttttcaagattgtttaggtattctgggccccttgcatttccatatgaatttcagcttttccatttctgcaaaagcagcagctaggattttgatagggattgcactgaatctgtagattcatttgtggagtattgccatcttaaaatattaattcatctaatccatgaacatgggatgtcttttcacttctttgatttctttcattgatgttttgtaattttcagtgtataggttttgcacttctttgcttagatttattcattagaattttatctttttaatgctattctaaatggcattttcttaatctcattttgattgttcattgctactatatagaaatacaactgatggccgggcacggtggcttacacctgtaatcccaacactttgggaggccgaggcgggtggatcacttgaggtcaggagttcgagaccagcctgaccaacatggtgaaaccacatctctactaaaaatacaaaattgggcaggcatggtggtgggcgcctgtaatcccagctacccaagaggctaaggcaggagaatcacttgaacccaggaggcagaggtggcagtgacccgagatcgtgccattgcactccagcccgggcaaaaagagcaaaactccctctcaaaaaaaaaaaaaatacaattgatgtttgtgtattaatcttatatcctgaaattttgctgagtttattagcgctaatgctttttttctttttgcagattcgataggatttcctacatataggattgtatctcctatgattagagacagttttacttcctcctttccaatttggatttttttttcgttcctaatttctctgacttcaactttcaataggatgttgaatagtagtggtgaaagtgagcatccttgtcttattcctgatcttaggggaaaaactttcagtaaagactgaatatacaccatttagtataatgttagctgtgggctttctatatacccttcaacatgtgtttttattatgaaaagatgttagattttatcaaatgcattttctgtgtttattgagatgatcatgtgggttttggcctctattttattagtatggtgtatcacactgataggtttttgcgtgtttaatcaaccttgcgttcctggaacaaattccacttaatcatggtgttgaaaatcaatttattttcaatcatagtgtataatcttttttatatgttgctggatttggtttgtgagttgctgaggatttttacatctgtgttcataagggatattggtctgtagttttcttttaatgtctttggtttggtatcagggtaatactggcctcatagaatgagttgggaagtatttcttattcaattttttttggaaaagcttgggaaggattggtattaattcttttttgaacatttgatagactttaccagtgaaaatggggttttgggcttttctttgtaggaagttttttgattactaattcagtctttttgtttgttccagatctgtgtatattttctatttcttcttgggttcgtttcagtagtttgtttctaggaatttgtctatttcatcaaggttatctaatgtattggtatacagttattcatagtattcccttatgtagtaatcctttttattcctataaggtcagtagtaataccccttcttatattcctgattttggccgtttgagtcttctcttttattccacacccccccccacacacacacacacacccagtcactttggttcaaagtttactaattttgttggtttgtagtcagcattttttatcttagcatggcatggttcttctcactgcctttgtgacttatttattaactgcagtatagtaatactgtagcctcttggcttaggaaagcataggacctgagtcatttgcccattctcaaatttcaaactgcccctctgtctaattttgtcatctgtaaaattggggattaaatgagatctactatgcacagtcaagcttcaagtggtgggcaggtaactgggttcccttagtagctgaatgagtctctgctggaatccatcctcataaaacatgatctcaaaattggaacccagtaaatttctgcacgcttgtcaggagcacctcaccccaggaccgagcacacagtgagttctcagatgctccacataaacacaagaaaagcagctcatggcacagttacatttttttctcttctgtaagcccatatggttagttgtgagaaccaaagaaggattctttccttccaaaattatgggttattttctttccttatttcaaaagcagtatgtgagcatttcatggggaaaaaaaatgaaaactaagcccaaaaaccagaacacccacaattgtatctgtccagagataagcaatgttgacccttggcttggggaatataaggagaagtcactttcagaatactgttctctagattctcctatccagacctctggaaaaggtagttattcctcttgtatttggggacactttacccagaaacaaaggacattcatcctcgagcgttggtttcccaccctgctgaacattggaactcctcacggagctttttaaaaatacaaattcccggccaggcgcagtggctcacacctgtaatcccagcactttgggaggccgaggcaggcaaatcacgaggtcaggagtttgagaccagcctggccaacatggtgaaaccccgtctctattaaaaacacaaaaaattagctgggcatagtggcaggtgcctactatgcccagctactcgggaggctgaggcaggagaatcgcttgaacccaggaggcagaggttgcagtgagcagagatcacaccactgcactccagcctgggtgacagagtgagactctgtctcaaaaataaataaataaacaaacaaacaaacacattcccagagagcacctcagatccattgaatcagtctctggaggtggggcgcaggcagctgtgattggaagcagcctggtagggagggggatgactcttgagtgacttgcagatgaagatacctagtcccaagctggctgaggggcccagatagatctccaactgggcacttgacctctgaactcccagaggacaattcttactttccctgctaagccaggactgtctggtcccatgcagtttgcctggtattggtctgagagtcctcggggctgggtgattctgagcaaggatcatatggtgttggcctggtatccccagggaagtgtaccaagctcacagtatgtcggcactgatgtttggagggattccaggagtcccagtaactgcatagctggatccatcttttaaacacattattccaaacctacacatcttgtcttttaaaacactcacaggagaaaccatttcagtagaagtttcctgtctatatttatatcataagcaccaaaggtaacaaattctagttattatccatgttgtttcgtctctgtctatattttccatttccaaaagtgcattagtgccttgatatttttctcagaaaatcacactcttcctcttctcctttttcctttagagatatgaatcaggttcttgatgcctatgaaaataagaagccattttatctgtacacgggccggggcccctcttctgaagcaatgcatgtaggtcacctcattccatttattttcacaaagtaagtattggatcttatggcttttcttactctcttagtgaattgagaatgttgcttataaaccatgtttagaactgacaagatcatgctagttcatttgctgagcaaccaagatgtcaagagttggcacttttttggcttccattcactttgttcctgggctcactttagaggaccatggagtgatggggagagcgcagctttggagtcagccaggcctgctcctcttctcatcctgctccctgtccgcatggccatgggcctgctacttctctgagcctaagtttccacatctgcaagatgagaatgaagatacctacctcatagaactactgtaaagcttcaaaacaaagtgtgtagagcagctaacacagagcacacagggccacctggtcgataaatggtagtagaccttatcattatccatagtcaaattcatatcacaattcaaattgtgattttgtaggcaaggaagttttaacatacgttgtaagtaggagctgtgttttcagatgcacgatggcgttcctccacaggggagatgagacgtcagctttctccccctgtgtttctttaggtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggtaaggagaaaacgtctggctgccttttcaataggtagaggaggatgtcaagttgtcatgaccacagctaaattcgaaacaactgaaatggtcttaaggcctagtaaatgttcttcttcctttattaaatgctatgagtggccagccatggtggctcacacctgtaatcccagcactttgggaggccgaggtgggcgggtcacgaggtcaggagttcaagaccagcctgaccaacatggtgaaaccccatctctattgaaaatacaaaaattagttgggtgtggtggcacgcacctataagcccagctactcaggtggctgaagcaggagaatcgcttgaacccgggaggtggaggttacagtgagttgagatcacgccattgcactccagcctgggcaacagagcgagactccatctcaaaaaggaaaaaaaaatgctatgagctggtttattggttttatttaccaataattttgaaagtgaaaagctgtgtatgtacatagaaaggattaagtgatatcagtatcttaaagactcgattattgtctccataattacatttacagaaatttaaaatatgggctcagccacagcatgatggcatctcagatcttcatcctcagctgtgccaggaagtcctgccttgcagtttcttgccaaggatagtcagtcttccagagttatgtcttcctccttttcaacgcaccttttcctcacagagaaaagactcagtggttacacagtttcctcagtctagttcttttaatcagccatttaataaaccaaaatatttcattctgaaaatccttcaagtttcatcccaaatgattaccaagaaatgtgttagaaaaataagactttggtcaaccatcacaagaaggatactatctagctcaacaaatatttcttgagcacctgagttgtggtactcccctaaggtgagatactcttctaagtcatagtactcccctaaggcgtggtctctcctaaggcatggtactcccctaaggcatgttactccactccccaaagacgtgttactcctcccctaaagtgattccccaggaggagtgggttcattgctatgctcctgcagcccaggctgggctctgagcaggccctcccatgttagctcaccatcagggaccatgccgaggcaggataagagggacactaaaggggcaggtgagcagtgagcacaggaggacttgcttagagccgcatccccagaacgttccctcttataagaccttaaaactgagtagtggcagccaggcgcggtggctcatgcctgtaatcccagcactttgggaggctgaggtgggtggatcacaaggtcaggaggtcaggagttcgagaccagcctggccaatatggtgaaaccccatctctactaaaaacacaaaaattagccgggtgtggtggcgtgctcctgtagttgcagctacttgggaggctgaggcagaagaatcgcttgaacctgggaggcggaggttgcagtgagccgagatcatgccactgcattccagcctgggcaacagagtgagactctgtctcaaaaaaaaaaaaaaaaaaaaagaaagaaactgagtagtggttttatatccattgagagcaatgtataccctgataggaaatctcgcccttctatcagccagtaaaactgttagctttttctttttctttttttttttgagacggagtctcgctctgtcacccaggctggagtgcagtggcacaatctcggctcactgcaagctccgcctctcaggttcacaccattctcttgcctcagcctcccaagtagctgggactacaggtgcccgccaccatgtccggctaattttttgtatttttagtagagacggggtttcactgtgttagccaggatggtctcgatcttctgacctcatgatctgcctgcctcggcctcccaaagcactgggattacaggcatgagccaccacgcccagcacctattagatcttttaaaattacttctcttggttcagccatgtgagcatggaggccctgtggcatccttgaaggaaggaaaatagacagggatccagatcctggcacctgggtttagtggctgtgtgtcatagcagccgtgtccatgaaatgggatcaaacaagaacatagatgtcatcattagcataattttcttttttttttttttttttgagacagagtctcactcatgggttttgccatgttggccaggctggtcttgaactcctgacctcaagtgatcctccccgcctcagcctcccaaagtgctgcgattacaggtgtgagccaccatgcccagccgtgttagtataattttcatggcactttatttccttattctcaccccattccatacaatgattcaactgattgaacctctgcagagacaactgtgggttctgcttctccttttccagtcaggcagtgctgctggcattgcccagtagctgctatcctcttcccacaccaccactgcccccaccagccagtgatctccctaaaactcagagctaatctcatcttccacttgcgggtctttcccagctctcctccttagatgacattgagaattctcacctttcacttggcacacgagccctttcgtgattggccctgtgttcctctccagcgtcactgctacctccagctcagtggaacagcttgcagttccacatccttctcctttgtacatgctctgtgctgcccagaattcccacccactctcctgaccctgccacccccagcttagctaattcctacactttcttccaaaggcatgatcaagcatcaccttttcctaggagctttccctccccacagccaaatttagatgcccctctctggtcctccatcaggctgggccttacctctgccacatctggtacagtgtggccctctccccactagctgagtaagacacatagttcctgaatttgtgctctctgtggcccatcccctcctgggccccacagacacagcagaagcaaagctgagccgcttcgttgatggatataaatgctggtggtgagacaagagcaagtgcctataatagtccatgaagctgattcagccaatagatgcacgatggggtagatgaacttttgaacagtccatgtgaaaagaccaccacctgagcaaccccactttcagcgctctctgaacgtggagtgaggccgccattcctcgtgctgtctctttggcaactgcggttgcagctcctgaccagcctccaccttcgctaaataagaacttccttttttttttttttttttttttctttttttgagatggagtcttgctctgtcgcccaaactggagagcagtggcatgatctcggcttactgcaatatctgcctcctgggttcaagcaattctcatgcctcagcctcctgagtagctgggattacaggcgcccgccaccacacccagctaatttttgtatttttagtagaaacggagtttcaccatgttggccaggctggtctcgaactcctgacctcaagtgatccacccgcctcgaccacccaaagtgctgggatgcgtgagccactgcacctggtcgggaacttcctttttccttacaaacatggggtaaagatgaaacccagacagtatgtcaaccaaaagggtcgatgatatcttttcttgaaaggcattttatattgaacctaaagtgaggagagacattttaaagggtaaatcctctattcaaacattttactttaagagtttcttctaaacatttgagcattttacttttctttcttgaatttaactcaaaatctatatctttggcttaataaagctccttcctggtgtttaggagctggaaattcaacaaagccagccatcgccctctttgagtgggagggaggtggtgaggcctccatgagggaggaggccagtgcagttccccctgcacattgcacatggccccagaacggccttcctgcccagggccctgagggatgcaaaggcactgagctgggagtctgaaaacttgtgttccagacccagctctgcccctgcctggtcttgttcccttgggcaagtccttaaatctctgagcttccatgttcctgtgaggaagggagctgggtgctagtggggggcagcatagcagaggttgcaagtgctctgcttgacggccgtccgctgtgtggcctgggcatgggaggagccttccactgtgtggcccgggcatgggaggagctcctctctgcctgctttcttcactctgctcctttgttctacaaatatttattggacatctgctatatgccagactcatggtgggggtacagcagggagcaaaaccattatctcagcagctgtgtaaagcctctcttctaatggggagaatcagctaacaggtgatcaatcaggtgataataagttctatggtgataatagggacaaagggcaggggtagagaagactgtggtcaggagatgatagtgcctgcactgcatataaagtgcttcaagccacgcctggcacctggggagtgctcagtaaatgttgtaatctaaaatctcttcccactttaaaccctgtctgagagtgaaaagcaggtgccctccctggggtaactggtggttcagccacatgtgatatacagttaggtgtgttcactgcagccagtgagaagcctccatgtgccggcactggcatggctgctttgcgtgatgggtccgtcccagctgtgcagggggacagccgtcccttgaggggaggatcacacgtgctcacggtgcagcacctgcattcaccctgcagccagcacagtggcagcagcttgcagcaagtaatgaccagtcttctaagaaagggcagcgtgctctaactcagaaataccagtcagacgccgtgaagctacagtcctgccacagtttgggggtactggagactttccctccttgtaggggttagggtgtcccaggtgcctcaatcccaagggcgcatggagtctttgctgcagcccatctccccaggtgacagacagctgctgtccttactggctgtgagtcctgctgcggtgcccaggagggaccctccctgcctgcggtgttcttggcttgcttggcaggaggacaaaggccgcatctttccaggcagtgctgctgttggctgtgctcttgctctctgttgtttccattgtgctgagtgggtgacacagatgctgggttctcctggcatgccccttcacagtactgcgcccgccctctccagtgccccccagggcctgaaactcagccggctgctaggcgaaagacacagtccatccctcacgtgctgcctctgctcaacctggacaggccttggcactgaccttgaccgttacaggcctcccagcattgtgcttcgcccagcacaaacggccagtgttcctgcactcctgacaccccaccccacctgcacaaagacattcagtagttctccaccctgccccaaaagtctaaactcttctaaaggataagatgtggtgagaaaagcataggctttggggccaggtgaatctgtgttgggatcccagcccctgtactcactgggcctgtgactatgaccctgaacttctttgagcctagtctaactgtaaggtggaggcaatgctactactttgaaggggattttaggagtattgacacatacgcagcatctagcacagctcctgccacatggtgcaaacacttaaaagacaccagccttcccccttttccctcgtagtgtctaacacatggtagggcctagagaaaaagctactgaatatagtaatacaaagatgcaatataagaagccacttggctgggcgcggtggctcacacctgtaatcccagcactttgggaggccaaggcaggtggatcacctgaggtcaggagtttgagaccagcctggacaacatggtgaaaccccatctctactaaaaatacaaaaattagccaggcatggtggcgagcagctgtaatcccagctactcaggaggctgaggcaggagaattgcttgaacccaagagatggaggttgcagtgagccaagatcatgccactgcactccagcctgggctacagagtgagactctgtctcaaaacaaaaaaaaagaagccactctgggttctgccaaacccctacaccccactgtgtttgcttcttcttcagcctagttccttctggtagcggaatggctgccacacattcaggcctggtacccacacccctcaccatccagaagagagagttgggttgcttgaatcagccactgtggcctagccctgttgctgtggatagggttagttctgcccaaacagcaggggggagcagtggccagagactaggaggaccagctgcactgaaacaggccttcctccttctcgggccgtgggtttctatccatacgctcatccgacaacaagcagatggtctcccacaacacagtatgtctcagctaagaagctcctgggggctcccagacttgagctccacagcccactgaactgctgaccctggcagaatttaaatttttcatgctagctgcaagtctctgaatctgcttgtgttcttgccttgtttgtatgtctgcttcacgtcggtttcacactggtttctgcctttcccagtcaactccacaggtaaacgtgtgtctgctttgcctgatgcaggtatctttgcctacagatgacttcctggcaccttcccagtgcttacgtgttgaccacaatgtggccccgagtctggcccatgccactactcattggcatccaattttaataactgtgactttgccttcagtgaaggccgccctccgtttgggatttcattctcgttgtctttgcaggatgagctcaggtttctacaaaaatgtggtgaagattcaaaagcatgttaccttcaaccaagtgaaaggcattttcggcttcactgacagcgactgcattggtaagaggcccactgctgctgtggaccactccctgcacccttcaaaaaggagcagagttctggaggagacacatgcctggtttaaatatctctgagatgttagcgtttgcaactgtctctttaagtaggatgcccaggcgtgggtgggtcatcgttgtcctggaatctgactagctagtgtaatgcattgagcagcttctctgggttgggtgaagctgcacttcaggatgtgagtctgtccctctcttgtcacccgtcttaaggtttagaagaaagaaaaatctaaggatgactttggagttccaacagctctggtgggaccccagtcagtgtagggtggccttggatggaacccaggggtgatgaagaaggacagctgggtctgctgcccatgagagggcctttgagtctttgtctccctgggcctcagtgtccccacatgtaagatgaggggcttgacacgaggtcttctggagccttcccacccctgccctgctctccttccatggctccaccccagcagatgtgcaaatggtttgcctcccacgtgcatgccttcatggccctctccataaatttccatgtgtctttcagatgcattggcttcgtagacttttagacttttggtccttgagacttgtggctgggccttctgatcccctcctctacttgatgtttggtgcgtggcttcaggcatagcaggcccttgaggccttcagtcagctgccagccgagccagctccctgggatgcgctgccggggctctccgtgaggagcgttcaccctgcttggagccagagccacagcggcgtgtgctccacagcgtcagggtcacgctgggccagccgcgtgcccagggcccggaaacctctgcgctcacccaagggtctgggtaccgccacttggtgggggctggcgtggcaccacctgtcgggccatagagaggtcaaaagttctgcttctgcaggtctaagcaaatactaatgacagtaataacagcaacaacatccaaaacactaaacacttttaaatatcaaaatacattcatcataacttctttttttttttaatttatttatttatttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtagactcagcacatgtttcagagagcacagggttgggggtaaggtcacagatcaacaggataagaatttttcttagtacagagcaaaatgaaaagtctcccatgtctacctctttctacacagacacggcaaccatccgatttctcaatcttttccccacctttcccgcctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgaccccgccacctccctcccggacggggcggctggccgggcggggggctgacccccccacttccctcccggacggggcggctggccgggcggggggctgaccccccacctccctccaggacggggtggctgctgggcggagacgctcctcacttcccagacggggtggctgccgggtggaggggctcctcacttctcaggcgggcggttgccgggcggagggtctcctcacttctcagacagggcggccgggcagagacgctcctcacctcccggatggggtcgcggccgggtagaggcgctcctcacatcccagacggggcggcggggcagaggcgctccccacatctcagacgatgggcggccgggcagagacactcctcacttcctagatgggatggcggccgggaagaggcgctcctcacttcctagatgggatggcggccgggcagagacgctcctcactttccagactgggcagccaggcagaggggctccttacgtcccagacgatgggcggccaggcagagacgctcctcacttcccagacggggtggcggccatgcagaggctgcaatctcggcactttgggaggccaaggcaggcggctgggaggtggaggttgtagcgagccgagatcacaccactgcactccagcctgggcaccattgagcactaagtgaaccagactccgtctgcaatcccggcacctcaggaggccgaggctggctgatcactcgcggttaggagctggagaccagcccggccaacacagcgaaaccccgtctccaccaaaaaaatccgaaaaccagtcaggcgtggcggcgcgcgcctgcaattgcaggcactcggcaggctgaggcaggagaatgaggcagggaggttgcagtgagccgagatggcagcagtacagtccagctttggctccgcatcagagggagaccgtggaaagagagggagagggagaccgtggggagagggaagagggaagagggaagccatcataacttctgataattaaaggtggaaggtggctagagaatggttaaatgatatgatacattgacaggatagaatatacttagtaacaacatggatagtcattacaatgaaaaaggcaaggaaggccgggcgccgtggctcacgcctgtaatcccagcactttgggaggccgaggtgggcagatcacgaggtcaagagattgagaccatgctggccaacatgatgaaacctcatctctactaaaaatacaaaaatcagctgggtgtggtacgcacctgtagtcccagctactcgggagcctgaggcaggagaatcacttgaaccccaggaggcagaggtagcggtgagctgagatcgagccaccacactccagcctggcaacaaagcgagactccttctgagaaaaaaaaaaggaaaagaaaaagccaaggaaagaccaaatatagtgtaatcacaacaaaaatgcatagagtaaaatatataaagaaaatggatgaaatcagacacattgcaactgtacagcttgttctttctacttttctgtattttttagatttattttaatgattgttttataatgggagaaaacctgtttttgttcattcctttattaactaagcagaacaggaactcatctcacgtgtaaaaatactttttctcattttcagggaagatcagttttcctgccatccaggctgctccctccttcagcaactcattcccacagatcttccgagacaggacggatatccagtgccttatcccatgtgccattgaccaggtcagcaggcagaaaagcaaggctctctaagtctggggcattgacagcaggttcctcttactcttcagcggggagaggtattgaaagatatgatgggcagccaggcagggtggctcacgcctgtaataccagcactctgggaggccaaggcaggcggatcacttgaggccaggagttcaagaccagcctggccaacatggcgaaaccccgtctctactaaaaatacaaaatttagccacatgtggtggcaggcgcctgtaatcccagctactcgcctcgcttgaaccccagaggcagaggttgcagcgagagcgcatcactgcactccagcctgggcgacagagcaaggctctgtctcaaaaaaaaggaaagaaagttggggagtggggcaaggggagggagagcattaggacaaatacctaatgcatgcggggcttaaaacctagatgacgggttgatgggtgcagcaaaccaccatggcacatgtatacctatgtaacaaacctgcgtgttctgtacatgtatcccagaactggaagtaaaatttaaaaaaaaaaaaggaaaagatgaaggggaggagggagtgaatttctttggttggaagcatgagagccttctgggaagatgctcacagggactgctcatggctgaaagctggcatgttttctggccgccctcatcagggtccttactctccccacaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtgagcagtggcccaggcagagggcagccagcgggatcagaaacatgccctggggggcacacgcacacacacaccactgcgcagtgctttgggcctcagccacccagccaccgtagcaatgctgaactccaggattgccaactttgctccctgcagaactcaaggcagcctgtccttcccacatgaatcaggtgaatttgttttgtgtcctttcatttaggtaatattttgaatttttttttctttttttccttttctgcttttcttatcagcactgttctgcaggcaaagtcatggcaatttccttaaagttataattagtgtggatgttattaaataatggaaaagatttgtgtatatttctcatcatcagctgtgttccagcggctggacccggtgccttatttatgttttctcatgtttcattctcactgggaggtggtggtgctattccctttaaagatgagatgatgaggcttagagaagcccagccacttgaccaagtttccaccaccaggaatcagcagcactgctctcctggccctgagcagccattaccaagcaggggttatgagctggtcttctcccagagagcgttctcactgagagacatagaacggagaaacgtccatccacgggacagtcctgctggccccaggagggatgcatgcagcaggcattcagcaaacatttgacaaatcactagagaaactaaaaggagaagttagtttgagcttccttattttgcatggccccagttctgttgcctggttcctcaacagccagtgtatatataattgcctcactgttacacaaagcagttgacattttctttggaatcaagtgtgtgtttgcaggctagaagattgcagtgggaatgctgggaactgtatttgaggcatgtcacatgccctctgagtcactgcccctgaccgttctggaaagtcccaagcaggttctggttgacaatggggaagcctttcatatcaaaacttcctaagacatgccctccaccaactctccccactcagttggaagctggtataattgaagacttttctttccctttcacttctggccaaaacttccggagcacagggtgcagagtggggagggaagcgccattggaaaagtccactgttttattttgcttctgagaagttgtttggaaaaagttgtttatggccaggtgcgatagctcacacctataattccagcactttgagaggccgaggcaggtggatcacctgaggtcaggagttcgagaccagcgtggccaacatggtgaaactcctgtctctactaaaaatacaaaaattaaccaggcttggtggcaggcacctataatcccagctactcgggaggctgaggcaggagaattgtttgaccctggaagacaggggttgcagtgagccgagatcgcaccactgttctccagcctgggcaacagagtgagactccagctcaaaaaaaaaaaaaaagaaaagaaaaaagaaaaacttgtttatggatctgggacatttatcattcacttagggaccagtagagccctcgaggtgagcagttagcatgaggtcaggaaaaacagaggcctacagacggtcactgggcctgcaggcttcttgtggggcagaacagggcccgcccaggccctcactctaaatccccgtgcccgacttcagctccaaaatcagaatctccacactagaaaagagagggcacatctgctccagcctcctaaaaataacaggttcaggcagggcagtggcacgtgcctgtagtcccagctactcaggaggatggcttgagcccagggattcaaggctgcagtgagctactattgtgcctgtgaatagccactgcaccccagctggggtggcacagtgaggccccatctctcaaattaaaaaaatcaaaatagtagcacagtgctgacgactcaggtggctttgctgagtgagtacctgccacctgcacacagtaagcctgtgttatctaactttattccaactaccaccctagctggctgtgtccattcggcatcatttcctgtcacacagagtcacactggtcacccacttccatcatcttagttgctggcagcagtgctccatacccacccccaagtcagccctccatctgttttcctgtaagtcaggcctggtaggctggttcctgcatcactgaggactgatcacgtcaaggaggcagaactgagcccctcagttctcgagctccacccagaagcctggtgtcccaggagccagcctggtcctgccaatccctgtcacatatggcaggttcctgacactctgggcctgatttccttcacctgtaagatagagacatcactacagaggtcattgggttgttggggataaaatgcatgtcataaccctaacagcctccacggatggcacatctgctgtgtgcctaccgtgggaaaagcctggggagggggagtgtgcaggtggtggtgacgccagcacatcttgaaaaacatgcagcagacaccagtttccttgttctcctctcagataaagttctgggaactggcctttcaatatcctcttcaaactgcccctggaagccaggacctgtgttctcagactttcttcctgacactgaagcttcttccccaaggcccagcagggagggctatggccaccacatagcagtgactctatcaggcacttagatgctaggagacaccactactaggtggtttttttcttcctcctgtttattggtattttccatagtttttcattctataactttttttttcctttttttttttttttttttgagacggagtctcactctgtcgcccaggctggagtgcagtggcacaatctcggctcactgcaagctctgcctcccaggttcacgccattctcctgcctcaaggctcccgagtagctgggcctacaggcgcccaccaccacgcccagctaattttttgtattttggtagagacggggtttcaccgtgttagccaggatggtcttgatctcctgacctcgtaatctgcccgccttggcctcccaaagtgctgggattacaggcgtgagccactgcgccagcccctcgcatgggccttgcctgagcctctcgcgtgactgctgctttccctgcccagcctctcagcaatgccctgccaaaatggagacaggcgcctttgccccaacactcatctgctccttttgcacaatcccaacttatctagttaggactctgctctagaattctgtgtgtgtgtgtgtgtgtatgtgtgtgtgtgtgtgtgtgtgatggagtttcactcttgttgcccaggctggagtgcaatggcacaatctcggctcaccacaacctccgcctcccgggttcaagcgattctcctgcctcaacctcccaaatagctgggattacaggcacatgacaccacgcccagctaattttgtagtttcagtagagacggggtttcttcatgttggtcaggctggtctcaaactccttacctccggtgatctgcctgcctcggcctcccaaagtgctgggattacaggtgtgagccactgcacccggctgctctggaattcttttaaggaaacttactaaacataacaacttagaatttattgactctgcccaccttttttcccattaaaaaaaagttaagactgggcacagtggctcatgcctgcagttccagcactttgggaggccaaggcaggcgaatcacctgaggttgggagttcaagaccagcctggccaacatggtgaaaccctgtctctactaaaaatacaaaattagccgggcatggtgacaaaaaaaaaagttaaggggctgagcacagtgactcacacctgtaatcccagcacttcgggaggccaaggcaggcagatcacttgagcccaggagttcaagaccagactggactacacgacaaaacctggtctctacaaaaaataccaaaaaattagccaggctggtggcacacacctatactcctagctactcaggaggctgaggcaggaaggtaacctgagaccaggaggtcaaggctgcagtgagccatgatcacaccactgcactccagcctgggcaacagactggagatcctatctaaaaaaaaaaaattagggtgacattttctcagatgctcactgaaagaatgttgaaggagtttcacctatttgttctggcttttattagccttaattaccccgtgattatctttaacaattcctaaaagtcattgtgtttctgagtttttcagctctgacagtgttgcctgtttgtaagtgaagacctgcctgcaggcccctctccctgcacagcacttctcgtgggtttgccttcccttactgccttaccctgtgccttcttgttatgctttctgtgtggggctggccactgctttcctgtccccattaacactgcagtacctatccctaagagaggctgcccttcctgccatctcccttactctgaggatgacttactcatcctttttcttttatttatttatttttttagtttttattattttagaaacaaggtcttgctctgtcgccgaggctggcgtgcagtgatgcaatcacagtccactataacctcaaactcctgagtctgagcgatccttccacctcagcctcccgagtcgctaggactacaggcgcacgtcaccacaccagctaattcctttttttttttttttttggcagagaggagggctcactaagttacccagactggtcttgacctcctggcctcaatcgatcctcccccctcagcctcccaaaatgctgagattactggcacaagctaccatgtctggccttacccatcctttttctgacgcttgttacctgaggaacttgtctgtcccaggtttcagttcaatcagtgccttggctttcccaactctattctcctgtgtctccgaggatggggggttcaaagctcatctgcccccacctctcctgcagtgagccccacagtagctcacacccaagcctcacaggaagaacagcagtgggtcccccactggctgtgcgcccccgaccggctgtgcgccttggcctttccctggtccagaatctgacagcactcacacctctgacttccacacttgggcttctagccagtgtccaggcacaggatgagcaggactgaggagcgtgtctgtgtcctcttctggtgcaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggtgagcagggaaccccaagggcccacagccgcctcctgccacccactcctgcccatggggcctggaaggctccaacagccaggcatgaaggcttggtcggaggtgctcaactgaaacaaggtgaaaactgagtagactcgccctcatggtttttaggcctgggctcagaagcctcatgaacaaatctcgaaagagcagatacaaatcactattcatttaggagccacccaaaacagtcttgctttattagtcatcagagaaatgtaagttaacgtgatcaaagctaagacagttgagtatagaattagtaggggcttttgtgttgccattgactattttcagtgattatgaagcagatgcttcaaggcacactcaagtgagcagagtgtttatcagcacagcctcaggaagcagtttggtactgggtacaaagagcccaaaaatgttcagagcttctcctcaggttttctcattcttagattttttccaaggaaataatcctgagtaagagaaagctttccacacaaagatgttaaaaatgataatagcaaaaagttcaacacagactcagtacaacagaggaaacgttaaattagaattgttacagggtggattattatgcgggcatgaactattttaagtgttcatatgcagggcatggtggcacacatctgtagcccctgctacttgggaagctgagacaggaggatcccttgagcccaggagttcaaatccagcctgggcgacatagcaagaccctcatttctttcttttttttttttttttgagacagagtcctgctctgtcacccaggctggagtgcagtggcgcaatctcggctcactgcaagctctgcctcccgggttcacaccattctcctgcctcagcctcccgagtagctgggactacaggcacccgccaccatgcccggctaatttttttgtatttttagtagagacagggttttaccgtcttattcaagatggtctcgacctcccgacctcgtgatccacccgccttggcctcccaaagtgcttggattacagctgtgaccaccgcgtccagccaagaccctcatttcttttaaaaaaaaaaaagttttagtgacacaggaaaatatgcctatgatagtgaaaaaaggataccaaatgaaaactcagggaggagttaactatgtttaaatgaaatgcacagggaaagaaatgtgaagaaaatctaccaaatgttagcgggagacccacctctgggcatttttcaggtgggcaatttgtaggtgatttttctttactttgctgctgctttgtggtttgggtactttattaaatttgcttaatgagcatgcagtacaatcagaaaaagaaaaaattagcaagatttggctgggcgcagtggctcacgcctgtaatcctagcactttgggaggccgaggcaggtggggggagtggatcacgaggtcaggagatcgagaccagcctggccaatatggtgaaatcccatctctactaaaaatacaaaaattagccaggcgtggtggcaggcacctgtaatcccagctactcaggaggctgaggcaggagaatcacttgaacctgggaggcggaggttgcagtgagctgagatcatgccactgcactccaacctggcaacagagtgagactccatctcaaaaaaaaaaaaattagcaagattttacagaagccataaggctgccaggaattgttgttgtttagtgcctgggggaatggcccctagcatcggtaggggtggggactgccctccccattggccctttcactgtgagaggccaagtcatggctatcgtcagagccaggtttctagccgttttaggaaaagtgtagctgaaggtataggttattgttgtggtaacaacagatctcacttctgagtgccacccacgtgccaggctctgcatgggtggtgtgggctgagctggtgcccgaggcaggaaggagccgctcaggacatgtggagccatctctcacgtggctgtctccctccgggcaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgctcttgtcattgtgctctgtctgggaggtctgaggagggagcagagacccctcccctcacccttctgtggatgaccttgagtctgctggagtcaaaatttggggatgaaagcgcacagtcccaggaaccccatggtgttgtgccacagctcccaggaatgggcttgtgctgggagagcccttagcagcatcctggtgcgggctccctctcacaccacatttctcatttccagcagctgatggagaatgcaagcagaggttgtcctcgcttttcagaggaggggctggccgtggggtgcttagtggtgctgtgtagtgacggggagcacaggctgggagccaggtcgggccccattcacatgaggcccagggcagaggccgagctgcaagggagccctgggctcattctaccggcccatccttattttgcaagtagggaaactgaggcttaggagaggagaacatgacttgtccaaggccatagggtgactctgatacagcgagtctgtcctgactcttggtgctttccacacacatacagagggaccattttacaaatgagggaactacggttcccaccctggaggctggaggcctgggctcgagtcccactcaggtacccgggtgcaccatgacctcaagtaggcttcctctcccggtctcgactcctgctggcctgggccccacccctgccctcccctgctcacctggctggctatggccagtgggggtgagccacccacagaggccacatagctcactagcctgttgccttgggcaactaatatgactcctcgtcgctctactgcacctgtgacgcaagtgcaatgaggggtgacaaatggagtcagtgacagctgctgctgtcattgtccacccagccacagcatctattggcagggccctggtgagaccctggccccagggaggagtgagccaacaccaaccagcttctcccctcaccggctgtgtgactctggccaggtcacttaacctcccaggacctccatctcctcccctgtaaaaagcagtgatgcctcctgtttagggtcttaggaggggtgccctgggtccaatactcaggtgacttgcccaaggccactgctggtcaggacacaggggagccacatgtctcccaagcctccccagttttgctaaaaaccagtggtttctgagagaaatgttccctgaaagacatgggcgtgtctggattaggatggacaggttgcagtggccccatgagtgtttggggatgaggcatgaggccgggtgcctgcaccaccgtggtgccagaggctctgccggaagagcactcctgctctggctggtaatgtccacttgtcagacagatgtggggccaacccagctcagtctctctgtcccgtggcccccagcctggaggagagaccagctgagcctgcctgaaaggagatggtgcctgagaagcacacaaaacagcactgggtggggaagcagggacaggaaggagggtggctgagcacacgggtggctgtggaacagctcgttgctccaggacggcacttggcaagcaacaggcctgcctctggcccccagtgcccgcctgcagcaccagcagatgtgccctccccagggtcacactggctgggccttgaggcccaggactctctggtcattaccatagaggttgtaaagacagtgaggacagccagacgcggtggcttacacctgtaatcccaggctgaggcgggcagatcacgaggtcaggagatcgagaccatcctggctaacacggtaaaaccccatctctactaaaaatacaaaaagaaattagccaggcgtggtggtgggcacccgtagtcccagctactcgggaggctgagacaggagaatggcgtgaacacaggagacggagcttgcagtgagccaagccgagatcgcgccactgcactccagcctgggcgacagagcgagactccgtctcaaaaaaaaaaaaaaaacagtgaggacagaggcctttcc

SEQ ID NO: 13904 - DNA, 43690 bp, Human
tttgcatgtctagtcataagatactccaccgttaaacagtagaaaacaagaatatctcccactagaaaaacttaaggcctaacaggtcacctcctatggggcaagtttaaaaagctattttctggagcaggtactaggatggccttcaggagcattttagtgctttctgacctactacctttcctcaaagctttcaatccttttgggctttctccacttgaatgtgaacacctacagatctacagctcagaaaccaggatgcttaatgggtaattccctcatttctcttgctctcacaattggtgtttatggggaagtatcaactacttgcagtgccatttccccatcaattactagagagtggggaaagtgaaatttaaaaagcattaagacatgtaaaagttctcccacaactggtttccattcatgaaatatttatgcagagtttataagctataaagccagagatgacttaattcaacagatttgacttttccaaactgagtgggtgcagtactccaaggggaattattcaggtttcaaagctcagattcaaagagaaaacgatctaatttgtcactccttacactaatattctcaaaagtcaagtccaatgcgatttagcaataagaagggactaggatttataaagttgccttttaatgagaatgtatagtctacttgttttaacaagttgagcctaagattaatgtattgcgtacagttcagaaaatcatgggcctcaactgcatgaacactattacaaaacagtaaatgttgataatatttaagttgaacaaattcacagaggcgttaaatcggccaaacgagtacaacaaagacacacctttccaactcttcaatttgtcatagtttccttaaaaatcaggaaatctttgttttgctttaaggcaaattgtcaggtcgaccaaaaggacagataagagcagaaacacttcgctgcaatgtaactcattcaggaaggtttaacttgccgctaatccgtgccacaaaaaaaaatctaggctctgttgcaggtacaatggaggacacggctgaaaaaatttggaattttaaatgagacaaatgcaaaacctggtgggcgtaaaaaggagcacctatgaaagtgacaaatagggggaaagggtgggcaagggaaacaatggctgactggagagcaaagaaggggaagctcaggagaaaattttagaaagccgccaggaccctgtagttctaagatctacggggaaacaggcacccaacggctgcgtctcaggtttccgcgggtcactaaagaataacggacatcctcccaacggtggccctggggctccgcgggcgcttccgccgagctcgcgccgaccccgcgctcggccccgcaccccgccgggcgctcgcggcgagataccggacgctgcccgcgtcgcccgattttgtccgttcggtcctccacactcaccccgcggccatcgctcgcccgaagccaggcgacaagaacaaacacctcccgacgcgaaaaaggaagcacaggcgattctcgtcaaagcagactttattgggggcgacagggccgccccgcacgcgccagccggctccccgcgccgcccccgccctccctcccctcctccaccccgctcccggccggcccctccctcccttctcctcaggctcccgcccccgtggtgcccggggccgcgcggaccgctcaccggctcccaaggcagcggctgtagcggcgacgcccgttcccgagtgcggccccggcccgaggcggcgggttttgtggctgttgcaccgcgaagggcggcagcgcgcgacaccgggaagcgggaggcggtggcggcggcggcggcgcgctgacgtcacgcgccggggccagccagggcgcgtgcgagccgccccgcccccggtcccatcggccccaatccgggaggagcccggcgagtgggcggggccgcggaggccagcggacagatcgattggccgagaggagaatcgagagggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgccccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcaggtgagcgccggccgcgcgccccggccccgggatgtttttgttttgaagggaagccatgttttatgtgtgtgatgggcgccgccatcttcttcgccagggcaagtatggcggccccaaaagatggcgggccgtgcggcggcgggggcgcggcggcggcggcgggcggcgggccgcgaagatggcggcaggccgcgggggggaggggccggcgccgcccggctaggccgcaatggcgtagtttctccgagagggggaagcgccgcgcggggcggagacggccgggggaggggccggcgcgctcgctccccgacgccctcgctccccgcgcccgcatcaacgggcgcgcccgccggcccgttgtggcggcagctgcgcgcccccggcccgggcgggacgcgggaggtcgttggcggggctgcgccgcggcctcgcgggccagggattgctgcctccgggacgcgcgcccccgcccccgcccggcgctgccgttaccccatcggccgctggagggcgccgcgggcgcttgccccgcccgcccccaacttccccggactcccaactgctccccggtggcaccttccagaaggagggggcttggcactcgtgggcgcctccggcctccttgctccccgcccacccagcgccgggctggaccctgccccggcggtcacgctcgcccaagtcgtcgtttgctgcggggcgggacttggggctgcacgtagggctcgcgtgtgcgggctccgagcgtcagtcggagcctgtcaccgccgttgccagcgaattcctggccctttcgccttcctgcggtacctagtggaaagggcctgtgaatgttagcgaataattcttagtcacttacgttttgggaaagctttttttttttccctcaagtatttagctcttctgaataggttgggttagtttactcaactgtggacatttgccagtaaataaaatcgggtagtttaattttaagcctttatggtttttactttgtagaaaggtatctattttccccatgaaaagaacgataatagaaagcgggtttttttgagttttgttttactgttttaatactacttttaacgaaggcctgaaaaccatctagagcaaaaggatcttatctgcctgtgtaaaatctgtttttacttcaaaggcaattattaattcaatgctggttttttaggtcagtatcctattagtatattcatatgctacctagctaaattgctgagatactaaatagactgagaataatcctgccatcgtagttaatctaatgcctgtgatgattacgtttagtactccatataagcggtggaacctcttccctataagtactttaaagcttcataaattctcagaactgaatggagactcaaaatatggtgacctttgagtattaaaagatcgttaaaattcggaggaatgaatgaaacagaaatgaaaaggctggactgaaaaagctagtttgtatctggtgaaagcctcaagatgagacaactacagctgggtggatctgtgattgaaagaggcctgagcaaagggatctaggagctgtcaaaatctaataggaaggtgctaacaggcgctgtcctgcatccagggtgccttgtagaattcatagcagtttgagtttagcagaaactatgtttaaatgaaacatgaatactttagtacttaatggttatcaaaagataatttccatgtattttggtagctcaagagattacatactgatcatgttggaactaaaagtcatggttttggccgggcgcggtggctcacgcctgtaatcccagcactttgggaggctgaggccggtggatcacttgaagtctggagttcgagaccagctggccatcatagtgaaaccccatctctactaaaaatataaaaattagccaggcgtgatggcgggagcccgtaatcccagctactcgggaggctgaggcaggagaatcgcttgaacccaggaggcagaggttaacagtgagccgagattgcaccactacactccagcctgggtgacagagcgagactctgtctcaaaagggggggggggcatttttttttgttaataccaatgagtaagggatgggggttttagttattgatgaatttgcagaattcagaatacgatttgaaataagatatttaggtaaagatacattaaccacaaaagtaaatttactttttctcatagtgtgtggaattagaggaatttagaaaaccgacatatttttacatgatctgcattttatcttaacaaattgctggtccacttttccacatccagagaagctggtagtgtacggctttgcttgctgaagtggtatgtatggagtcagccagttaggggagaaagtctgaggggcttgactgatggaagtcaatttacaattaagtgagcatttacaagtgtgcaagtggctgttttgttttgttttttgttttttttttttttttttttttttttgagatggagtctcgctctgtcgcccaggctggtgtgcagtggcatgatctcggctcacggcaagctccgcctcccgagtttacgccattctcctgcctcaccctcccgagtagctgggactacaggcgcccaccaccacgcccggctaattttttgtgtttttagtagagacagggtttcaccatgttagccaggatggtcttgatctcctaacctcgtgatccgcctgcctcggcctcccaaagtgctgggattacaggtgtgagccaccgcgcccagccaagtggctgcttttaaggtggcacagtttggggttgttttcacgtccgtttcttttcttctcttttctttttttaatttgagacagagtcttgctctgttgcccaggctggagtgcagtgtcacgatcttggctcactgcaaccttcacctcccggattcaagggattctcatgtctcagcctcccaagtagctgggattgcaggcatccaccaccacccctggctataatgtccatttctttaaagcgctggttgtctagctagtgtggtagagtacgctgtgcataagggtagttataaatatttgatggcagtaacataggatggcctgtttctcggacatgtgttttgtggtaaactatcccccttacttttccttgtgatttggaattattactaaagagaagctaaagagcttatggataactctgcatttcccaagctgaaattctgaaggtgatttcatcttcagaactgaaatgacgtgatatactcagtataattccataacaagtggagaaatgaaagtgggttaattgttgggtaaatctgtatgtatgtgtacatatgggttgagcatggtgggcagcattactgctttcgtgtacttgatctcatttgatcctaggcatgaaggttttaactacactttagtttcactaaaatagccccttagtttggaatgaactgtgaagtaacagttttgcataagccccaagctgagttacttgaagtccttataaaaatagttgtacatacagggtattccccgagggtctagttacttcttagaccctcttggtttaaaaagcaaaaagatcaggctgggtgcagtggctcacacctgtagtcccagaactttgggaggccaaggcaggaggatcgcttaagcccaggagttcgagatgaaccttggcaatatagtgagaccccgtctctgcaaaaaaacaaaaaaccccacaaaaattagccagtcatggtagcacatgcctgtagtcactctcagctacttggtagattgaggtgggaggatctcctgagcctgggaaatcgaggctgcaagtcagcggtgattacaccactgtactccagcctaggtgacagtgagacactgtcaaaaaaaaaaaaaaaaattggccgggcgcggtggctgacgcctgtaatcccagcactttgggaggccgaggcgggtgggtcacgagctcaggagatcgagaccatcctgcctaacacggtaaaaccctgtctctactaaaaatacaaaaagaaattagccgggcgctgtggcgggtgcctgtagtgccagctactcaggaggctgaggcaggagaatggcgtgaacacgggaggcggagcttgccgtgagccgagatagcgccactgcactccagcctgggcgacagagcaagactccgtctccaaaaaaaaaaaaaaaattagtgggagtcatcatatttctggaaaccaaatgggtttcttttgcgcacatgccatgttcctttaatttcccacagtaagagcactctggtgggcatcttttgaatgtaatatcagtataggaatctaatagttttttagtagttttaggccttataggatccttagagattggctttttttttccttttttactttttttttttttttttttttgagacgggggtctcactctggcacccaggtttgagtgcagtgtgagatctcggctcactgcaacctccaccttccgagtagcacgtgccaccatgcctggctaattttgttgtatttttggtagagacgaagtttcgccatgttgcccaggcttgtcttgaactcctgatctcaggtgattcacccacctcggcctcccaaagtgttgggattaccaacctgcccgccccactccccaccccttactttttttttttgaggcagggtctcattctgtcacccaggctagagtgcagtgagacagtcacggctcacggcagcctcaacctcctgggctgaagcgatcctcccacctcagccttccaagcagctgggaccacaggctaatgttttaattttttaggcatggggtctccttatgttgcccaggctggtgtcaaactcctgggctccagcaatccttcctcagccttccagagtgatgggattatgggtgtgagccactgtgcctgacctctttattttttcctaaatttttaattgtcatacacatgtttagtttcttctgtatttatttttatttatttattttttatttcttatttttttttgagacagaatctcgctctgtcacccaggctagagtgcagtggcacgatctcggctcactgcaagctccacctcccgggttcacaccattctcctgcctcagcctccagagtagctggaactacaggcgcccgctgccacacccggctaattttttgtatttttagtagagatggggtttcaccatgttagccaggatggtctcgatctcctgacctcgtgatccgcctgcctcggcctcccaaagtgctgggattacaggcgtgagccactgcgcctgtcctgtttcttctgtatttaacctgaatatacttaactgtttagtgtgtcagagaactctgtgcatctggagttttttagttgttgctttttaaattagagatggggtcttgccttgttgcctaggctggccttgaattcctgggttcagagtatcttcctgcctcaaattcctgagtaactgggactacagacacccagcttcaactatgttttgaataatcttaatcaattgctttaatgccagtgtttactttggcctttttcactatatatgattaataaacatttcagtgttgatagattggggcacagtactatatattttttccctagatactaatgctgttacataggagtaacagttgttgtggggttttttgggttttttttgaaacggagtctcgctttgttgcccaggctggagtgcagtggcgcgatctcggctcactgcaagctccacctcccgggttcacgacattctcctgcctcagcctcccgagtaactgggattacagacgtgtgccaccatgcccggctaatttttgtatttttaatagagtctgggtttctccatgttggccaggctggtctcaaactcctgacttcaggtgatccacccaccccagcctcccaaagtgctgggattacagacgtgagccaccgcgcccagccaggagtaactgttttataacttagttaattataaactaagccacttaaccattgcatttaatagggaagataatgataaaaactgagaatttaaaacatttagttcagagagaaatttaggtgattttaaaatcttgagatttcaggtggtgacaaactgtgaccctctctaaggctgttgatattttaattcggagcagaagttgcattgccatgtgcataaactgccgcatagatgcctggaaccctggaaacaagccagcatgtccatggtcacccccaccccgtttccatttccatacatgggttttgtgaggtgaggccatcatgtgcatactgcctgcccatggctaatgaggatagcacaggtgcggggccagtgtcccccccattctgtcccgtgccagtcagcacagcttgggttgtgggggacatgtgccttctcaaagtgctggcagctgagtggcacctccttcacgcctaggagtcgatggtccctcccctggtgtgcccaggttggcctcatgctccgggtagagaacccttgtttggaccttgtggggatgtggggtggtgagaccccacctgagctgtgaccttctgagaggagacaaattaaactgctgaaggagaggcaaaaataataatcattattctgttacactgaatagagaagcggcttgtgctggattaagcaaaacctgtaagaccagaaaaccattgatacaaaatcagtaaatgcaaggaagttgaaatgcattgaatttttcccaattttataagttcagaagatgcaggtttgccaaaaatcactagtcatgaccgtttgccattcctctgtgggtttttcacaccctccctccccagtagaaactgcgctgtttatcactaagatgctataaacatgaatttccatggagccaagctcaaaaagccctccaaagtaatcacttcacccccatgacctacatagggtagcctaagtcatagatctcgaatcctgatctggtagctctgaaaggtttagcttcctaataaagcctcttgtgctgtcagactctcccctccaggttattaaccttgccttttccctcccactatcaacaactgactccccctagtgggaaaagaaaaatccgtatcaggaaaaggtcagggttcctgtcctatctacagttagtattttataggcttttggaagagggtaaattttttaaaacatccatgttggactcctaggtggatatttacaaaaggcatttctattttgtttttgaaacctgcttaacaaggtcagtctgttttaaggctgggaaacttaggttatattagcaaagcagttattgcaatgaatgttacttagtatttgcattcttttatttaactcttgatctgctcaggtgaccatttttattctctctgtgctcttactacttccaataggaagagtaagcaaaaatgaatttttctttttttctttttttttttttttcgagacagggtctcactttgtcacccagtcgggagtacagtggcacaatctcagctcattgcagcctcgacctcctgggctcaagcagtcctcctgcctcagtgccccaagagctgggactacaggcacgcaccaccaggcatggctaattttttgtagagacagggttatcagaatcatgacttggatgcagaagataacattcatgtaattactgcagagtattaggaagagccaagggagatgttagaagttagctgattgttggggggcttgcaccttttcatgtgtgatggactttcataacagcacgtaaggggagccaagccatttcctcgttctaagtatcttctcagtaggttccattctgtttaacttcatgaataattatcaagaacagaaagccagcagcatcatatttcctctctagaggggactgaccttgagatctttctaaaatgagttggggtagcggtatccttaaagtcactttgaatctttatagcaggaaattctattcctttacaaacagaacaatatactcaatttctttctttctttcttttttacagagtcttactctgttgcccaggctggagtgcagtggtttgatctggctcactgcaacctctgcctcccgagttcaaacaattttcctgcctcagcctcctgagtagctgggattacaggtgtgcaccaccacgcccggctaatttttttttcttttttttttttttttgagacagtctcgctctgtcacccaggctggagtgcagtggcgcgatctcggctcactgcaagctccgcttcccgggttcataccattctcctgcctcagcctcccaggtagctgggactacaggcgcccaccaccacgcctggctaattttttttctttgtattttttagtagagatggggtttcaccgtattaaccaggatggtctcaatctcctgacctcgtgatccgcccgccttggcctcccaaagtgctgggattataggcatgagctactgtacccagcctactcaatttcttaaagcaagagtcttccattttaacatgacctggcaaatgagatattaggaactcttgagaaaaaaaaaattttttgagacgggtttttgctatgttgttgaaactggagtgcactggctattcacaggtgtgatcattgtgcgctacagccttgaactcctgggctcaagcggttctctggccttagcctccctagtagctgggactagaggtgtgtgccattccacccagcttgagtaaaattctttttttttttttttttttttttattgaaacggtgtctcgctctgtcacccaggctggagtgcactggcgcgatctcggctcactgcaagctctgcctcccgggttcacaccattctccttcctcagcctcccgagtagctgggactacaggcgcccaccaccatacctggctaatttttttgtatttttggtagagacgggtttcaccgtgttagccaggatggtcttgatctcctgacctcatgatcggcccgccttggtctcccaaagtgctaggattacaggcgttagccatcacgcccagccaagtaaaattcttaatagccattcagttactttggttttacacagtggtttcaaatgtggtttagcattaaaacaatataaatggttgtttgtgatggactctttctcgtgtaatttttttttttttttttttttttttttttttttttgggagacagagttttgctctgttgcccaggctggagttcagtggcacgatctcggctcacctgcaaccttcacctcctgggttcaagcgattctcctgcctcagcctcctgagtaactgggattacaggcttgcactactacacccagctaatttttgtacttttagtagagatggggttgcaccatgttggccaggctggtcttgaactcctgacctcaagtgatctgcctgcctcagcctccaaagttctgggattacaggcgtgagacaccgtgcctggctttcttgtgtaaattaattccccttctcaaatagaagatctgtgagtcagggaaaggggctgccattgctgtgcaagaagctgttctgttggtgtcaggacctgtcttttcaggagagtattgaactttgaatattgagtgaatgaatggctggaatttgtgctgtaaggcagaatcagggcttataccaaaatactattttggtctattcctgtataggtggaaaagaagtattagggatagagagaaggtgcagaaggttctgttttagaagcagcatgggcttttagagtcaattctcaattcaaatctcagatttgctacttaccgtttttttttttttgtttttgtttttgtttttgtttttgtttttttttgagacagagtcttgctctgtcgcccagactggagtgcagtggcgtgatctcagctcactgcaacctccgcctcccaggttcaagcaattctcctacttcaggttcctgagtagctgagactgcaggtgcctgccaccacacctagctaattttgtatttttagtagagatggggtttctgcatgttggtcaggctggtctcgaactcccgacctcaggtgatctgtccgcttcagccttccaaagtgctgggattacaggcgtgagccactgcacccggcctacttactgctctttagatacattgcttgtcatttctgaggtcagtttcttcagccaaaaacatagggtttaataccttaaagatattgtttggattgagaaatgtgacaagttgccagaatgagacaggtacttaataaaggatagtatcctttcttaaggtctttattagtgggaaaaactgggaaacaacctatgtctgatttttgcctgttgctaagcagtgaatcgcaaatgtttagctctcccctgtttcagtgaaaggttgggtgatggcagcggtgactcttttttgtctttttttgccagaagtaacctggagtggcctaagatagaaggtgtggagaaacaaaatctagccaaacatatacatgcatacatacataggtaaatatctcagttggtgaaggtgaatatagaaaatcgggatcacaggaaaaattaccatcaaccctaatgaggttactggcagtcaaaattaaaaaaaaaggaacttatactaccttcatctgatattaattctgaggaaataaaatgtttcttaggaatgaattcctttgtgtatgaaggggaccactgagtggtagtactggcatttttcagccaatgtgacaaatttcacagtgctgtcttagagatgcctaaaaaatgtattaaggaacgtggctgggtatggtgcacttttggagactgaggtgggaggatctgaggccaggagtttgagaccaacctgggcaacatagtgagaccttgtctccacagaaaattaaaaaaaaaaaaaaaaaggccaggcatggtggcatgtgcttttgtagccccagctacccaggaggctgacgtgggagaatcacctgagcccaggaggtcaaggctgcagtgagctccactccagcctggatgacataatgagattctgtctcaaatgaaaagagagagagagaaataatatataaggcctttgatttttctgattaacatattgactaactggttgactggttgactgaataatgactcccaatatagccagatcctaattcttggaacctgtgggtgttaaccttatttgcaagtgtgattaaaccagggctcttggaatagggagagtatcctggtttatccaggtgggtaccaaatgtaatcacacaagtgtccttgtattcacaggaaggcagtgggagattgactgccaaagaggaagtaggagaggtgtgagaggttggagtccagtgaagagaaggggtcaaggaatgtaggcagccttcagaagctagaatatgtgagggaccagattctccactaaagctgccagaaggaacccacacaacgactttatagctctgaaactgattctcactgctggcctctagaactataagagaataaattcctgttgtttcaaaccaccaaattggtggtagtttgttacagtggtaataggaaactaatacatgtgctagcatcccctgtatagcttcattctgcaggaacttggcaagtccctgttatgtgcaaggcacaagacctactgttcccccttaaacctaggagaggggggaagtggaataaaggggctttttttgcacactactcaatttcccagacatgatggttggcatttaacatgttaccttgttttagccttataagatcagtggtatccttcctccctccctccctttgtcccttcctcccctcccctccctttgcttctctttcttctctttatttctttgtagaggcagggttttctctttgttgctcaggctggtctctaattcctggcctcaagagatcctcctgcctcggcctcccaaagtgctgggattacaggtgtgaactcctgtgcctggcctcattgtttaataaatgaggaaaccaggcgaggttaagagtagaggctggagtgacaggaatgaatggcttcttgaaaggaagagatcttaatttgggttttggagagtggactgggcttaggtaggtcatgagaggaaggcaagagggtaaattgtattgagtaccttttactagacactgagaaaaccactttgcttggagcgtggagggcaggtgagactccatctttttacttctctggacttgtagagtgcttctagcctttccatttatttagttccttaattatatctttttgactggaaattggagtctacaaactcagtcttatgctttgctcctcaaactagacttggagtgattattgctttggtaacatagaagaacaccgagcagctgggagattgggatgggccagcggcttatttatacaatacctttaaccttctgaatagtaccatatgcagaaatagaaacttttaaatgtgagttaattgtccttccacatatatgactagtgttggctagattttgtttttccacacattctatcttaggccaagttagtcttggtctagttgttttaggtcattgcatttagccagagtgtgagtgagcactgtagtcacctaatcgacagttttgggtagaagttcctaacatgatggttgcccacatcaccttaccccctttgaatcaatgactgtattctcagctttttccaaataggaattctgagatttggctttaattggccttgcccacttgtgttctggtaattagcaattgtaaacttaagttatattggttaaagaaacccattgcaggccaggcatggtggctcacacctctaaccccagggatttgggaggccaaggcaggaggatcacttgagcccaggagttcaagactagcctgggcaacatagtgagaccccatctctaccaggaaaaaaaaaatcaactgggtgtggtggtgtggtgcacctgtggtctcaactactggtggagtggggttgctggaggatcacttgagctagggaggttgaggctgcattgagcagtgatagtgccactgcactccagcctggacaacagagtgagaccctgtctcaaaggaaaagaaagaaagaaacccatagaaacttctaatggggttaactatgtcctgtgaaacaataaaagatcctgtcctcaagggaaactccagcagggaatagacatacaacaattttttaatgacctatagtgggtccagacaatttttaaagcagatttagatactttgcttcctgaacatgttttacctagatgtacatttgatattaccccatcgctagtcaatagaaatcagtaacattcatagcataatttgacattcaaagtggatcagtaaacactctcctctatgtagcaaatctttttcagtagtaattatgaagggaatagtatttttagtagcaatggaggtttgccatgttagccaggctagtcttttttattttttgagacagagtctcgctctgttgcccagcctggagtgcagtggcgtgatctcggctcactgcaacctctgcgtctcaggttcaagctattctcccacctcagccacccgaatagcagggattacaggtatgtgccaccatgcccagctaatttttgtatttttagtattgatggagtttcaccttaacctcaggtgaccagcctgcctcagcctcccaaagtgctgggattataggcgtgagccagtgtacccagccaaccagggtaatcttgaactcctggcctcgggtgatccgcccacctcagcctcccaaagtactgggattcaggcatgagccactgcgctgggccagggttaatactttttaacaaagatttttattattattattttttataattttctttttttgagatggagtctcactgttgttggctcagggtggagtgcaatggcatgatctcagctcactgcaacctctgcctcctgggttctagcagttctcctgccttgccttcccagtagctgagattacaggtgcccgctaccacacctataatctttttttttatatatttttgctagaggtggggtttcaccatgttggccaggctggtctcgaactcctgacctcaggtgatccacccgcctcggcctctcaaagtgctgggattataggcgtgagccaccacacatggccaagatatttttttgaacaaagaaagaaacatatgtacatatggcctgtaatgtaataaataaaaattactagcttcttttacagcatcataaatttctattctatttggtaaaaacttctgattttctttttgcaaaaattagcaaaatggccaaatgatagcaaatattgacattatttaatgtattgctttattgtgtgtccagcttgtgaaaatgaggcaggtcaaatattgtccttttgatttcttctggcaacaaaagccagtgtcttttgtcatttctctagaagtctttttgcagctttttcctatatgtttcttttctcttttcttttcttttcgatggagtcttactctgtcgcccaggctggagtgcagtggtgcaatttcagcttactgcaaactctacctcccaggttcaagcggttcttttgcctcagtctcccgagtggctgggattaaaggcacacgccaccacacctgctaaattttgtatttttagtcaagatggatttttgccatgttggccgggctggtctcgaactcctgaccttaggtgatcagcccaccttggcctcccaaaatgctaagattacaggtgcgagccaccatgcctagcctattttatttatttatttatttatttttttttttgagtcgaagtctcacagtgtcgcccgggctagagtgcagtggtgtgatcttggctcactgcaacctccgcctcctgggttcaagcaattctcctgcctcagcctcccaagttagctgggattacaagcgcccgccaccacgcccagctaattttttttttttttttttttttttttttttttttggtatttttagtagtgacgggatttcactatgttggccaggctggtctcaaactactgacctcgtgatccacccaccttggcctcccaaagtgctaggattacagatgtgagccactgtgcccagccagcctattttcttatattttcttgttcacaatttctgtgcagtggtctttggagagttctagttatcttccttgtaggaaacactgttttttaaggaataagtcataaatgtgataacatgtgtcttaaatctgtatcttacgagaatgtacaataaccacaaaaattatttcaaacttagaccaacaaaatatgttttattttaaggcaagaaactgatattatttgaaagtgtgggagggccgggcacggtggctcatgcctgtaatcccagcagtttgggaggctgaggtgggcggatcacctgagatcaggagttagagaccagcctggccaacatggtgaaaccccatctctgctaaaaatacaaaaaatagctgagcgtggtggtgtgcccctgtgatcccagctacttggaaggctgaggcaggagaatcacttgaaccagggaggcagaggttgcggtgagccaacattgcaccactgcactccaacctgggggggacagagcgagactccatctcaggaaaaataaataaataaataagtgtggaatgtggtaatgatcaagagtacacttattttcagccagttttattatggttttaaaattatgtacagaccatgcagcctctcttgtctgtgcttagggcaaactgcttttgctgtatgccacttggcacttgatacgtcactgagtacagttttctttagacagagctagttgtctccctacttgtggacatctctcttcagtctcctttgcaaagtcttcctcattctcttaatattagaattgttcaggttttgattataatccttctcctctctgactgtattctttttcagtagataatcttacaatgtctttctggggctttcaatgcagtctgagtcaggcatggtattgtgggcctgtagtcccacctacttgggaggttgcagcaggagggtcacttgagtccaggagtttgaggctgcaatgagctatgatcatgcagactatgatcactctagtctggtcaacagagccagaccctgtcacaaaaaaaaaaaaacatctatatgccagtgattctcacagattacgatataattctctctgacctaggtttcttatcccctatacatgcatatttagttgcctttttgaggtctgcccattagattttgcacagatacctcaaaccaaagaggaactctaaatcttctgcacatcatctctttcacactcttgtcctccatctcatcaaatgacaccaccatcttctaaaaattagaagcaagaaactcaggtggcatacttggcatccctgttcctccccaacccatctgattaattatctagccatgtttatttctccatccattaacagatggacaaaatggtatgtatgtacagaatattattcagccatgaagaggaatggaatgttgttatatgttacaacaggtgggtcttaaaaacattatgcttagtgaaataaaccaggcatggatggcaaatactgtatgattcaactggtatgaggtacctgaaataggcaaattcatagagacagaaagtagaattgaggttagcaggtgctgaggggaagtgaaagttcttgcataatgggtatagagttttttgcgggaatgaagaaaatattttgggtatagatagtggtgatggttacacattctgaatgtattaaatggcactgaactgtacacttacatatggttaaaatgagaagtattatggtaatgtatattttaccacaattttttttttttttacgaaaaccgtggaaatatagaggttggatttggccaactggctgtactagttgattcctgatataggtcataaagtcttgtcagcgtctactttaggcttctttcatatatttttttggtttctgattctgaattattttagtgaccatcctgagggttcttgatattcttcagtgttggtagtgtatgccacttgcacttgatatgtcgctaagttctctttagacagagctagttgtctccctacctgtggatatacctcttcagtctcctttgcaaagtattcctcagtctttcaatattagaattgctcagatttgggttctgagccccactcaagaagtatttcctcatttgacttccctcactagactgtaagttccttgagagcagatactttgtttctagcttttattcccagtgcccagaacaatgccaggcacataggaggccctcaatatgtgtagaactaatgataataatcatttagcctgtgattcctttatgccatgagttcagtcttctgtctcagcacacttgagacatgccctctggggtagactgcatgtttgtgtctctcccagattcatgtgttgaaatcttaacccccaatgtgatggtattagagggtaggtcctttggaaggtaatttaggtctgagggtagaaccctaatgcatgggattagtgccctataaaagagactccagagtgctagccctctggttctctctatgctatgtgagaagacagtgtgaagatggctatctgcaaaccagggagtaggtcctcaccaagaacaccaccatgctggcaccttgatcttggacttctagcttccgaactgtgggaaataaatgttgccttaagccacctaatctatatttttgttgtagcagcccaaatggattaagacactttcatcagtagcttattcagagtagcactgattctcaacattgctatcattctgtatcagaaatataaaacatggcccacacctgtaatcccagcactttggtaggccaaggcggattgcttcagcccaggagttcgaaaccagcctaggtaacatagtgagaccacatctctacaaaaaataaaattagctgggcatggtggtgcctgtctgtggtcccagctacatgggaggctgaggtgggaggattgcttgaaccttggaggtcaaggctgcagtgagccatgattgctccactgcactccagcctggacaatagagggagactgtgtcaaaaaaaaaagaaaagaaagaaatataaaacatgaggacaaatagctcccttggccaccaaagtatttctgtaccccgtgaaagttttgatgtagaagtagatgtgccaggctagagggatgggcacgtgcagggggtgtcagtaggagcaggcagccctgggaacaggaatgaaattaaagaatttgagtcctgggtttgtgtcttagggtcagtaaccatatttcctgtctctttttcggaatacatccagctatttttttcctaggccccacctaggaatagatagtcttcatctgtgaatggataaccttgggtatattatcactagtgttctttctgaacaagaggcagcagagcttaacagttaagcatataaatcttaggggtagacttcatgagttttttgtatttttagtagagacggggtttcaccgtggtctcgatcatcctgacctcgtgatccgcccgcctcggcttcccaaagtgctgggattacaggcgtgagccaccacgcccggccctcatgagtttacatcagccacttcctagccagttaaccctgagcaggttacttaacctctctgtgcctgcgcattctcctcagtaaaatgaaaaaaatctgtgattccttgtaatgatgtataattatatttcctagaatgaagagtggtggaattagagtcatgtaaagtttacaattgtattcagtgcttttcattgctgagagtgattgaacttgataatgaccacttgaatcaaatggaacctacgttctatcttgatcttcctctcatactccagctttgctctgaggtcagaaagctgtgtgctaagcagttatatgtagtttttggtggttgtagatttcgttttggtttggttgttggtcttgatttttaacactggtggaaaggtaattcaaggtaaaagttgaagccagtttcacttctgaaatattttattttactacttttggtgagacagacaatttgagaagcaaaaacttgcagttagccttgaaaatttcggagtacctatttctaatttaggcatcaaaggtagaagaagacttgtttttggcctctgggcacttctgctctaccttaagaggcaagacccgccaggcactgtggctcccagcactttgggaggccaaggcgggtggatcacgaggtcaagagatcgagaccatcctggccaacatggtgaaaccctgtttctactaaaaatacaaacgattagctgggcatggtggtgtgtgcctgtagtcccagctaatcgggaggtggaggcaggagaatcacttgaacctgggaggcggaggttgcagtgagctgagattgtgccactgcactctagcctgggtgacagagcgagactccgtctcaaaaaaaaaaaagaggcaagaccaacaaaaattcaaactggaatgattgagtctgtcagggaataatctaggagctcaaagaaaaggtaggaatcaagactgaactgataaaatgaacatgccctcaaattctctagaatttgagctagactttggaggggaggctgggttgagaagagaggtggtaagagagagcaaaactcacacttactgaaacctcctgccatgcacttgtgaatttaacccatgagaaaagctggttagaatatagaaggcatgtgcaaaggagaaatagaaggtaagaccaggtatgttgttaaagtgggaccagacagcattggacccagaatgccagattgaaataatttacagcagcactgaagggattataccatgggtgagaatatatcagctatattttctgtgccagtttatcctttgcagtatcactagagaaaataattgtgaaaatcaattaagaaactactacagtcatttaggtttgagataataggaaataagttgatggcagtggatcaaagagggaagactggtgttttttgtttgtttgtttgtttgttttgagacggggtcttgctctgttgcccagggtggagtgcagtctcggctcactgcaacctccacttcccgggtttaagcaattctcttgccgcagcctcccgagtagctgggcttacaggcgcccgccaccacacctggctaatttttgtatttttagtagagttggggtttcatcatgttggccaggctggtcttgaactcccaaaatgctgggattacaggcatgagccactgtggcctggccgagagatcttttaaaggggatcaataggatttggtgtctgagatatgggaaatgaattatatggggtctgaatatatgaatatatatatatatatacacacacacacacacatatatgtattttttttttttcttttttgagacagagtctcgctctgtcacccaggctggagtacagtggcacaatctctgctcactgcaagctctgcctcccaggttcaagcgattctcctgcctcagcctcctgagtagccaggactacaggtgcccgccaccacgcctggctaagtttttgtattttagtagagacagggtatcattgtattagccaggatggtctcgatctcctgacctcgtgatccacctgcctcggcctcccaaagtgctgggattacaggtgtgagccaccgtgcctggtccttttttttttttttttttttttttttttggaggcagagtcttgctctagactgaagttgcagtgacgcagtgacgtggtcacggctcactacagcctcgacctcctgggctcaagtgattgtcttgcctcagcttcccaagtagctgggactacaggcatgcaccccatgcctggctaattttaatttttttgtggagatggggtctctccctttattgcccaggctggtctaggaacttctgggcttaagtgatcctcctgtcttgatctcccagagtgctgggattacaggcatgagccactgcacctggcctattttttgtaacctgttggatatgagatgatagtaagacatacaaatagagatgtcgtacatttctttgaacatatgcttatttatttttattttttgctttgtttttttgagacagactctcactctgtcactcaggctggagggcattggcatgatctcagctcactgcaaactctgcctcccagttcaagcaattctcctgcctcagcctcctgagtagctggtattacaggcatgcaccaccatgcctggctaatttttgtatttttaagtagagatggggtttcgccgtgttggccaggctggtctcaaactcctgattgcaagcaatccaccgcctcggccttccaaagtgctgggattataggcatgaaccactggtgctgggccgaacatatatttgttgagggccagctatgtgcagattttgaacaaggctctgtaaatgcacgggatcaaaactgaccaacctccatgtccatatgcagcttacagtctagtgggaggatgacaaaaatcacacagctataattacaaattttagtcaatggaaattgcatgaataaacaccttgaggttagggtagatgggccatgatacaactggggagctaaagggccaaaatagaggagtgaagagggaggaggctggagaggtagcaagagactagctaagaggtgaaggctatgaaatcagatttgaatcagcaccactgaattggtagttgccaggaaatgtgtgtggtgtgagtgaaaagccgaaatctaggctgggtgtggtggctcatgcctgtaatacgaggactttaggaggccaaggcaggaggatcgcttgagtgcatgtgttccagaccagcctgggtaacattgtgagaccctgtctctacaataaataaaaataattagctgggtgtggtggcacctgcctgtagtcccagctactcaggaggctgaggtggggggattgcttgagcccaggagtttgaggctgaatgagccgtgattgtgattgggccactgcaccactgcactccagcctgggtgacagagtgagaccgttctccaaaaaaaaaaaagggagaggggagaacaaattgagctggtggctataaatcaccccatttaagaagttactggtgaaagcagtttttgtagtttttaaaatctatttactcagctaaagataatctcatgatgtgtttcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctaggtaagttataagaactttcctttcttttaattatagaaagtgcttgagtcttgccagctatgttttcctgtgcctaagtcaaaatggtggtttgtattctttctctagggaaattcctgaaaacaaaagcagtcagttttatttgtttgttttttgtttcctttttttgagatggagcctcgctctgttgcccagactggagtgcagtggtgcgatctcgactcactgcagcctctgcctcccgggttcaagcaattctgacagtcagttttatttttagtagtaactatgctattaatgtgagtggcagcattttagatccttgcagtaagatgaagcaaatacccttaaataggcattgcatttgagtaaataaaattgcacgtaatttgttttggaatagatatcttccacactgccttatggcttcttggtacacattttattttttatttttttgagacaagagtcttgcttgttgcccaggctggagtgcagtggtgcaatctcagctcactgcaacctccacctccctggttcaagcgattctcctgcctcagcctcccaagtagctgggattacatgcgtgtgccaccacgcccagccaatttttgtgtgtttagtagagacagggtttcatcctgttggccagtctggtctcgaaccagtcctggcctcaagtgatccgcctgccttggcctcccaaagtgctaggatacaggcatgagccactgtgcccagcctgtagtacacattttaaatttgggtgtgttgtattggtctatgctgctggagacctgggtctgtacttgactcatccagctgaccactggaaaggatttcataaattcgtgtttgtcttgtcatcagttaagctcctggtatgttaatttaagctggcatgacaggaggagatcaagtatttatggcttggacatggcgagcagtggagaaactctgaacccattggttgggtgtgtttgttttgcctaaagtgggctgggttcttatagaagcctactttttgtgttactttctagtactgtttggcagtttgtacaaggagctgaaaataccacaaagatgtaaacttttaagttaaatgaactaataaactctggagcagaaagcctaatgcctttccatacctgaggttggttggaacctggaatagctcaggaaatttcggcaagggcaggatcaagaagaaagaaatccttttgatcttgcacattctaagaacagagtgggttgctttttttttttcttttgagagcagagtggtagaggtggagaccgttcagtgtcctggcttccttcttggccctgccgaaaacaaggtgggcagttcctgccacctggagctcgtttccccacctgtcaaatgggcgttaagaattccattgtggtttgatacatggaggttctcactgtgttgcccaggctggagtgcagtagcatgatgatagctcactacagcctcaagcaatcctcctgccacacctcccgagtagctggaactacaggtgtgtgccaccatgcctggctaatttttttattttattttattttattttttgtagagatggagtctcactatgttgcccaggctggcctcaaactcctggcctcaagtgatcctcctgcctcggtctctcaaattgttgggatgacaggtatgagccactgcacatggcccaagagtttttgtttgttagttttgttttttgagatggattttcactcatctcccaggctggagtgcagtggtatgacctcggctcactgcaacccccacctcctgggttcaagcgattctcctacctcagccccccaagtagctgggattacaggtgcatgccaccatgcctggctgatttttgtgtttttagtagagacggagtttcaccatgttggccagcctggtctcgaactcctgacctaaagtgatccacccaccttggcttcccaaaatgattatagacgtgagccactgcacccagctggccctagagttttgatagagatggagggtttactgggaattagggcgcttccagggaaatgactggagttgaggtaaactggaaccagatcattaagggcgatgaatcctaggccaggctgtgcagacatttctcatatgcagtgggcagctactgcagactttgagctggggagaaggggctgtgtgagtagagcgttaacttgggagaagtcctttgcagctgtctgtgcaggctagattcatacaggcacaggaaatgagagaggtcagttgaacaagagttaatgaaggcctgagttagaattgtggcagtcagataacaaaggaataaatgtgatagaaattacaagagaccagctgggctctgtggctcaagcctgtaacctcaacactttgggaagctgaggtgggatcgcttgaggccaggagtttgagaccagcctgggcaaaatgatgagactccatctctaaaagctcagtttggtgatatgcagctagcttcttgggaggctgagtgggaggatcgtttgaacatgggaggtcaaagctgcagtgagctcatgccactgccctccagcttgggtgacagagcaaaattgtctctaaaaaagaaggaaactgaaccaggcatggtggctcacgcctgtaatcccagcactttgggaggctgaggtgggtggatcgcctgaggtcaggagttcaagaccagcctggccaacatagtgaaaccccatctctactaaaatacaaaaacgtagctgggcttgatggcaggcgcctgtaatcccagctactagggaggctgaggcaggagaattgcttgaacccaggagggggaggttgcagtgagctgagatcacgtcatcgcactccagcctgggcaacaagagggaaactccttccccgcctcccccaccaaaaaaaaagagaaagaaaaaaactacaaaagataatggaaaagatttagaaacagactgtgtgctcagttgggggcaggggggaggagtaagagcatgcttaccgttttgatgcttttagccactgctcattagatgactccagccccaacttacttcctaaaaaccacctcaagtccaacatggatgttttattattaacagcatctcaaaccaaatactgactactctgagccccaaaccagaacactgaagctttttttttttttttttttgagatggagtctcactctgtcgcccaggctggagtgcagtggcacgacctcggctcactgcagcctcttccacccgggttcaagtgatctcatgcctcagcctcccaagtagctgggattacaggcgcctgccaccgtacccggctaatttttgtatttttcatagagacaaggtttcaccatcttggccaggctggtcttgaactcctaacctcatgatccacccgcctcggcctcccaaagggctgggattacaggtgtgagccaccgtgcctggccttttgaaactttaaattacaattgtgattctcccgtgtccacatggctggggaggcctcagaatcatggcaggaggcaaaaggcatttcttacttggtggcggcaagagaaaaatgaggtagaagcaaaagtggaaacccctgataaacccatctcagatctcgtgagacttactatcatgagaataacatgggaaagattggtccccatgattcagttacctccccccgggtcccacctacaacatgtgggaatcctgggagatagaattcaagttgagatttgggtgaggacgcagcgaaaccatgtcagagggtaagaggtcccagtggcagagtaaaagcatcattcagacaaatagaaggagactcaggaggtacgagagagaggaataaaacctctttggattatacattgtgaaggagttgcagtggaggggcggagggctgaaggaaaggttttgaagagagagggaatctatgggtggtgagcagtaaagccattaggtgttggtgacccttggcactgctcaccctccttggagcattggagcagctgatctaaaagtttgtccccagtcttctgagcagaaaatccagggacacatgttactgttgggaaggtaacatggctaccttagaccatactccttaagaaagggaccacccacagagactggcacccgggtaccagatagccatccaaaacaccagggctgaagaacccaaaagtttcagtaagataggccatcaagtggaaagaatgatagacctgaatgagacttttcttcagtagcaggggataattagagacaataaaacaatgctttgagaggagaaattactgtaaacatagagttattgatccagcaaagctatcaagtcagatacaaggtcaagagatgacaattttagagacccaaggattcatgttgcatgcaccctttctgaggaggtaatttgaagatataatacagcgaaatgaggatgaacatcagaaggaagatttcctagtgcacgacaaccaagaggacagctgtgtagcaggctggaaaatgtattccatttagaatagaaagttggctggctgtaagaatttcttaaggaaaagtcagtttcattcagtagtgggtagagtgagtaagaagcttggtggtatggaaaagggtcttctgaaaaagaaaaagaaaaggcaatcggaaactccatgaaaaggggtgagggagtagggcaaagaaagctgtagcctgaaaaatggggcctaattttgacagtattgaaagagagagcttctttgacctgactctgggaagattttctccttgcagctcctatgttgtatacttgtagagcattaagtgtgatcctagcacactgttgagccccacagtaaataatatttgcataatcacaatatgaatgtaaatagcatttcttttattagcctgttaaaagatttcatttgtgtatagaaaagaatgaaatcttgctcgccttgacagtgtaaaaagtaaagttacagagtttgggccctgtgaggtgggtcaagggttgggctccctctcatccacattctacatagtagcttttttttttttaaatggagtcttgctctgtcgccaggctggagtgcagtggtatgatctcagctcactgcagcctctgcctcctgggttcaagcaattcttctgcctcagccttccgagtagctgggactacaggtgcccgccactacgcccggctaatttttgtatttttagtagagacagggtttcaccatgttggccaagatggtctcgatctctcgacctcgtgatccacccacctcggcctcccaaagtgctgggattacaggcgtgagccactgcgcccggcctctaacatagtagctcttgaagctcatgttcatctgaacaaatatctgtaattggacagtggtgttggtgagaactgtttgcacctaggtgccctgttttgttagatcttcacgttttgaggatgtgtgtaacagttgagtgggattttctggaggctcaggaattgatgcccgggactctgagagcagaagatacagaggcaccaagagttttaaactcttgggggccagaccacatcttcgctaattacggcccatagaacttgtcctgctggcctccagtcttcgcccccagcactcacagtggcattagagccgcagctgttggcttaaggtagaatgtaagctgcttttctgtctcctctgtgcactggggtgatggggtgctggactggacttgaaactgtccaaagagtatttcaggctcatgctgcactcagcctagactgcctagtaaatcagttacatacgcacatgggcaaaatataagccataatgactttaattggaaagtctgacattgggaaggtggacagtctatggatgactttttttcccgaaatgtctgttcagtaaacattttgaaaagtggtcagtgagtggtccagtgagttctgtttcctgtaaagtgaccacctttgtatgtgtttcactaaataaagttagacctttgaaaacctttggtctagaaagattagaatggttaggccaatcccaaatgggtatttttgttgctgttcactacttaccctgagactttcacaatattaatgtatagatgaaatgtgataatggagatgaaaatacctcacaactcttcagtatcatcacatgaatattaatatttaagagataattcattgaacaaactttatttgtctaaggcaatattatcttttcacaaagaagggaggtgaatcatgcttgcaaatgacagccgtattacgcaggaacttctgtcccaatagcacagatcagaggatggttctggtctggaagtcagctaaccttgttttgtatggaagaggcttattttcattaaagagtcacttgtccaaaaatgtttcatctccctttctgggatatttgcagatctgttggttagaacttcggtttacacaatgctctgctgatactgtgccagaagtttgggttctgaagtccacaatctttacaacgttcttcccacatatgccagaatgagctattataaatcgggcagtcatgtcattgggagtgtattctccctctctatttgacaggaaacttgagttgttgggtgtctgactcctccatataacatgtactgcgttgaggggtgtgttcctcctagtgccatgctttctccagtttctcagtcctttatcgaagggtggttaagaatgaactcatttttagctagacccatttcacacatagccaatggtaataagagctatcatttcccaggtgcttaacatacagctcttaagtaggtagcattatacctttttacagaataagaaaccgaggccgagaagttacagtttgctcaaggtcatgcagctagtagaagtcacctccaagtcacacatcccatactgcctcattcataatgtctatgctgttgtcatcattgtctccaggttcaaaaggactctctgggttcaaaagtgtccgttggtgaatggaagacttaaatcttagttacttctgaatagttgaggagggtgagaagatgttctcagtggtagtatatgatttttactgtttactcgcaaaatgaaacactgttttaacctaagtatatttttgaaaaatgacttttttcattgttggcattcaaataaaatcttaaaagtaccaacgtatactgctgcatttgccactctgtgtgaaggaggatgatttgccaaggagcttaagagtggctgcatttaaatcttccacttactccttaagtccaagggtatttgtccaaatgcattttaaactctcattctaaaattaaatatatttctaaatactagcacacattttgaaaatgacattttaagaaaaaataataccacttataataacaaaccaagagttgggtaaatggtacctgagactgttctctttactttgggggcgtatttgaaaatttccatgataaaatatcttttaaaaaattaagtggccaggcgcggtggctcatgcctgtaatcccagcactttgcgaggctgaggcaggtggatcacgaggtcaggagatcgagaccatcctggctagcacggtaaaaccccgtctctactaaaaatacaaaaaaattagcctggtgtggtggcaggcgcctgtagtcccagctactcaggaggctgaggcaggagaatggcctgaacctgggaggcggggcttgcagtgagccaagattgcaccactgcactccagcctgggcgacagagcaagactctgtctcaaaaaaaaaaaaaaaaaaaaaaaaaaaattaagttactaggaataactctagcaaaatgtatgggaggccgggtgccgtggctcatgcctgtaatcctagcactttgggaggccgaggtaggtggatcacctgaggtcaagagttccagaccagcctgaccaacatggtgaaaccccgtctctactaaaaatacaaaaaaaaaaaaaaaaaatagccaggcatggtggcacgcgcctgtaatcccagctactcaggaggctgaggcaggagaatcgcttgaacccaggaggcggaggttgcagtgagccaagatcaaaccacttcactccagcctgggcaaaagagtgaaactccatctcaaaaaagaaaagaaaagaaaatgtatgagagaggaccttactaagccatgtttactaagatttaatttgcatatggtaaagtctaccccccttttaggtatgtatgtactattctgtgaatttggacaaacagtcatgtagccatcttcacactcaacacagaatgtttccaaggagtcctaggcaggtggattgcttgagctcaggagttgagaatagtctgggcaacatggtgaaaccacatctctacaaaaacaaaataaaacaatgtttcagtagaattttcaaagaataagtgttcactcttaattgggaacattaaaacttaaaaaaaaaaaataggctgggcgcggtggctcacgcctgtaatccccgcactttgggaggccaaggcgggcggatcacgaggtcaggagatcgagaccatcctggctaacaaggtaagaaaccccgtctctgctaaaaatacaaaatattagccgggcgtagtggcggacacctgtagtcccaactactcgggaggctgaggcaggagaatggcatgaacctgggaggcagagcttgcagtgagctgagattgcgccactgcactccagcctgggcgacagagcgagactctgcctcaaaaaataaataaataaattaaattaaattaaaaataaataatgtttgagtggaatagagacctttcatatcaatcactgttattttccaaactgatgtaacctcaaggtggcgcagtggcaccaaacttttgttctacctgattttgtgaactcaggccagaactccaggatttatttgtatttaagataagaaaggctagttcagagtcctgtttacaacaggcacttaaaaaaacttgctaactggtattacaggttgagcatcctttattcaaaatgcttaggaacagtagcactttggattttggggttttgcatatgcataatgagttatcttaaggctaggactcgggtttaaatacgaaatttgaaattcatttgtgtttcattacaccttatacacatagcctgaaggcaattctgtacttttttttttttgaaacaaggtctcgttctgtcaccgaagttggatcgcagcctcaaattacaaggctgaaaggattctacctcctcagcctcccaagtagctgggactgtaggcatgtgccaccacgcctggctaactttttattttttttagagacggggtgttgctttattgccccggctgttatacagtattttaaataattttgtacacgaaacaaagttttcactgtgaccctatcacacgagtgcatcatgttagcactcagatagtttcagattttggattttggatgttagggatgctcaatctataatccatttacgagaaaggacgaatatctacagggttgggaagggggaggacactgaattgaaaatgttctcgtgggtgggcggatcacgaggtcaggagatcaagaccatcctggctaacatggtgaaaccccatctctacaaaaatacaaaaaaattagccgggcatggtggcgggcgcctgtagtcccagctactcaggaggctgagacaggagaatggcatgaacctgggaggcggagcttgcagtgagccgagatagcgccactgcactccagcctgggtgacagagtgagactctgtctcaaaaaaaaaaaaaagaaagaaaaggaaaagagaaaatgttctcgtagaatttaaaataacaaatatgtatagtatcggaccaactccatggagataagtgatagttaccagatctgttgttcctcatatactcctagggctggaaagtttaaccaatgatttcatgtgttcaggttacagatcaggtcatccttttcccagattataagtgaagaaggacattgttagggccttcacaaacttaaaagatcacagaattaatttttttttaaggagtattttttttgtaacaaaagagtggtggtaaattagctcttgcttttaaggattcacttaggtgggctttttttttttcgactttgactttttaaaaaatttcaatagcttttggtgtataagtggtttttggttacatggatgaattctatattgatgaattctgaggtccgagtgcacccctcgccagagcagtgtacactgtatccggtatgtagtcttttatcccacaccattctttccctactaagtccccaaagtccattatatcacttgtatcctcatagcttagttcccacttataagtgaggacataccgcgtttgattttccattcctgagttacttcactcagagtagtggcccccagctagttttttgttgttttttttttgtttttttttttttgagacggtatttccttcttgccgcctaggctggagtgcagtggcacgatcccggctcacggcaacctccgcctctctggctgaagcaattctcctccctcagcctcctcctaagtagctgggattacaggcatctgccaccacacccggctaatttttgtatttttagtagagatggggtttcaccatgttggccaacatagtgtcaaactcctggcctcaagtgatccatctacctcggcctcccaaagtgctgggattacaggtgtgagccactacgcccagctatggttttttaaattattattttatttatttttttaaatccaatacagagtttcgttctgtcacttaggctggaatgcagtgacacagtcatggcttactgcagccttgaccttctgggctcaagtgatcttactgccttcggcttcccgagtggttgggactatcgacacacaccaccatgcctggctgattttgggggattttttgtttgtttgttcatttgtttttgatagagacagggttttgtccatgttgcccaggcttaatttttttattttttgtagagacagagtctcactgtgtttcccaggctggtcttgaactcctgggctcaagcaatcctcccagtttggcctcccaaagtgctgggattacaggcgtgacccaccacacccggctgatttatttatttattaaatatgaaccatcatggaggggtgtgagaggggtaaaactagggacaaaaagaaaatctgtttccgagatttaaatttattctctagtttttttaggaacgcttaatttctcacccccctaccacacacagatctatagggaatatttggagagaaagttttgacaaaagtccaaagcttgattcagtggagaagcaggtaggtaagttaccaaaccaggaggctctctggacagtaatttcacctggggctctgccagacggttaccacattaccaggactcttggtacaaatgagaacttccaagcccccatccagaagtagggtaacagtatgagagtatgtggtgttcccatctgtccaccaggccctaggagctctctccccaaagtaactggtgctaatggtttgtcgtgtgtccttccagagatatttgatatttaatatctataaatcttgatttaaaaggactcttctgtaccctttaaaatgatatattttaaagatcattcgtgtcagtactaattggacccatttcgtgtatagagatggatattttaggacactcctgtgttcaccgcttctttttcataaggcaccttcatcatcgcagcagctgcctttggaaatcttcccttgcctctcacaaggagattcatctgattgtctgagttgattttttgtgtttttttaaagggtttggagttaagaacaggtatgtgaatcacacagatcatagtgccattctaagctgcaccagcttattagctatgagactgtaggcggcaactcgatgtttctagcctgagcatccttatctgtaagatgggaagagtgcttcacagtcattggtacttagtgaatgcaagttgtctcatcctttctgcttcatggaaatgtatcataattttagtttgggtacctataaggaaagcattttagggactatatgatttatgccagttgagtctacccactcctacaaatctgtctgtctctctttttcttttgataagaatgaagccaagaaaaattaaagaagatgatgctccaagaacaatagcttgccctcataaagtaagtaatgctagagggagagtgttcattaaactgttgatgaagttttagagagttataagaaatttgcacttttgtttctgcttgtgataatttaaatgaagcaaggaattagaatcttcggtttctaaatccaagagatgaagttttgttatttagtaaaggcaactttttaaatactgttaaatgggatgactgcagggagccgttgcttgattactgtgtgttgactctactgttagcgtttcatttctttttggattatattaacaagtccgtcttaagatcctgggttgtgtctcacctattgacctttatgggaatgtaggcttgtaactgaaatttgaaaattattttggatgttgctaaaataagccaaataaagacttaataattgtgtgtgattagagaggcacttaattgttttcaaatgtagttagtctttaaaataaaaggataacctgaaaagtacttttgagatatttgttgggggctattttcaaacttaattggatatgagactaacagaaaaatcaagtatcacataggtacagagaacaaagtaggagagattgagtggaataaagaatgttaaaaatgaacaatcggagcaggctacatttagtttcacggtctcttccctgtaatgactgtgcactagcaagtccttcctgttctttgtcagcgttcttgatgtggcgatttgaaatgtaaacgtatctccattagggccgaaataacaagcatttgaaaacagttaggctggaagtgcctatgccatccctttagcttctctgaagttttctttataatggacacataatacttgtacatatttatggggtaccgtgtgatgtttcaatgcatgtatacattgtgtaccagttaaattttttaaatttccattttctaaatggaaattcaacctaggggtaaaggcggaaaaactggggcttccctctcccttctgcctgtgagctgtctagtgacttgtgctgtccttctgtcatgctgtcttatcatttccccattcactccattactgggcaacaactgcagaagaaattgttgaggacatgcttctcgagcgccacacatccatctgcctttcccgccctgcactggtatcaatttgcctgcttcttccttttcctagtgtctcacaaaataaatttcttctgtagttgccattccttggagaccctcttgcttctttctctgtcaagaaggggaaagaggcaaagagagaagagggaacagtaggcgatggagaatgacagtccattgttgcagcacagaatatggggccaccaaaggtagtggtggactaccgtcattttaactccatttgcttagcagtgcttctgttacttcattttgggggacatagtcgggtgaggtggctgtggtagagctggaagccagggtgttgggttctattcccagtttggctactactagtagtgtgaccttgggcaagtctacttaaagacatctctaagcctcagtttcctcatctgtaaaactagggtttgcattgaatgatgactttttcagctgtctgctttttgtcttaaatgatattaatgttctaccgtaatactaagtaaaattaaaatggggggttggggaggtggttttgttttaatatgtcagtaaaggctgttaaatggttgaatcctttctaacagtttgcaatgtgaacttctaagctgctttctctgttttaagggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcaggtagagccagttccctctcttccccacactgccttgcctgtctgaacactgcaagtgtaggtggtgtggtgatgaggcaggaggcgccagcccagagactcagggtcttattactccttggtgagaaacaaaacttctcctggggagtcgcttagaagggttgccggggctctggacatccttgtctatactctgtggtactgggtacgcaatgtattggtgttgatggagtacactttatggcaggaggagaacaggattgaagagcatacctaaaactcaatttctacttcattcattacaggattgaagtaatttatttttggtagttaatagtataattactaactgataaagtttctagagtgtaagtataggtaatactttagcccataaataagtgaaagaactagcagtgcagctagtaaatctaacgtggttcttttttgacaactgacaccagaacccttaatcatttgtattttactgttggaaatgtttacagcagcactaggactctagcctgcatttaggaagacttgccattttgccaagtgttttaaacagttcgtgagggctctccttgggttttcggggttgtccaacctgcctgctgattctagactatatccacaaagttcacccagggcaggaatgaaaagtgtttggtaaaataaataggctgttctctagcaaagcagtgagctcctgactcccagggtctggtcagagttgctgagtgggttgatctctggtctttccttgacagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggag

SEQ ID NO: 13905 - DNA, 69813 bp, Human; identical to SEQ ID NO: 12455

SEQ ID NO: 13906 - DNA, 69813 bp, Human; identical to SEQ ID NO: 12455

SEQ ID NO: 13907 - DNA, 35840 bp, Human; identical to SEQ ID NO: 12156

SEQ ID NO: 13908 - DNA, 35840 bp, Human; identical to SEQ ID NO: 12156

SEQ ID NO: 13909 - DNA, 44789 bp, Human
cagctaatttttgtttttttagtaaagaaggggtttcaccatgttgcccaggctggtcttgaattcctgggctcaagcaatctggctgtcttggcctcccaaagtactgggattacaggcatgaaccaccgcacccagctcatctgaatgctgttgatttattaatatcttttcccagcacagacgcatagcctgctctttgtcgtccattgacattcgtgacattccttctctcccacccctttgccccctgcagggaaccccctgccagcctagggttacacctgccacccactcctctggagcctaatcagctgggagaaggctcctgggtccctgtctaaggtcttttttttctttttttttttttttgagacagagtttcgctctgtcgcctaggctggagtgcagtggttcaatcttggctcactgcaaactcagtctcctgggttcaagtgattctactgcctcagcctcctgagtagctgggattacaggcgcgcgccaccacgcctggctaatttttgtattttagtagagacagagtttcaccatgttggtcaagctggtcttgaactcctgaccttgtgatccgctcgcctcagcctcccaaagtgctgggattacaggtgtgagccaccgtgcccggcctctgtctgaggtttcttccaaggaaggaaggatttttgttcagaggtggctgcccctgtctgacatctggtccaggagcccttactctagagaccgttgagttgtttgttgggctttgggtatctgtgaagaggccctaaaaactttcatcgattcgtttactcatttaacaattaatctctctagggtgtggtggctcagcctgtaatcccagcactttgggaggccaaggcgggtggatcatctgagggtgggagttcaagaccagcctgaccaacatggagaaaccccacctctactaaaaatacaaaattagctgggcatggtggcacatgcctgtaatcccagctactcgggaggctgaggcaggagaattgcttgaacccgggaggcggaggttgccgtgaccccagatctcgccgttgcactccagcctgggcaacaagagtgaaactctgtctcaaaaaaaaggtagaaaaattagccagggatggtggctcaggcctgtgatcccacctacttgggaggctgagatgggaggatcgcttgagcccgggaggtcgaggctgcagcaagcggtgatcacgccactgcactccagcctgggcaactgaaagcaaccttgtctcaaaaaaatgaaaaaaaaaaaacaaaaaacaaaaaaacctcagaagcaagactttccttggctcagaggtttgcctcccagggacacaaagggagatcaagtgattgccttttggggagagtggagacgggcttcctgcatttccagtgcctgggtgggccacgtaggggtgtccgtgtctctgaacgcatccgtgcccaccctcaccccttgggttttgggaaggactaatgaaatcatgaaaactgacttccttggggcttgacctggggctgctctaagtgcgctacaggtaacgccattaacccgtgcaagacccaatgaacagacgctatcataagccccacttttcaggcgagcaaacaggggctcgtggctatcgatgccatggagccttggcccagaacctggggtctagaaatcgtggcctctctctcctctcaccgccctctttctggtcggagtgaaccccccagagaagggagggagacggcagggcctgacggaagccccgggagctgcacagagaggcggagggagctgccctaataaggagaggcccggacttgggcatatctgcagaaaaacccttccccactaggcaggcgcgggggagggcgtggaggggcggggtggtgccgcccccggggcgggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggagggtgagggagcgaaggccgggggcgggagcgcggatccgggcgggagggctggtgtcgggctgcctccctgggaacgacctgaatgggaggcctgggctggagagggagtctgggttccggctccttgtccacttaatcgctggtgacttgaacaaatcacttcccctcttggggctgcggttcctgcttcgggaaggaaagggtgacagctgagtcccattcagcacagaaaggctcaaataataatagttttcataataataaccgacaatggctattctgcccagtgctcactatgggccaggcatcagttaggcatgattgctaccctggtaagtgtttccttctattatccccgttttccagctgggcaaactgaggctccagagttcattcacttgcccaagatcatacaacttgtgggccttggaaccaggatttaccccacccacccaggtgtctggttccagagccaggaggcctcatgaccatgggaatgaggggtcttgagggggacaggggaggaatgggggtagaaggtgtggctcactttgtggataagtttgtgctttcatccatgtcccctgtggtctgcttagcccctgccagggtggtcttcctctctgcagtttattttttttattttacttaatgtattatttatttagttatttatttatttttgagacagagtcttgctctgtcgcccaggctggaacgcagtatgcgatctcggcttactgcaacctctgcctcccaggtaaaagcaattcttttttttttttttgagatggagtctcgctctgtcgcccaggctggaatgcagtggcacaatctcagctcactgcaacctccacctcccaggttcaagtgtttctcctgcctcggcctcccaagtagctgggattacaggcacgtgccaccatgcctagctaatttttgtatttttagttgagatggggtttcaccatgctggccaggctggtcttgaacttctgacctcttgatccgctggcctcagcctcccaaaatgtttggattacaggcgtgagccatcgcgcccggccggttcaagcgactcctgtacctcagcctcccaggtaggtgggatcacagacatgtgccaccatgcccagctaatttttgtatttttggtggagatggggtttcaccatgttggccaggctggtcttgaactcttgacctcaggtgatcagcccaccttggtctcccaaagtgttgggattacaggcgtgagccaccacacctggccctctctgcagtttatacttgaggaaactgaggcccagacaggtgaagtgactgtccagggtggtccagacagaggtggttggtccgaggtcagctgggctccagtctagcgctctttctacttcctcaaggcagattggattgcagtgtgtgccccactgtcctgagtgggtgcttccctcctccccagccctccctggcatgggccatctccagggctgtcccgagaagggcatagactgcggacagtcccagcaaagccaagcagaagtggcggtactttccatggcattctcctccttcagcttaccctcctggagaacctgaaactgtatcaccagaaggatcccgggttctttgggtcaggaatgggaaccaccatttattttattttatttatttaatttttttttgagacagtgtttcactgtgtcccccaggctggagtgcagtagcatgaccttggctcactgcaacctctgtctcctgggttcaagcaattctcgtgcgtcagcctcccaagtagctgggattacaggcctgcaccaccacgcccagctaatttttgtatctttagaagagacgaggtttcgccatgttggccaggctggtttcaaactcctgacctcaagtgatcctcctgcctcggcctcccaaagtgctgggattacaggtgggagccactgcacccagccaggaaccaccatttcttttcttttctttctttttttttttttgaggcagagtttcactcccgttgcccaggctggagtccaatggtgcgatctcagctcactgcaacctccgcctcccaggttcaagcgattctcctgcctcaatctccctagtggctgggattacaggcggatgccacaacgctcagctaatgtttgtatttttagtagagacggggtttcaccatgttggtcaggctggtttcaaactcttgatctcaggtgatccgcctacctcggcctcccaaagtaccgggattacaggcgtgagccaccgcgcccggccaggaactgccatttcttgagtacctccctcggaccaggttgtgcccaaggccccacgtctcccagtggtaaagccggcggtgcttgctctctgtgaggcttggtgttctagcctgcaagacccggtgatactacctcacgcctggagctctaacaagaattccaggggatgaagttggggagagttcagctcaatgcctggcccatgaaaggccctcggcaaagggcattttctctcccagtcccagggctgctggcttacagcagggcagtaagacagctcagaaagtccagtgatggaaacgctgaccaccgggctgtgcaaagggctctcggcctgggtcccctcactggccaggagccctgttgtggcctagttttctgggcctttgatccccctgcttctgctgacatggggtgcctgcatcccagaccatcccaggagagaaaccgcagctgcccatgatgaagcccggtgagttgaattgaagagggaccagactgatgacagggcgttaggcaccctgatccccagcaagtgacaggaggagggcagagcagatccaaggaagccttcacagagggtgctgctatgggcggaggacaggatcagtgtgctactgaggtaacccaggtagagcacctggtaggtagaaagcacatctgtgctcactgatgcacaagagagcagatccccaggcctggggctaatgtcaggccagtctgagttgggccctttgcttcccttctccatttggatccctccctgttttccatttttttttttttttttaagttttcattttctttttttttttttctttgagacagagtctcgctttgtcgcccaggctggagtgcagtggcacgatctcagcgcactgcagcctccacctccagggttcaagcgattctcctgtctcagcctcccaagtagctgggatcacaggcatgcaccaccatgcctggctaatttttgtatttttagtagagacggggttttgcaatgttagccaggctggtctcaatcctgacctcaagcgatttgcccaccttggcttcccaaagtgctgggattacaggcctgagccaccacgcccggccaggatccctttgctaagtaagaaatcatcaactccattttggagatgggaagactgaggtcctggtaggttaaacatctggtctctcattgccagagctggttggaggtggggtcattgtctggaactcagacctactgttcatttctgcacctctggacgggaagggggtgctgttgcctggaaatgctgcctgggggagcctgctcagctcccccagacccagctgaggtgtgacctttagccagctggacaggaggacagagtgggttgctcatcttccctgcaggtcttgcctgagcatcccactgactagtgtgtgtgtttggtggggggtaccccagcagcccccaaagaggccagctcttccctttccctggcagatggatgggaggaggcagctactgaggtggattcagctggagtagggaaggggatttgctgtggagtctcggggagtgagatgggtggggtgctgtcagcagcttgtctgtcccctcacccaaaacgcatggccttggtgcatggagagaaacatggaccgttttcacttttgggggctcccaatgagaggggggtacagagcacctcacttcagtagacaccccacgtctgagggaagagatgttgcgccatcctgggggggcttccagaacaagatgggagacacaagaaggcttcaacaaagcaatatcttccatcacagggaactgggagaataaaaggcaacatccaaacaggcagatatccctagagccgaggtcagatgtcccacagcccttcctcccgtttgtagaaacttctagcagatctccagctcctgcctttccctgtgggccttgatttggccgtggtgagagaaggacagctgcagagatcagaggctcagctggccgttcaggtcatgctgttccctactagagaacagaagggtcccaggagtcagtcaggctgcactggatggtgtgggggtggggccgggtctggggagacctaagtgggcagctggccccggggaggctaaggttggctcccacgtgcagggcatcccaagctcctgccagaccctgttcctggcttcagttcaagcctggggtggggatgaaggatgggggaggggagagggcggaagggcttcattcattcccgcctccccagggagcagactgggtgtgtcatgactgtgccttgactcaggccacacagtgaccacccacgccttgggctgggactgcttggggaggagggggcatccggtggcacagtcaaaccaggggtgcccagaggtcccattcttccaggagctcatcacatacgcacaccccaaccaagccctcaccgtcagtctctccacatcattctttttctttttctttttttgagatggagtctcgctcacctagtctggagtgaaatggcatgatctcagctcactgcaacctctgccccctgggttcaagcagttctcctgcctcagtctcccgagtagctgggattacaggcgcccaccatcatgcccagctaatttttgtatttttagtagagatggggtttcgccatgttggccaggctggtctcgagctcctgacctcatgtgatccacccgccttggcctcccaaagtgctaggattacaggtgtgagccaccgcacacatcattcttctcttaaaagtttttctaaattttatttttttgtacagacagggtctcactgtgttgccccggctggtcttgaaccctcaggctcaagtgatcatccccaccttggccccccaaagaccgggattacaggtgtgagccactgcacctggctaattcctgtggcccagtagcatgactatagctcactgcagccttcacctcctgggctcaagcaatcctcctgcctcagcttcctgagtagctgggcctagaggtgcgtgccaccatgtctggctaattttttaattttttgtagagacagggtctcactttgttgcacaggttggtcttgaactcagggcctcaaataagcctcctgccttggtctccctaagtgttgacattacaggtgtgagccaccccaccctctgcatcattcttgctctcaggaaggcagctcccctttattcctgacccccagggcagcatctaccaagacacagctcccctttaggggaggcaccctgtcgccagaacccccccgcagctaccaaggcaggcactgtgccaagcgctttacggcattggctcattgaatcctcatgaaagtctctggagggaggtactatcatctgtattattcccattttacagatgagaaaactgaggcacggagaggctaaattccctgcccagcaatctgtctttagcaccctctctgttgtatctcattgatttctgctgatcctggatcacgggttcatctggggaagtcattgctggactttgggcagtaggtggggagggctgagagctctgggtgccaggccttggccttagcccaaggcagctggctggaccagacagaaagcagatgggaggggccttggtactcgaaaatgaatcttccacatccatgccttaagggtttctctggcctggcctaacagtgagctgggaaaagacctcaccacgtgactgcagttgggtgcttgtgctgcagaggccagagagaaggcactggaagcgctggcttttgtctgcagccaggagtctggcatcttaggatgttgggctcttggacagggaaatgaagacaagagcatgggcatttagaattccaactcattcccatttcacctaaaggttctgtgactttgggtcaggtatttagcctctctgtgcctcggtttcctcacccgaagaagcagtgataaaaatatcaccttcctcgtagagtgttgaccgtgaaataagataatgaatgtaacatgcctcatacagcacacggtatctcaccgggttcagtggtggtagctgttcctaaaagtactttgtttgtttgttttgttttttgttttttgtttttgagagggagacttgctctgtcacccaggctagagtgcagtggcaccacaaaagtacaaaagtaccttccatgttgctgcttttttttttgagacagagtttcactctgtcacccgggctggggtgcagtggcacaatcttggctcactgcaacctctgcctcctggtttcaagtgattctcctgccttagtctcctaagtagctgggattattattattattattattattatttttgagatggagtttcacttttgttgcccaggctagagtgcaatggcacaatctgggctcattgcaacctctgcctcctgggtcaagcaattctcctatctcagcctcctgaatagcagggattataggcgcctgccaccatgcccagctaaattttttttgtatttttagtagagacggggtttcatcacattggttaggctggtctcaaactcctgacctcaggtgatccgcccgcctaggcctctcaaagtgctaggataacaggcgtgagccaccgcgcccggactagtagctgggattacatgcaccaccgtataacttgcagtatgtaatatgcaccactgcctggctaatttttgtatttttagtagagacggggttttgccatgttggccaggtgggacttgaattcctgacctcaggtgatctgtccaccttggcctcccaaagtgctgggattacaggtgtgtgagccactgtgcccggcctttttttttttttttgagacagagtttcaccctgttgcccaggctggagtacagtggcacaaccctggctcactgcaacctctgcctcctgggttcaagcaattctcgtgcctcagccttctgagtagctgggactacaggctcttgccaccacgtctagctaatttttgtatttttagtagagacggggtttcaccatgttggccaggctggtctcaaatttctgatctcaactgatctgcctgcctcagcttcccctcacttcccaaagtgctgggattacaggtgtgagccactgtgtcaggcctcacgtagctgcttaaggccagaatgtacagtgtgtcttggtcatgcccagtcccagccatggtgagggagagggagaccaaggaaataaagatgtggccctggcctggcagagggagaaggagcaggtttgtaccaatacgtcaactactgggcaaaccaagactgcacgtgcaaaggagtgaccacatgggatgagattaaggagggcttcctggaggaggtagactggaggcctctttaggggaaggaatgtgtgttgcagacaggtcaagggaatggggtgcaggctgggtttactgaggctgtttccttggggatgttaggaggtcatgccagggtctcttgttggagggcttgccttcagttctcttgttgtgaaccgcctcccagacccctgcattgcagcccagtgtcagcggaccaaggggatggattggaccagtgattcccaaatgtggctgacatcagaaatcacctgggaaaggtaggaaaaatccagactcctgggcccacctcagacccctagccctggggcctaggagcctggattccacaacctctcttgtgatgctgatgtgtgggcaggtttgggaccctctgaactggacaatcacgtgggatcctcaaccagagaggcaggctctgcgtggcccaaggaacccgggagttttttttgtttgtttggttttttgttttttgtttttgtttttgagatggagacttgctctgtcacccaggctagagtgcagtggcattatctcggctcactgcaatctctgccccctgggttcaagcagttctctgcctccacctcccgagtagctgggattacaggctcccgcccaccaccatgcctagctaatttttgtatttttagtaaagatggggtttcaccatgttggccaggctggtcttgaactcctgacctcatgatccacctgccttggcctcccaaagtgctaggattataggcatgagccaccgtgcccggctttttttttctttctttttttttttttgagacagagttttgttcttgtcgcccaggccggactgcaatggcacagtctctgctcactgcagccgccacctcccgggttcaagcgattctcttgcctgagcctcacgagtagttgggattacaggcatgtgccaccacgcccggctaatttttgtattcttagtagagacagggtttcaccatgttgaccaggctgctctcaaactcctgacctcaggtgatccacctgcctcagcctctcaaagtgctgcgattacaggcgtgagtcaccacgcctggccacggaacctgggggttaaggtcccagtgtgggctctcagcagcactgtttccctggaaaacagggaatagacaggttatagggaggaaagtgggcatgtggggagggcacagctagacagctcccttacatagatagagagacagggccctctcaacagatggcctggccaccgtccctggctgggcagtgcatgcatttaggttaagagaggagactctgggttcaggcttgtgtccaagtcctggtgctgctgcttcctagctcccttgggcacattactcgccagctgtacccttggtttcctaactggaaagtcgggggttagtatgtgtgaagtgcttggaacagcattggctgggcacggtggctcatgcctgtaatccagcactttgggaagctgaggcaggcagatcacctgaggtcatgagtttgcgaccagcctggccaacatggtgaaaccccatctctactaaaaatacaaaaaattagctgggcgtggtggccggcacctgtaatcccaactatttaggaggctgaggcatgagaatcgcttgaacccaggagatagaggttgtagtgagacaagatctagccactgcactccagcctgggtgacagagcgagactctgtctcaaaaaaaaaaaattgtgtctggcacacagaaaatgctcgatgaaggtaagccattattgttgctgttattgagaagcaggaacctgagaaaggggctttgagccacgccaccccatccccttcccccacccctgctgctggagttcaagagcctgttccatcaagaatcctgaattgcgcatgcacgcgtacacacacacacacacacacacacacacacactcactcacatgctctcacgctggctttttccatccatgaaatgtgacactcttcctgtccccagcagccccctgttgccaagagggcctcagagctggtggctctggttctcttcacctggggagagacttcaccgtcctggcaggagctcgggggagcccttccccaagtgtgagcagcatccctcgtttctggatcccaggttcaggtagtgaggcctctccttcccacacctgcctggtgtatccaccccctcctcccccagcaccgcagctaatccctgccaatccctgctgggccgcctggcgccagccctctgccctggggccagctccctgccccggctacccctgccccagctacccctgccccgccagctctggcaagccaggcccctttgttcctacagtctaggttcctcctgacttcctgaggtggtgggaggggagggccttacctgcctgctgtcaatctggccaccaggtgagaagtgtaagctgcagaccctcagggagctaagactcacccagggaaacaatgatgagcactgcagtgtgggtcttgcctctgtggcttggaggccagagagggcaggagaaatccgagaaggcttcatagaggtggaagggacgtcattgtcactggccctgggacctggaggaaggttagagaaaggagacacaggccgggtgtggtggctcacgcctgtaatcccagcactttgggaggccaaggtgcgcagattggttgaggctgggagttccagaccagcctgagtaacatggtgaaacctcatctccactaaaaaatttagctgggcttggtggggtgcacctgcagtccctcccagctacctgggaggctaaggtgggaggatcacctgagtgcaggaagtcaaggttgcagtgagccatgagccatgattgtgcctctgcactccagcctgggcaacgggagtgagattgggtctcaaaaaaaaaaacccaaaaaacaaaaacaagaaaggggacacagagggagccatggtcccttgcatgggaggtcccttgcatgggaggtcccttgcatggtcccttgcatgatcccttgcatgggaggaacccagcaaggagagaccccctccagttggaggagggcctgcatgatggagagggatgagtatatcacccgccagatcagagagggccttgaatgccaggccaaggcatttgcttctcattaatcagcaccagtaatacctctttatttttatttatttttatttttatttttgaggtggagtcttgctctgtcacccaggctggagtgcagtggtgcgatcttggctcactgcaacctctaccttctgggttcaagcaattctcctgtctcagcctcccaagtagctaggactacaggcacatgccaccacgcccagctaatttttgtatttttagtagagacggggtttcaccatgttggccaggctgttctcgaactcctgatctcaagtgatctgcctgcctcagcctcccaaagtgctgggattaccggtgtgagccactgtgaccagccttcagtaatacctcttcatgtgtgccgagcatcccaataaagattttacatgcctgatctcatttaattactccagcagccctgagaagtaggtactattattatccctgctttccaagggggaaactgagtctcagaagggctagggacttgccccaggtcacatggctattaaggagcagagctaggattctaaccaggcaggctagctccagactcctcgcttctcagagaacacagcttcaaagtgtgctctgagaggggcttccccagggctccctgagatgctctctggggagttatttccagaagattctgttgcagaggcaggccacactacagagcctgggagaggttccttgttaaaattgtaggaatggctgccctggccaaaggtcagcagtggaccagtagatttcaagtcagtttccactctgggccgactcattggttctaagagcctcaagcatggtgttgggagaatctagagccatgtgatactcagcaagaaagactgtgagatagattagcaatgtctgtcctgggttaggtatggagagcagggacctgtgagccatgtatttgctgtccctgggctaattgtctatcattggccagagagatcttcctggtggtcagcattcagagtaatcttccttccacaccctctaaagccagaaactcagtcctataatgtagggtgtagacacctctcctgtctacagcacatgcttcatgacatgttggtcagtgtatttgtctgttttatgttgctgtaaagaagtacccgtggctgggtgatttctcaagaggtttatttggctcacagttctgcaggctgtacaagcataccaccagcatctgttctgcttccagtgaggcctcaggaagctttgactcatggcaggcatgtcacatggtgagagctggagcaagagagaggaggaagtgcaaggctcttttaaacaaccagctctctgctgggcacggtggctcatgcctgtaatcctggcactttgggaggccaaggcgtgtggatcatttgcggtcaggagtttgagaccagcctggccaacatgatgaaaccccgcctctattaaaaatacaaaaattagctgggcatggtggcgagtgcctgtagtcccagctactcaggaggcggaggttgcagtgagttgagattgtgccactgcactccagcttcggtgacagagtgagatgctgtctcaaaaaaaaaaaaacaaaaacaaacaaacaaacaaaaaaaacaacccagctctcttggtcgggcatgatgactcatgcttgtaatcccagcactttcggaggctgaagcagatcaccagaggtcagctgttcaagaccagcctggccaacgtggcaaagccccgtgtctactaaaaacataaaaattagccaggtgtggtggcacccgcctgtagtcccagctacttgggaggctgaggcaggagaatagcttgaacccaggaggtggaggttgcagtgagctgagatcatgccactgcactccagcctgggtgacagagtgagactctgtctcaaaaaaataaaaaccaaccagctctcacatgaactcagagcaagaactcactcattaccaaggagatggcaccaagccattcatgagggatctacctctgtgacccaaacacctcccactgggccccacctccaacagtggggatcacatttcaatgtgcaatttggaggggacaaatatccaactatatcggtcagttactgggtggagggagccctggaggagactcaggagacctgggttatttcctgctctatcatcctttcttccctgggccctgttctgtaatgggttgacatgaagacacttcctgccagaatttgacaggtcactgggaacaaagacctcctccctgtcacctccctcatcctccattcccattcaccataccctcctctgtctgcagacaaccttttagtcctcacggtggccactaaggagaccgagggattccgtcgcttcaagcgctcagctcagttcttcaactacaagatccaggtaaggggtttcctgggtgaggcagagacagtgaggggtggcaggaggatctaggagctagtgtcctttccaaactaccacgtctcttaagatagacttggggccacaggggaggcttctggaagcctgaaggatgaaaatgagttagtcgggaatgggaagacacagcagaggacacagcatgagtctagggggtgatggagagggaaagagttggctaaagaaatgctcagatgttagtgtgcaggagcctcagctgagaggctagtttagaggacagggcctcgggatcagcatttccacaagtaccaccccgtaatttggggatgggcacggtctagacatcttcccggtattataaacactgctctaaagaaacatgagtggtcccgcacaggggctcacgcctgtattcccagcactttgggagtctgatgatccactgaggtcaggagttcgagaccagcctggccaacatggcgaaaccccatctctactaaaaatataaaaaaattagctgggcatgatggcacgcacctgtaatcccagctgcttaggaggctgaggcgggagaatcacttgaacctgggaggcggaggttgcagtgagccgaggtggcgtcactgcactccagcctgggcaatagagtgaaactctgtctcaaaaaaaaaaaagaaaataaaagaaaaaagaaacatgagctaatgcccgatcgaccactggcatgggcttggtgtcatctgtgtgcagtccatggggctgagccctgcagggagacgagtatcctgagtgcttccttatgtcaggcacaaggttgggcactggcaatagggtgatggacaatacagaacatgtcattgcttacacagagcttgcaatctagtggcattaagtcagcaagcaagtgtatcagctcacatgaatgagggttgcagcagagggttgcttcaggcatggctggatccagggattcaagcagcaaagtgagggccttgtgtttccatctctaggccctgtttgttttaatcgtggtggcaagatgaccaccagccacagattcatgtgccccagtttctcaacttcagcagaaggagacaggctttcctttttaggaaaggcctgcagactgttctgtttttcacagaacagtcccagggaaggcgctgataggccatgctggggtcacatgctcaaatctccggatgtgggaggggcaggaagggtgggacattctgattggacaggcatggtcacatgaccaccaggaaccggctaatcctcatacaggtggagaatggtttccttacaggggagggtcagagttgctggacccacaggagcaaaaaaattatttctttttctctttttttgagacggagtgttgctctgtctcccaggctgaagtgcaatggagcgatttcggctcactggaacccccacctcccgggttcaagcaattctcctactttagcctcccgagtagctggaattagaggcatgtgccaccacacgccgctaatttttgtgtttttagtagagacagggtttcgccatgttggccagtctggtcttgaattcctgacctcaggtggtccacacgtctcggcctcccaaagtgctgggattaccagcatgagccaccacggccagccctggaaaaatatttctttaccaaaagcccgtgttaaggggtgtttctctccaggcgcttggcctaggggaggactggaatgtggagaaggggacgtcggcaggtggagggcagaaggtccggctgctgaagaaagctctggagaagcacgcagacaaggaggatctggtcattctcttcgcagacaggtaggtgggtcagggcttcctagcctgggcccctccgcggaagatagaagaatattctaaaatgaggccctcccagaacatcggggaagaagggggaccactctagctaaggttgcctagttttagggtgtccattcccggtcttagtaaagcccattcccaggcttggtgaaaagataaagaggaggtgacccatgagtgtgatgggccccctttaagtaagagaagaatgacatgttgtggggaccatctctttgcccagggtgcgggtgggaacatggcaggcagggctgcagacagagacaggtccatttcccagatggtggcccaggctggcgtgggcagagggccatttgtggagcacttgatccctggtccctcctgtctgtgccctcactgggcccctgctcacccttgccctgctccgtcttctcgctgctctggccacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggtgagaggcctgggtgcagggcgcttggcccagcagaggggtccatctactgcctttgtggggaccccccttgtttgacgtgcaatctgggtgtctcacaggtctccagtgcagaatgtcctgaatagagctcctgacttttcaaccccaaatgtgctcccctgcagttctgatctcattcaacagacacgcagccccatagacagaacccaggagtcactcctgactcctcccttgccctcctccacctacgtccaatgccagtcacctgtctactactttttaaattttgagacggcatctcagtctgttgcccaggctggagtgcagtggtgggatctcagctcactgcagcctccgcctcttgggctcaagcaatcctcctgcctcagccatccaagtcactgggattacaggcatgcaccactatgcccggctaatttttgtatatttagtagagatggggtatcgccatgttggccaggtgggtctcgaactcctggccttaagtgatccacctgcctcggcctcccaaagtgctgggattataggcatgagtcaccacacctggccacctgcctcctacttcctaaagatctctggaatctgctctctctggcccacagttcactgccaccattctcactgggctcctggccgttggtaggagcctccttactgctctgccattccctaccctcatgcccttccaggccattctccatccagcagccagaggtgtctttaaacgatgcaaatccaaggccaggcgcggtggctcacgcctgtaatgtcagcactttgggaagccgaggtgggaggatcacttgaggccaggagttcaagaccagcctggccaacatggcgaaaccccatctctactaaaaatataaaaggtagccgggcgtggtggtacacgcctgtaatcccagctacttgggaagctgaggcaggagaatctcttgaacccaggaggtagaggttgcagtgagctgagatggtgccactgcactcaaaaaaataaataatttttttaaataaaaaataatactatatttttttataatgtaaaatatattatatatattatatataataatttatataatatatataatatatatattggtggctcatgcctgtaatctcagcactttgggaggccgaggtgggcggatcacgaggtcaggagatcgagaccatcctggctaacacgatgaaaccccgtctccactaaaaatacaaaaaattagccaggtgtggtggcaggcgcctgtagtcccagctactcgggaggctgaggcaggagaatggcatgaacccgggaggcggagcttgcagtgagccgagatcgtgccactgcactccagcctgggcgacagagcgagacattgtcttaaaaataaataaataaataaagatgcaaattcacacacatcacttaatgactttccactgcacggagaataaaatccacaggcctcttttcaaccttagatggggatctgccatctgccctcaacagacacttttttccactggtccagagtaagcacagtccagatggccttgccctggcccaggcccaggagtagggatgtcccattgctcttgtggttgcttgtcaccagtctgtactctagccaggggcccatgtgggcttccccactatgccaggtctcagcccccaaggcactctgtgagcttggcccagcctttcccttctctgggccaggtttcccagataactgtaaaaagggacaccaggcctgtatcctcccagccctgctctccaggggctcctcgtacaatccgtttcttcaccacctatatggtgcccagcactgaacagtacagcttagtgggcaccattggtcttattcttggggtcattaggaactcattaataagtgacattcactggcagccccatttccaacctgcagccccacctcctgtcaattcaggaggacttctgagaggtgacagggtttgtgggcatatgagtggaggtggataagagggaagggtgggaggaggcccctgacttagaggctggaagctaagggtccgtcttggtgtccccacccaccaaccttcaggcttcatcggttatgcccccaacctcagcaaactggtggccgagtgggagggccaggacagcgacagcgatcagctgttttacaccaagatcttcttggacccggagaagagggtaagaggcagtgggcgggccaaggagagggggctggggatccaccggccaggctgcacgggaacagctcctctcaggcctgaacccctgggttggtgtcttagtctatgcaggctgctctgacaaactgccataggctgggtggctcccaaacaacggatgtggatttctcatggttctggaggccggaagggtgagatcacagttgggttctggtcagagccctctaactggtacagacacagctgacttctctctgtgtcctcagatggtggaagggggtagggagctcactggggcctcattgataaggacactaatcctatttttttatttttgggatggagtctcactgtattgcccaggctagagtacagtggtgcgatctcggctcactacagcctctacctccctggttcaagcgattctcgagcctcagcgtctcgagtagcggggactacaggcgtgcaccaccacgtttggctgatttttgtatttttagtagagacagggtttcactacgttcgccaggctggtctcgaactcctgtcctcaggtgatttacccgcctcggcctctcaaagtgctgggattacagtcgtgagccaccgtgcccggctgtcgggtcttaaagaggcagcattgttcattggttcagaataaggacttcagggccaggctgcctgggttccaatcccagctcaccatttactagctgtgtgacattgggcaacttctctgtcccttgttttttccgttatgaaatgcaataatgggccagacccagtggctcatgcctgtaatcccagcactttggaggccaaagcgggtggatcacctgaggtcaggagtttgagaccagcctggccaacatgatgaaaccctgtctctactaaaaatataaagattagccgtgcgtggtggtgggtgcctgtaatcccagctactcaggaggctgaggcaggagaattgcttggacctgggaggcggaggttgcagtgagccgagattgtgccattgcactgcagcctgggtgacaagagccagactccatctcaaaaaaaaaagcaataatgataatactttctcacagagatgttgtcaggattaaattgattaatatatgtagaatagtttatttatttatttgagacagggtctcactgtcacccaggctgatgcgcagtggcagaaacatagctcactgcagcctcagcctcccggactcaagcgatcctcccacctcagcctcctgagtagctgggactataggcctgcgtcaccatgtctggctaattttaagatttttttatagagatgaagttttgctatgttgcccaagctggtctcaaactcctgggctcaagtgatccttctgcctcagcctcccaaagtgctggaatgacaggagtgagccaccgcacccgactcgtgtagaatatttggagtagcggccaggtgcggtggctcacacctgtcatcccagcactttgggaggcggggggcgggggcggatcacctgaggtcaggagttcgagaccagcctgctcaatgtggtgaaatcccatctctagcaaaaaaaaaaaaaaaaaaaaaaaaaattagctgggtatggtggcacatgcccgtagtcccagctactcaggagtctgaggcaggagaatcgcttgaacccaggaggcggaggttgcagtgagtcgaggtcgtgccattgcactccagcctgggtgacaagagcgaaactctttctcaaaaaaaagaatatttggagtagctatgtgcgtgtagtggagtgcttggcaggtgctggttactcttaacggccgtcattgttgtaggtgagccggctgcattcttagattccttccagttcagagtccctggttttctgtgagtagagccactagactgtagaccccaggagcttggctgctggccttctctgggcacctagctgccctgatgtgacgtggcagagtcggtgtggggaatgagggctgaacttggggacagattccccacactgggtgagatgtagccccagcctcccccagggcctgtccctgctgcagtctggtaccttctttcctgcaggagcagatcaatatcaccctggaccaccgctgccgtatcttccagaacctggatggagccttgggtgagcagcccccacggggaggggtggatcctcagaggggtgataggaagaattccaggcagggcccgagcccagggaggagaaatgggctgcttctttctggccattgtgctgagaggtcactggcctcatccccaggtccccaggggccacttggatatcctggcgcagagccatgtctctcttgggggcgggggacaagtgagcattcagcctgggaggagttgggggatgcgcacagcaggtgctggaccccctgccctgcataccaggtccttacaggtgggccctctttccccactttcccggccctcccaccttccaggtgaaggagtcctgggctaggggcaggaactcagctggtgggacaggcagcttgggaagcaaaaggctacttgacccttgatgccgcaaacatccctgggcctggcctcatgtctgtggctggtgatgacattgctttgccgcaggtcttcctgtcttcctgagtgacctcaggcaagtcacacctcctccccacaggggactcagttttcttatctttacaaaagggaagtgaaccggatccactgattgctgattttgtggataaatgggcccttttgagaatctgatgaaagctacggctctgctcccagagaaacgcagaaaatgccctttgcctgtggtttctgggggttaagaagcactgagttcagatccacgcaggtcaggagctatctgttttcctttttttttcttcttttttaagatggagtcttgctccatcgcccaggctggaatgcagtggcgaattctcgactcactgcaacctccgcctcccaggttcaagtgattctcctgcctcagcctcccaagtagctgggattacaggcgcacaccaccatgcccggctaatttttgtatttttttagtagagatggggtttcaccatgttggccaggctggtctcgaactcctgacctcaggtgatccacctgccttggcctcccaaagtgctgagattacagacgtgagccatcgtgcccagccctattttaatttttaaaatagagacagggtctcactatgttgcgcaggcttgtctcaaactcctgggctcaagtgatcctcccaccttggcctcccaaagtgctgggattacaggtgtgcgccagcgtgcccagctgaaatacccattttcctatgtgcagactaatagggtcaaacatgggtattgggggccaggcactgtaatcccagcactttgggaggccaaggcgggtggatcaccagaggtcatgagttcaagaccagcctgaccaacatggtgaaaccccgtctctactaaaaatacaaaaattagctgggtgtggtggcatgtgcctgtaatcccagctactcaggaggctgaggcaggaaaatcacttgaacctgggaggcggaggttgcagtgagccgagatcatgccactacactccacactgggcaatagaatgagactccatttctaaaaaacaaaaaacaaaaacacacacaaaaaacatgagtattggaaccctgctgcaggggctccctccactgggacaagatctgtcctgatcatgcccaggcctcccctgcatgtggctctggcattttctcagtgctgctctgcctactcagagaaggcgcgtcccagaccctttctcttggggcttctctgaggtgcctggagctgggatgttccaggtcttcgttcttctcccagcccctgcttctgactgtaagtaaccacaacaagtacaggggttgccgtggattctgtgctcatgatgggccaggcttggtgccccacgcttgttcaacacaaatcctccccctcaccccatgaagaagggattattcctattttatagatgaggaaactgaggcttagagagaagtgacttgcccgaggacataatctactcactgcacagctgggatttgagcccagctggttggaccctgagcctgacctctgggtctgatgctgggtgggactgtgctttctgacccccagatgaggtcgtgctcaagtttgaaatgggccatgtgagagcgaggaacctggcctatgacaccctcccggtcctgatccatggcaacgggccaaccaaggtagggggtccccagcccctggggagtgtgggagggggccagagccctaatttcattctcactgtgaccccacagtgtctccctggggccagggccaccttcctggggcctgctatgaactcactgcctctgtcctcacatctgagctcagcgtgatgccttcttttcctgctgtggtggtcagtggtactctgtctgttcttgctggtcacaggacacgtaggaggctgccatccccttccaggcctaggctgggctaccagagccatctgcactgtcaccccagggcagagtcacttattcactcagtaaacctttatttcatgtttgcaccagacagtaagacatagtcataagcaggacggatgtcctgcattcatggtgacagaagggactgggtgcagatgcggccagggacagaatggacctcactggtccctggggaactggctcatagctcatagcatatttgagtgtggtccttcaccgctggaatgagggagaggaaggaggatgtgatgtgtttaaaatgcaaatttgctgatttcacccaggatctgttcagatggaatctctgagcggggtgggacccaggaatctgcattttacaagctctcgggagaagcactagagtgccaagccctcccctgccctctctcagagcggcttggtgatctcctggggatggagcattatctccaagaccctcttagggagtgggagggggctggatggtgctgacccactgggggcccagggagatgtgagtcagggctatggcaggtggggctggctggcttctctgtgaccccacgtctccccgacagctgcagttgaactacctgggcaactacatcccgcgcttctggaccttcgaaacaggctgcaccgtgtgtgacgaaggcttgcgcagcctcaagggcattggggtgaggctgcgcccaggcctgtgcctgagggacacggggggctcagtcccctgagatggcgagatgggtgattctggaatagactccattgtctttggtggaaagtgaaggggtcacctccctgcctggggttctatcccggttgccacccaagtgcctcctcctggaagccctctcagattgcatgtctctagcttcccccgagatgtccaggttctggtttcttctgcctggtccttcaggctctcctgcagccccctccccatcccatgaacctcatcctcatttatgactcacctcgaacaccacgccagccacgatctcctgacagcaggccctcaaccgagtccttgttccaggcctgggctcctgctgctctctccccggggcaccctcctgctgcttccctgcccccccgtaccccctgactggagttccccggcccgggcacctttcttgggaagtctacatgcttctgattctggctctgactcccttgggccaccctggggtggagtggcagtgctgtgactggacactgctggactcttgtgccgccctccctggtgcaggatgaagctctgcccacggtcctggtcggcgtgttcatcgaacagcccacgccgtttgtgtccctgttcttccagcggctcctgcggctccactacccccagaaacacatgcgacttttcatccacaaccacgtgagtaacaggcgctctgtggggtcgtcatgtggcttagatccagggcccagcttcacaaggtagcccgagacctctgagggtctcaccgaatctagcttatctgggccaaatgacaatcaccagtggactgtgtccccaaatcactgagttaactttggagtcagactgggtgagtttgaatcccagcgccgctattttattggctgtgtgaccttgggcacattactcaacctctctgtgctttagtttctcatctataaaataggcataaaagtcggggcgcggtggctcatgcctgtaatcccagcactttgggaggcccaggtgggcagattatctgaggtcgggagttcgagactagcctgaccaacatggtgaaaccctgcctctactaaaaatacaaaattaagctgggtgtggtggcagatgcctgtaatcccagctactcaggaggctgaggcaggagaatcgcttgaacctgggaggcagaggttgcagtgagccgagattgcgccattgcactccagcctggacaacaagagcaaaactccgtctcaaaaaaaataaaaataaataaataaataaataaaataaaatagggataataattgtgcaatcacacagaattgctgcaagggctaagcaagctgacatgcgaagttcgtaaaaggtgcctggtgcacaggacgcatctagttgcttctaactgttgtcatcttcacttccatccctgtcactgttaatccttcctaccttcctaattgtacctggtggcagtcaaattggttttcttttctttttttttttttttgagacagagtctcgctgtgtcacccaggctggagtgcagtggcacgatctcggctcactgcaacctctgcctcttgggttcaagcgattctcctgcctcagcctcccaagtaactgagactacaggcatgcgccatcacaactggctaattttttgtatttttttttttttttttgagacggagtcttgctctgttgcccaggctggagtgcaatggcgtgatctcagctcagtgcaacctctgcctcccaggttcaagccattctcctgcctcagcctcccgagtagctgggattacaggcgcctgccaccgtgcctggctaattttttgtattttagtagagatagggtttcactatgttggccaggatggtctcgatctcctgacctcgtgatctgcctgcctccgcctgccaaagtgctgcgattacagccatgagccaccgcacccagctggatggttgtttttccttttttttttttttttgagatggagtcttgctgtgtctcccaggctagagtgcaatggtgcgatcttggctcactgcaacctccgcctcccaagttcaagcagttctctgcctctgcaacctccgcctcccgggttcaagcagttctctgcctcagcctcctcccgagtacctggaattacaagtgcctgccaccatgcccggctaatttttgtatttttagtagagacgtggtttcaccatcttggccaggctagtcttgaactcctgacctggtgatctacccgcctcggcctcccaaagtgctgcgaatacaggcgtgagccactgtgcctggcctggactgttgtttttcaaagcgaagttgaggatcacctggcacattttgtaacaaagtggatctctgggccacacccaggaatcaacaatgtctctggatgtgggatcctgagcgtggtggcggagctctatcctgatgacagaggctcttaggaggcctgacctggtcagaggagaatgggcaaaggatggccagggaagggtgttcctggcacagggctggcatgggcaaaggtctggagacaggaaagcagatggccggggtgccagagatgaaggggcacagcctggcagtgacaggaggtgctacagtccctgggtggaagctgtgtcctccttcctcacccccgcatccccttccccatccccaaccccaggagcagcaccacaaggctcaggtggaagagttcctggcacagcatggcagcgagtaccagtctgtgaagctggtgggccctgaggtgcggatggcgaatgcagatgccaggaacatgggcgcgtgagttgtgggccacagtactctccactgacagtgggggcaggggagctgtggctgtggtaaggagcagcaggctgagtgacaggagttcagaaggctgtgtgtgctctagcaagttcctgcccctttctgggccttggagtttccatctgtcaaaaggggaaatagcctctgtcctgccaacccccggggctcctgggcagggctgagccatgttatttgggttcaggaagcaaatcagagaaagaggaaggactgggggcaaaagtagacaaaggctgactattagggagccaaccttgaatgttttactttattatatataaaaaaaaaaggccgagagcagtggctcatgcctgtaatccctgcactttgagaggccaaagttgaaggattgcttgaggccaggagttcaagagcagcctgggcaacatagcgagaccctatctcttcaaaaattaaaaaaaaatagccaagtgtggtggcttgaacctggggtcccagctactgaagaagctgaggcaggaggacctcttgagcccgggaagtcgaggttgcatgagctatgattgcaccactgtgttccagcctgggaaacagagcgagaccttgtctcataaagcaaaacaaaaacaaagaaagaagtaatttgtgttgcttgtagaagagtcagacagtccagatcaaaggttggcaaacttcctgctaaggattagatcataaatctttgcaaattggctctgccggctctgtgacaaccctcagctctgccctagtagcacagaggctgcattccagcaaaatttcatttatggacactgaaatttgactttcatgtcatttatttttttttctttttgagacttggtgtcactcttgtcatccaggctggagtgcagtggcaggatcatagcttactgtagcctcaaacccctgggttcaagtgatcctcctgcctcagccccccaagaagctgggactacaggcatgtgccatcacatccagttaatttttaaatatttatttatttatttatttagagactgagtctcactccgtcactcaggctggagcgcagtggcgcgatctcggctcactgcaacctccccgtcccaggttcaagccattctcttgcctcagcctctcaagtagatgggattacaggtgcttgccaccacacctggctaatttttgtatttttagtagagacgaggtttcaccatgttttccaggcctgtctcaagctcccgaactcaagtgatccgcccgccttggcctccctaagtgctgggattacaggtgtgagccactgcgcctggttaatttatttatttttattttttgtagagacaggatcttgctatgttgcccaggctggtctcaaactcctggcttgaagttatcctcccgtctcagcctcccagagtgctgggattacaggcatgagccactgcacctggtgatgaccttcacataatttttacatcttcttttgatttttgttttcttttttttttttttttttttgagatggagtctcgctctgtcacccaggctggagtgcaatggtgcaatattggctcactgcaagctctgcctcccacgttcacgccattctcctgtcttagcctcccgagtagctgtgactacaggtgcccaccaccatgcccggctaattttttgtatttttagtagagacggggtttcaccgtgttagccaggatggtctcgatctcctgacctcgtgatccatccacctcagcctcccaaagtgctgggattacaggcgtgagccaccacgccctgccgatttgtttttttcttgaaacaacttaaaaacataaaatcagccaagtgcagtggctgtaatcccagcactttgggaggccaaggattgcttgagctggggaagttgaggctgcagtgagctatgattgtgcattccagcttggctgacacagtgagacccccatctctaaaaaaggaaaaaaggccgggtgcagtggctcgcatctgtaatcccagcactttgggaggccgaggcgggcagatcacctgaagtcaggagttcgagaccagcctggccaacatggtaaaaccctgtctctactaaaaatacaaaaattagcctggcatggtggtgcacgcctctaatcccagctacttgggaggcagaggcaggagaatcgcttgaacccgggaggtggaggttgcagtgagctgagattgtgccattgcattccagcctgggcaacagagtgagactcgttctcaaaaaaataaaataaaataaaaataaaaaaaagaaaaacataaagctgttcttagcccatgagctgtacaaaaccaggcagggccagagtttgactcacagaccctcgtttgctgagtcctgtaccagataaacaaaagtaacacagatttttaaggcttttggtacaagttaccaaattgcatttcagaaaggcagccccagcttactccccaccctgggccatgtaggcacctgtgggctgtgttcttcccagtaccaggattttcagggcacttgataccagttgccaacctctgggccttgggtgagagagcccagcagtccaggggtttgggactcagagtcgggaggaacctttgaggctgctggtgtgacctctctaaagccccttggctgatatgtggtgaagccagactgtggtcacagatgtgagcagccaccagtagctccaggatcaggtgcactgaccctgtgtcctcctccttgcagagacctgtgccggcaggaccgcagctgcacctactacttcagcgtggatgctgacgtggccctgaccgagcccaacagcctgcggctgctgatccaacagaacaagtgaggctgctccgtctgcacccagcactgctcaggactggcctggtcctggggtggcagccctccttgccttcctcctcctcctcctcatccacctcctcttcctcctctttttccttctcctgctcctctttctcctcctcgtcttcctccttgtcttcctcctcctcttcctcttcctcctcttcctcctttttcctcctcctcctcgtcttcctcatcctctttctcctcctcctcttcctcctcctccttggcctcacctattacccagagctgtggatccccagcctgataccccaggttctgatagagaaggtgtcctgccctgtctgctcctggctgccccatgggagggagcaggtaccagaagagccaaacccccgacaccccggccaaggcactgcctgtctcagtgaggtgcttggggatccctgcgtgcaggttgaggggcacctacctccccccatccctggttagtgctgtctcctactcccagtgggcagcgacctcctactgaggtgctcccttccctcaggaacgtcattgccccgctgatgacccggcatgggaggctgtggtcgaacttctggggggctctcagtgcagatggctactatgcccgttccgaggactacgtggacattgtgcaggggcggcgtgtgtgagtacctgcagggtgggggtgggtgggggacaccttcatctggcttctgcctgggcttgtggggctccctccctattattcctgttcttgttaccctcaaattcctgttgaacctgaagcaaggaagacttcagttagacacacagaaggacttcctgacaaataggcccatgtgtccagggcgggggaatcaaatcagcacaattgtgcccccctagcctgtgacttcccttctcacacccagactccaggctatgactccccaccaccaccctgtgaccccctccatcttccccaccaccagcctctgacccccacccgctttctgtctctcccacagtggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggtcagccaggagcgggcagcacaggacgccctctggatggggcaggcgggaaggtgggcctccagctctgaccctcatggtgggccgccttgtcaccgtaggcctgggagctccagagattctagcagggcatctcggaagccaccagggcctgctggaggaatgggggccgtcgggcacgagggctggtcctcaggggtctgcagggaccattttagctgacctggtttttataccatctattttatttacatttttggaatagcccaaagaaaacggaactttccacctaaaggtactccaagtgatgtgcccgagagacacctcaccctgtctctgcgccccaccccatatatttttgtgactttttttttttttttaaacatgcagcaagatgaagttttcccctgtgaccaacatttcaggaccagaacacgctccttttcttttacgcattttttctttcattctgtgttcagtcctctgggaagacttccctgatcacattcttagtgtcaggcctgggctgggccctggggacatagcggtgactgcacttggtctctgatattgggaacttcagttcggcgggtggaggaggctgcactgttgcccgtctgggagcgtgcaggggaggggtgagggcaggggaggggtgggggagcgcctcttccaccgggcctgtcctccccaggatgtgttcatgttcctgaccaaccggcacacccttggccatctgctctccctagacagctaccgcaccacccacctgcacaacgacctctgggaggtgttcagcaaccccgaggtgaggccagggtgggcacataggggctgggagcaaaggggcccagtgatcctgcagtcggagggacttccctctcagagtcttacaacagccaggacccctgtaggccacctgccaccctcccttcaccccaggaggctatagggcaggatttgggtagggagagaagggtgtccagagaggcaacaccatctattggaggagggaccaggactcaagaggcctgggtttgtggcctagatctgccatcatctgggacttagttgagccttccagctttggggaccttagttatcttagctccaaaatgggtatactgtcccagcctgtcttacccatgagggtgttgtgatgatcagaaggggagacagttgtaactgtttctagacgttgggagctcacagctgatgggtgtaagcacatgcctgcacacagacatatacacacaagcacacacatgtacatacatgtgcaaacaccacctcctatgggcacacctgtgcacccagacaacacacacgcacccagtgggtgcaggtgaacacctgcctctgtcaagcacgtacaccttcactcccactttgaggggtctgctctgagcatccctggcagttgagccaatggtgaggaccctagcctgcttcccacttcccacaggactggaaggagaagtacatccaccagaactacaccaaagccctggcagggaagctggtggagacggtaagggccatggacaccctcttggaccagccttgcctgctgcagggggcagggcacagaagggaaactgcttgccctggggagtgggggacagcaggatgggagttgggggtggagggatgggagttggggggcggcaggatgggagttgggggtggcgggatgggaatgggggggcggcgggatgggagtggggggtggtgggatgggggtggggggaggcaggatggcccctctacctgttggcactttcctgctggaggctgtgggagtctgcagggcctctctacctggcccaggcaggaaggaggaaaacatcctggatgtgatggccactgtggcccaccatgcctggaccacttcggggagtggctgcttctctccactcactaatgtctgcttcccccgagcctggggcctctgccccctccctccctccatgcccatgtttctgtctgaccttggcgctggtagctctgtgacctcggctgggaaagtctgtctctgggctctgcctcctcctccccactcagtctctccaggattgacaaggccctgctccccggggacactgggagggctccctggcttgggtgtgtggccctgaagaggaaggaggattctgtggtgccactgtggacccccttgactgagtccctgccctccccagccctgcccggatgtctattggttccccatcttcacggaggtggcctgtgatgagctggtggaggagatggagcactttggccagtggtctctgggcaacaacaaggtgggaccctgatgcctgggctggggccgcagggaggctgcctctccatcagtgccgctcactgtctggggtcttctggcaagctggcctggccaccctttctgggactcttgacataggggtgctggcatgggtatctgcaggcaggtaggagtagagggattgagaaacctgagatggagtttggtccctgagctgctgttgccaccgtgtggctttgagttgccttgaccgtaagctactaggttttcagttcctggtttgctattggaatggcttagcttggttccctagacttcccccaggtggagctggggaggaaagggccaaggtgggatgaggggcattaggaagggctgtcgggtccaagttcatcagacagcaggagcaggtggcctgctgagggtgctaggccctgtgttctctccgtgagaatcccaacacctgttcctgtcctggaaagttcaggtaccatttttttttttcttttcatgtgtgtgtgtgtgtatatatatatatatataaaaagaaatatatatagattttatttatatatatatatatatattttttttaaataatagagacggggtctggctgtgttgcccaggctggttgtgaaccaggcacaatttcattttatttattttaattaattaattaattaattaatttagagaccgagtctcactctgtcgcccaggctggagtacagtggcgcaatcttggctcattgcaacctctgcctcccaggttcaagagattctcatgcctcagcttgccgagtagctgggattatagacgtgtgccaccacgcccagctaatctttgtattctttatttatttaattgtgtgtgtgtaaattttttttttttttttaaggcagtgtctcgttctgtcacctaggctggagtgcagtggcatgatctcagctcactgcaaccttcctttcccaagttcaagcagttttcttgcctcagcctctccagtagctgggactacaggcgtgtgccaccatccctggctaatttttgtatttttagtagacactgggtttcaccatgttggccaggctggtctcaaactcctggcctcaggtaagctacccacctcggcctcccaaattgctgggattacaggcgtgagccaccgtgtctggcctaaggcacctttttattttatttattttttttattttaatgatcccagaacatttatttccataggattttgataaaagagcacaatcttgaataaaaatacaccactgtacttaaaggcaacattacctactaagcaaactctgtccttagccctttcacagaagagaaactgcagaaaggaatttttcgtctcctgacagttttacaacattcatatctcctatgtacttcaagccccaacccacctctgattttcttttttcttttttttttttttgaatggagtctcgctgtgtcgcccaggctggagtgcagtggcgccatctcagctcactgcaacctccgcctcccaggttcaagcagttctcttgcctcagcctcccgagtagctgggattacaggcgcctgccaccatgcccgactaatttttgtatatttagtagagatgggtttcaccattttggtcaggctggtctcgaactcctgacctcatgttgtgatccacctgcctcagcctcccaaagtggtgggattacaggcatgagccaccgcaccgggcaccccacctctcattttctacgtcctttttttttttttttttggtgaagtggagcctcgctctgtcgcccaggctggggtgcagtggtgcagtggtgcagtggtgcgatctcggctcactgaaacctctgcctcctgagttcaagtgattctcttgcctcagcttcacaagtagctgggattacaggtgctggccaccatgcctaattttttttttttttttttttttgagacggagttttgctcgtcacccaggtggagtgcaatggcacaatctcagctcactgcaacctccgcctgagtagctaggattacaggtacccaccactacgcctggctaatttttgtatttttagtagagacaggggtttcaccgtgtttgtgaggctggtctgaaactcctgacctccggtgatccacccaccttggcctcccaaagtgctgggattacaggcgtgagccaccgtgcctggcctcattttctaagttgtttaacagaaatgtgtgttcccaagtttaaggcaccgtttttaaaggcacatgagaccctggacctgtgtgccaacctctgacctggcaactggactaacctgaagttctggttatcttcctaatccacatgctttggttgctgagctgatctccagaagccaggaactggactagcccgtgcattctgggggctggctgatgcttgtgctccagtgacagggccagacctcggaccccagctgactctggccctggaacaagttttcagtgctctgtaacaaatgactgtggctcagaataacacccgtgtgttatctcctggtttctgtgggtcaggaatctgggcccagtttagctgggtcattgaggtgtcagctggggttggggtctcatctgaggcccaggattccattccaaactcacttggttgttgcagaattcattcccctgcagctgtagaacttaacttgcttcttcaaggccagcaagagacagaatctctcttcagtatcctcctttagccaggcgcagtggttcatgcctataatcccaacactttgggaggctgaggcaggaggatcgcttgagtccaggggtttaagaccagcctgggcaacatagtgagacctcatctctacaaagaataaaattagtggctgggtgcatggctcacgcctgtaatcccagcactttgggaggccgaggtgggcagatcacctgaggtcaggagttcgagaccagcctggccaacatgatgaaaccccatctctactaaaaatacaaaaaaaaaaaaaaattagccaggcatggtggcgcacgcctgtaatcccagctactcgggaggctgaggcaggagaatcacttgaactcaggcggtggaggttgcagtgagctgaaatgacgccattgcactccagcctgggcaacagagtgagactccgtcacacacacacaaaaataaaaataataaaaataaaattagttgggcgtgatggtgcgtgcctgtagtcccagctacacgggagggtgaggtgggaggatcacttaggcctggaaggttgaggctgcagtgagctgaagttgcgccactgcgctcttacctgtgcaacagagggataccctgtctcaaaaaataaggtctttctgcagatgactcacctagtaggtcaggcccccccaggataatctcccttttgattaacccaaagtcaactgattaggagccttaattgtatctgcaaagcctgttcagttttgtcatgtaatgtggtccggtcacattcccgggtgtaggagaggggagtagacagagcctgggggccatcctagaattctgcctaaacattcacctcggtcacctccaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggtgggcaagcctggggcatagccaggatgcggggacagttgggtggggtgtcagtggagtggctgggactggtgggggtagggtgggaggtggagaaactgggaggggccgaggtggagtgagggtgtggggagcgtgggaggggcaagggtggggcatgaggtagagggactgaggggtggggatggggttgggaagagcaggggtggggtgggaagtggtagagaagctgggaggggtggagaggagtagggagcctgggaggggcaggggtgagtgggagtggaaagcctagaggggcgggggggcaggggtgagggagtggagagactggaaggggcaggagttggtggggaggtcgaggccagtgtggggcagggggatggggtgggaggggtagggtggagtggggggcttgggtggaagggccaggggtgggtgggggctggagagtctggcaaggggaggggctggggaaggggttgggttggagtacgggtggaggaacatcccagcttatgggagaggcctggatatttggtccccaggcaggagtgaggtctcaccgcacacaccccctccatctagtagcgtgtgggaagacagggtgctgggctgggactctagggccggctagttggcctctagcctgagctggagtctcactcagcctcatgagtagctgggattacaggcacctgccaccatgcctggctaatttttgtattttttgtagagacagggtttcaccatgttggccaggctggtctcaaattcctgacctcaagtaatccgcccacctctgcctccaaaagtgctgggattacaggcatgagccaccgtgcctggccgacctcagctcttttgaatctttcttccttgtcattaaccctgcctcagtggctcctataccagcccaccaaaaaagcacccctgcccaccttagctggccagcgtgcccactccctccctagccacaagcctgtgccccacgcctgggccctgcttcgtccgaagcagccttcttccaatagtgaggaaaaccctgaactcctgttactgacagttgtcattcatcccttgaatgcttactgtggttccccggaaacaattacctggctggcctcggttaattctcacaattctttccagtgctatcactcatgtgtctgtccactgctaccttggctttctccaaggtactttctccaagactcagttccttccttggtctctggtttctccagatacctgcccatggcgtgcctgggtcctgcctcagggaatccagcctggatagttgccagaaagggttgtgaggattggatgcccccctttgtctttgtcttttcattcattccttcgttcctttcttcccttccttccttccttcctctctctctctctctctctttctttctctctctctttctctttctctgtctctttttctttcttttctttcgcacttgtcacccaggctggagtgcagtggcgcaatcttggctcactacaatctccgcctcccagattcaagcgattctccggcctcagcctcccaagtagctgcgattacagacgcccaccaccatgtctggctaattttttgtaatttcagtagagatggggtttcaccatgttggccaggctggtctcaaactcctgacctcaggtgatccgcccaccttggcctcccaaagtgctggaattacaggcgtgagtaccatgtccggcctccttccctttcatttcttctcttccctttcatttcttctcttcccttttcctcccttcctccctccctcccttcctttcttccttcccctctgttctcttccttccctccctctctcccctctgtccatacatttttgttgagaaccttttctgtgccaggtagttgcaggcactcgagcatagagccccatgtagacctggcccctgtaagctgacctgcagcaggccagaccaggccccatgtgtgcaccctcctctcctggcctttgtgtcctccttaactaacacgggctctcttgtccccctgccttggtacaggcccagtttgacctggcctttgtcgtccgctacaagcctgatgagcagccctcactgatgccacaccatgatgcctccaccttcaccatcaacatcgccctgaaccgagtcggggtggattacgaggtgagcaggagccagccggggtcaaggggccggcaatggggatgaggagggctagctgaggagaggcttcagggtggttgaggcagaggggccccaggtaaccagtgccagagaaccagaaaaaaaaggatgtgggtctgtgggagggcttcctggaagggttcacagtctagcaggaggaggggccaggctcttaagctactattttaagagatttttgggctcggcatggtggctgatgcctgcaatcccagcagtttgggaggccaaggcaggcagatcacttggggccaggagtttgagaccagcctggccaacatggcgaaaccccatttccactaaaaatagaaaaattagctgggcgtggtagcacacacctgtaatcttagctacccagaaggctgaggcatgagaatctcttgaacccaagaggtggaggttgcagtgagctgagatcatgccactgcactccagcctgggcaacagagcgagactctgtctccaaaaaaaacaaaaagaggttttttgaacttagccctgggctgggtgctgtggagaacactcataaaaacagctataatccttttttttttctttttcgagacagggtcttgctctgtcacccaggctggagtgtagtggcatgatcacagttcactgcagcctcaacctcctgggcccaagcaatcctcccacctcagcccccccaagtagttgggaccacaggcgtgtgccaccatggccagctaattttttttcttgcttttagagatggggtttcactatgttgcccaggctggagctataattttttgagagcttacaacaaacatatcaggcatccctaatccaaggattctcaaccaggagcaactgtggcctgcaagggacattggcagtacctggagacataattggtttttacaactatgaggggctactggcatctagtgggtagaagtcagagatgcccgggacagccttccacagcaaagtgtctatagtggtgaggttgggaagcttgatcctcagctctcaattgtaacatctcatttaattctcactatcctgttctgtttaaccctcattttacagaaggggaaactgaagctcaggttggtcacagttagtaaagagtggaggtgatgtctgcccagggctgcctgactccaaggacagagctcttgatcacttactctttgggtttttttttttttgagacagtctcattctgttgcccaggctggagtacagtggcgcgatctcggctcactgcctcctgggttcaagtgattctgtctcagcttcccgaatagctgggattacaggcgtgcgctgctacacccagctggtttttgtatttttagtagagatggggtctcaccatgttggccatgctggtcttgaactcctgacctcaggtggtccacccgccttggcctgccaaagtgctgggattacaggcgtgagccaccactcctggccactactcttcatttagtgtcttccttagcagcgcttgtggctgtcactccagaaggcatccccaggcaggcagtgctgagggccacttggccatgacaggagatcatgacgggagaacagacgggcaggggggcggtggggaaaggccactgatgctttctgtctcccagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaagatgctcagggcgagtgggtgtgtgtgtgtcttggtgtgagtgtctgcagggagagaggttttaagagccctctttttttttttttttctttttttgagacagagtctcactctgtcttccaggctggagtgcaatgacgctatccccgctttctgcaacccccgcctcctgggttcaagtaattctcctgcctcagccttccgagcagctggggctacaggcacccatcaccacgcctggctaatttttgtttttttattaaagaaagggtttcaccaggttggtctggctggtcttgaactcctgacctcagatgatccacccacctcggcctcccaaagtgctgggattacaggcatgagccaccgtgcccggccaagagccctctttttagagcctttaagaaaggtcatgctagcctctcgacccctgagtagctgggattataggtatccatgcctgacacatttttgtattttttgtagaaacggggtttcatttcaccgtgttggccaggctggtctcgaactcctgacctcaggtgatccatccgcctcggcctcccaaagtactggattacaggcgtgagccaccatcccaggcctgaaagtcttttaaaaaagatttttgaggccaggcacagtggctcacacctgtaatcccagcacttaggctgaggcaggcggattacctgaggtcaggagtttgagaccagcctgggcaacgtggcgaaaccctgtctctactaataatatgaaaaaatcagccggttgtgttggcatgcgcctgtaatcccagctactcgggaggctgaggcaggagaatcgcttgaacccaggtggtggaggttgcaatgagccaagattgggccactgcactccagtctgggtgacagagcaagactccatctcaattaaaaaaaaaaaaagattttttagtcttttcattttcaaaattgactcattgtaaattcaaacagcacaaatcttaatctttctgtcatcctttccccccagctgctcagttcctctctctgaaagccaccatgtctaatctgttttttgaacgttcttgagctggtttgtgccgacacaagcctgtgtgtgtgtttgtgtatgttagggttatttttgtttttgtttttgagatggagtctcactctgtcgcccaggctggagtgcaatggcatgatctcggctcactgcaacctctgcctcccgggttcaagcaattctcgtgcctcagcttcccgagtagctgggattacaggcacccgccaccacgcccagctagtttttgtatttttagtagatatgaggtttcaccatgttggccacggtggtctccaactcctgacctcagatgatccacctgcctcggcctcccaaagtgctggcattacaggtgtgagccactgtgcccggcatagggttgtttttaactgttaacttttttctgattacaaactcatcttcaccatgaaaaagtcaaacaaaataggtaacatggggggccggatgctgtggctcacatctgtaatcccagtactttgggaggctgaggcgggtggatcacttgtggtcaagagtttgagaccagcctggccaacatggcaaaacccccatctctacaaaaaaatacaaaaattagccaggtgtggtggcaggtgcctgtaatcccagctacttgggaggctgagctgggagaatcacttgaacctgggaggtggaggttgcagtgagccaagattgcaccactacactccagcgtgggtgacagagcaataacctgtcaacaacaacaacaacaaaaagtaatatggaccgggtgcagtggctcatgcctgtaatcccagcgctttgggaggctgaggtggtaggatcacttgaggccaggaattctcaaccagcatggccaacatggcaaaaccctgtctctattaaaaatacaaaaataaggtgggctttatggcacatgcctgtaaacccaac

SEQ ID NO: 13910 - DNA, 40897 bp, Human
aggagtttgagaccagcctggccaacatggtgaaatcccgactctactaaaaatataaaaattagccaggtttggtggcgggcgcctgtaatcccagctactctggaggctgaggcaggagaatcgcttgaacccggaaggcagaggttgcagtgaaccaagattgtgccatagcactccagcctgggcgacaaaagcaaaactccatctcaaaaaaaaaaaacaaaaacaaaaaacagaaacaagtaatcagagccaccagggcacagacaggccaacagagggcatagggtcatctggcagtctggttaagaaaataagacaaacacttaaaaacaaacaaaacacttgcacagcaatgggcaaacacacagtagtgaatgggtgtgtggtgacatggcacaacagaggaaagcccaggtgaggttcatttctttcagactgtccaccactaaccctgtgtacctaaccatttggggtcttagactcttttgacaatctgattaaatgcactgctcccttcccctgaaatacacacacaggtgcacagactacacggggatacatccaaagacaaggagttgattccagactaagaaccctgggccaaagctttctccctctagggctgctctctttcattctgacctcaaactccagattctcagtggggatggctgtggggagtgaggaacgggggcgggggggaggagtaacagcaagagcagccagttggctttcctccagcgtttaagggcgcacctcgttaattgcttgctggaacagaacctagagtaggaggaagctgaaccacctgtaaaccctctgattttcaaagacttattgcattcctagtatatgccacgcatgtgccatatttgtaagccaactcccacgatttatccgttatcagctggactcccatagcaccctgggttgtaactgtgggtgaaaaggcctgtctcctttctctttccccagttccctgagacaggaccggtgtcctgcctggggtatccccagagtttggcacacggtgatagccaacattcactgagcgccaaagggccaggtgctgccactctctcaaaataagcctctgccacttactgaacaactagtctgcgccaagcactgggatactaagcctacgactcccagaaaggtcccggcggacccccgtgcgcagcgggacgcagtgggcgccagggaccgcagtgccccgggcccagcgctcttctccaggtgatcgccggggaggcaggtttaaaaggcaggagccggaagccgtctcggcgcccaggtggccgagaatccagtcaccaggtcactgagtcaccgatgggggcgaggacacgggcctgggccggtcagaggggcgggatcgtcacccctggctcaggggcccctccgtccaggcagggagccaaagtcagtcttcgcttgagggttggcggtcgctggaagtggtagccattgggagttacactaatcccgcgaagggtgcgcaagggaggcggcagccccccccaagaagagaggcaggccggcctccagcgctccccgcccacaagcacgtccttgcccccgggaggttgtttgccggctccaggatctccctcccggcgaccccggcctcgccgtcactcaccctccagtcccgggtgactcagaacgctcggccgccggccgcaccactgtggccgctgcaggggcggggaacgcagtgaaggggcgcggcgcaggtgtcaggttgctggagaggcgggcctacagggcggaaaccaccggcgcgggtgaccggaagccccgcccccaacatggccgtgcccacaggtctcgttggaggccgtgcctttatcgtcatgtgacgcgagtcctcgccccacccgtctgcagccactcctggtctcagtcccagagctcgagagggccacgtgaccgtcccggggccagtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctggtaagaagccggcggagtcggcctggggagggggcggttgctaagggactgagagaggcgttgccgggggtggggccgggccaatctgggcccgcaggtggcagcgggtggggcctggggaccgcagccagggctctcgaagcgtctaccctgcttcacgtgcctaagtctggggtcttttctcataacccctcctggaatctgagggagaatccaggccagctccagtaaatcccacccatgtttccttttatttccatctgaaaagagtttggaatgaaacaagcgttttcagaatgagcttcctcacaggactttgtgcttatcatgctgctgttttagcttctccagtcctttctcactctatccctcaccctttctgggtcactgacagtccagcttccccctgcaaagcatcctgggaaaacttgagttgtgttcccagagttgacaagtcctttctgatttcagatacgtcacactgtcaaatggaacctgcatttttaccccccttttcagctggcgttggacatctttgaggtgtcctgaagaggagggtggttatttggagactatcagtggaaatgaagagctcagctgatggctgtagatcctcacccacatggtccctcacccctgaaaggttttttttgagggctggttcctatttgataatggctccagatgatttagaagctagccactgatttcagtaaatacttctgcctccttccactcctaaccactaaaaaaggctccctctgcggatctgtttttctagaccatccttggagaaacacaggaggaggaggatgagattcttccaaggaaagactatgaggtgagctcctttgatactgcttgggcaactaaagtagtgagtggcctggtcacttcaggccgaagcattatgattccaaccagagatgctctttgaccttctgtcccagggagtgagtgggtaagagaacttccttctaggaaagagactgtttagcaagcccttttctcaccttaaccccaaaacaaggtctggtgtttttacacgtttataaatctgtggcaccttaacctggatagagtatgtatttgccattaaactgtttgcttttacagcttacagagagacttagagtgaaaggcactggcaggcagtatgtgcccctaacaggtgtgtgcttataaactgttaaggaggccttgcttctcttctaggagagcttgcttttcagatattttcttgctcaagcagcttctctctgacatgttcttgattaagttccacctttcatgtatgggattcttagagtatgtgtttttagtaaagccaacactgctggggtgaaacaacatgcgtgactttttatcattaaattcttaaacgtaataaagaaggtagagaaaagcctataactccattcattaaaagatgactgttaacaccttactaagtatctttctacatccttacccatgcttttatatacatgatacatgctttttttaagtaacaaaaatgagattccactaaatcatctattttaacctgtcccactcaccccctttattatactttttgtatcattaggtaattttccacaaccttttcttttttttgacagagtctcactcttccataaattcttcatgctgtagaatttagtgtcagcgttaggatttgtagcacttttttgtttaacttttattatgaaggatttcaactatatgcaaaaacagaataatctgttgaaaccccttgtcctcatcacacagcttccacagtgatttagctcaagcccagtcttcttttgtctgtgctttcgttatccacttctcctttctcatattattattttttattgtatgtgtgtgtgtgtttgtgtgtgtgtgtgtgtgtgtgtgtgtgtgtgtgtgtgtgtgtgttttaaagtaaagacagtctccctatgttgcccaggctgttctcgaactccttgacaccagcgatcctcccatgtcagcctcccaaagttctgggattacagtcatgatctaccatacctggccgcccttcccatgttattttgaaagaaattctgtacatcatattatttcacccataattctatatgcatctctaatggataaggacttttaaaaagcataacccaatactattaccacatctaaaaaattaggaatttcttgatatcaaatatctactgtccagattttccagttttcttgtaaatgtcatatgtattttaactttatttgaattaggttccaaaagtccttttttatttgtttgataaatctgttaaatctcttttaatctgtagcttcttccttcatcttttttttttttttgtaagttatttgacaacataattaggacctgggattttctactgtctagattttgccatttggagccgtttgtatagtttaatatgctactctgatgggactgctttgaatgaaccaaaaagcactgtatccactgctgtgttttgttctatttctttttttttcttttttttaaatttgagatggagtctcactcttagtgcccaggttggagtgcaatggctcgatctcagctcactgcaacctccaccccaccctaggttcaagcggttcttctgccccagcctcccgagtagatgggattacaggcgcccaccaccatgcccggctaatttttgtatttttagtagagatagggtttcaccatgttggccaggctggtctcgaactcctgacctcaggtgatactgcttcggtctcccagagtgctgggattacaggtatgagccactatacctggccattttcttctgtttcgtaagtatttgttttcttgtacatagttgagaagtttgcaggaattagtataagatactccatattgttctgtcaccttgcactccctcactgaaccctgttacatcatcctgactgtatcaccaggactgagactgtctcacagccttcatcctacttctaggagctcaccaaggcttccccattgacacccaggctccctcaccccttctactaaattgtacttacatttgtaatgtgcttgccttcagctgatatgcatattcatgtaaatttttgttgttcttgtcattgtttgagacagagtctcactctgtcgcccaggctggaatgcagtggtacggtcttggatcactgcgacctccacccccgcctctgagttcaagctgttctcctacctcagcctcccaagtagctgggactacatgcatacaccaccatgcctggctaagttttgtatttttagtagagatggggtttcaccatgttggtcaggctggtcttgaactcctgacctcaggtgatccacccacctcagcctcccaaagtactgggattacaagcgtgagccaccacgcgtggccatattcatgtacatttcatgggttaatgttcttttgatattggtcattgatatttctcaaccatcttcaagaatgagcttcttgagagcacttgctttgtgtaagaacaaattcaggcacttaaacagaaaagtctggattttatttattcaataaataaatcaacttgacacaaaaagtataataaagaggggagtgagtgggacaggttaaaatagttgatttagtggaatctcatttttgttatttaaaacacgtgttaaaagcatgtgtataaaaacgtgggtaaggatgtagaaggatatttagtaaggtattaatagtcatattttaatgaatggagttatagggttttctctaccttgatagtcagtcaactagaaaacccttctgttgaatatctttctaaaaagtgccccttcttcctgtctcaggaagagttcattgcacatatttgactctttatttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacccctagctcacaaccagttgaaggtggttttggtgtgaacactaagatgccccttcctggttgaattggggctggttcagcccccacctccctcccggccaggtgccattttgctcgtaaccccctgtaacagccctgcaagacacagataacattttatttttttaaaaagttgttagtcccctaaaccaaagagcaacatatactgcagaaataaaaagttagtcatagcaaaggagaagtaacagtatctggttttaataatagctcatatattccattggtacatatttacaaagggccaaactcaactaatttatttaaaaaaaaaagaagcgtggcacagtggctcacgcctatatgctcagcactttgggaggccaaggcaggaggatcgcttaaagccaggagttcaagaccatcctgggcaataaagtgagactttgttcctacaaaaaaatttgttcaaaattagcagggggccgggtgcagtggcccacacctgttacccccacactttaggaggctgaggcaggtggatcacttgagcccaggacttcataccagcctgggcaacatggcgagactccatctcaacaacaaatacgaaaaaattaacgaggtgtggtggctaacctgtggtcccccctactcaggagatcgaagcaggtgaattgcttgagcccaggagacggaggttgcagagagctgtgatcacgccactgcactccagcctgggtgacagagcgagaccctgacaaaaaaaaaagggattctggtgttctagcgttgcggttgtttctaaatgcccttcttagcagttttattgcactataattggcatactattcagttcacccatgtagagtgtacaattcaatggggttttaaaaattagtatattcacagagttgtacaaccattcctacagtcaatttttttttttttttgagacggagtttcgctcttgttgcccaggcaagagtgcaatgttgtgatctcagctcactgcaacctctgcctcccgggttcaagtgattctcctgcctcagcctcccaagtagctgggattacaggcgtctgccaccacacccggctaattttgtatttttagtagagacgaggcttctccatgttggtcaggctggtcttgaactcctggcctcgggtgatccgcccgccttggcctcccaaagtgctgggattacagacgtgagccactgcgcccagctaattcctacagtcaattttagaatattttcatcacctgagaggaaaccctgcactcattagcagccactgcctgttctccttgcccctgactccaggcaaccagtgatctcctttctgtctatttgcctattctagatatctaaaaaccttctaaatgtttacggaaccatatcattattagatggaaccatcaatgaagtacttgaccagtaatttccatacatattttggatgaaggcaagggtattgtttctcctctgctctcaggcaccactcgcggaacactgctaacaccgatatgtggaggttgtttccccactactcaggaggctgaggtgggaggatggcttaagcccaggagttggaggttgcagtgaaccgagattatgccactgcactccatgctgggtgacagagaaagaccccatctcaaaaaaaaaaagtagtaggttgtcacctgcatttctcagcagctggcagtgaattgaaggttcacaggactccctccttgagtttggttaacttgctagagcgggtcagaaaacacagaaatgctacttacatttgctagtttattaataaaggatatcataaaggatacagaagaacagccagatggagagattcaaggaacgtgggagggggcacggagctttcatgccctctccaggcacgctaccctccaggaacctccaaacggttcagctgtctggaagctctctgaaccttgtcattttggagttttatggaagcttttttatgcagtcatgattgattacatcaccagcccttggtgatcagcttaaccttcagcttcggtctcctccctggagggatgggtgtcccaccccgctaatcctgccttggtctttctggtgaccagccccttttctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctccaccctcacactttgtctctcccaaagcacaggatgaggctcttctctgccgttcccttatctacctagaaactggacctaccagagaggaacacagttgtctttgatccctttcctgaaatgtcattaaccagggaacattaaaactcatcttacagaggagactgaagaccaaacaacatacctagagcctggacaaactgtcccaaccgttgtttgttcactgtcccatacaatttccaaagagaatcattcacaagatgatatctgcttcccagatccattcattccccactaagaattatttcctcccacatccctatctccccttcccctgtgaagaagagtatagaagcgtctgtacctcgctggcattattgggtaatcattctgcagttcccctgtgcaatgcatgttaaataagtggatgcctttgctcccattaatctgccttttgtcggttcactttcagcagacctttagagagtgaaaggggaagcttttcctcttggccgctacaatacatatgtaggtgcatatatgtttaatcacttatggatgagtctagtttctaaaagtacttttttcatcactgtgtttcttttctgatcagtaaaaaagattttttttttttttttgagaccgagtctcactctgtcgcctaggctggagtgcagtagcacaatctcggctcactgcagcctctgcctcctgggttcaagcgattctcctgcctcagccaccctagtagctgggattacaagtgtgtgccaccacacccacctaatttgtgtatttttggtagagacggggtttcgccatgttggccgggctggtctcaaactcttggcctcaagtgatccacctatctcggcctcccaaactgctggaattacagacgtgagccatcacgcccagccgatcattttttaaaatataaaaaagcacaccatttgtgctatgagaatttcagacaacacccagaaacaaatatctccttaagcactacctcacggatgttttcccattatgaatgctgacgtacaaataatcctaattttgtttaatcaaaaagggatattatacttttaattctccatcctgctttatttttattttttaattgcatcttgctcttttgctgaataatttttggagattttccatatctttctatatagacttaactataatcattttattggtgtatagtttactatatttggatgtataattgatttactcagtcacttgttggtactccaggactcataaaaaaagaatttggactaactctaggtagtcatatagatagaataaattgtcactcatcacatgtgtttggctgacttgaaactattgtctgggagtgtggctgccacccagccaatgtccagctgatgtgggtaggaacaggttgtgggaaggagagctgatggccgaccattatttttctttgttgccaaactgctgcgtcttttttttttttttttttgagagtgtctcactttgttgcccaggctggagtgcagtggcatgatcttggctggctcactgcaacctccgcctcctaggttcaagcagctctcctgccctagcctcccgagtagctgggattacaggcgtgctccaccactcccagctaacttgtatttttagtagagatggggtttcaccatcttgcctaggctggtctcgaacttctggcctcaagtgatcctcctgcctcagcctcccaaagtgctgggattacaggtgtgagccactgcacccagcccagactgctgcttctctaacaagacaactaaaatgatttcctttgaattgtttctctaaatgtctgtggcatacctgcaagttgcttgcaggatttctgtgttttgtgatgcatgttgtaaaggatgctgcttcagatgtagaagttttaggagccgagagccaagctgaatctgtgcctcttcctaacataaagtggaagttggccaggcgcagtggctcatgcctgtaatcccagcactttgggaggctgaggagggcggatcacgaggtcaggagatcgacaccatcatggctaacacggtgaaatcccgtctctactaaaaatacaaaaaaattagccgggcgtgttggcaggcgcctgtagtcccagctactcaggaggctgaggcaggagaatggtgtgaacccgggaggcggagcttgcagtgagctgagattgcgccactgcactccagcctgggcgacagagcgagactccgtctcaaaaaaaaaaaaaaaaaagtggaagttgcttttaaaaatactttccatgttagtttgtcttgtgactaacctcatttccatagacactaactacaaaagataattataactaattgacattctaaattaatttggttctggctaactgaaacttttgttcatatctaatggagtaagtttcataaggctgatgatagctgaaggtctttaaatattttgccaaaacaggaagtttaaaaataggtaatttaaaacttctcctaaagcatgaagtatgaacctaaagcaacaccactcaaattttaatgtgcatctgagtcatctggggctgcagggctgcaggagtctaagattctgcattttgtttttgtgtttgtttttgaaacggagtctcgctgtgtcacccaggctggagtgcagtggtgcgatctcggctcaccacaacctccacctcccaggttccagtgattctcctgcctcagcctccaaagtagctgggactacaggtgcgcgccaccatgcctggctaattttgtatttttagtagagacagggtttcaccatgttggctagactggtcttgaactcctgacctcaggtgatccacctgccttgacctcccaaagtgctgggattataggcatgagccaccgcacccagccagattctgcattttgaaccagctcctcctgggtgctgcaggtaccactgctctgcccatccacacgttgagtagcaggaacccagaggtttgtccctttgcaggtcttctcacctgacatgaccttttgactcaactttgcctcttttcagagtttggattatgatcgctgtatcaatgacccttacctggaagttttggagaccatggataataaggtgggtcttacaattcttcatctctggggatcaaatcagtcttaacatggcattttttttctcttctaaaggccccagtaaacatctttacaccttgttttttgaaccttttcatgcgatacaggcagacctcactttatgcgctttgctttatttcacctcgcaggtactgcaggttttacaaactggaggttggtggcaaccctgtgttgagcaaggtgccatttttccaatagcatgcattttgtttgcattttttagccataaagtattttttaattaaggtaggtacatttttgtaggcataatgctattacacactttatagacctcagtatagtgtaaacatcacttttatatgcactgggtaaccaaaacactcgtgtgactcactttattgtgatatttgctttattgtggtggtctagaaccaaacccatgctatctgcaaggtaggcctatgttggcatttattccctaggcctttatcctgccaaccagagttccccctgtcagtgcaccttgcccagcctcttaagagtccatcatttttgcactgtaaagcacctgaaatcccaacatcatctttactgtgcctgctctccacgtggaatttagcttaaaactggttggccaagatgtatttcttcccctctgccaccataaccctgtaaactgaatcattcttttcctgtgtgaacagaaaggtcgaagatatgaggcggtgaagtggatggtggtgtttgccattggagtctgcactggcctggtgaggaggcagggcctggagggatggtgggccatagggctggaggggcttacagggaaagccctggcctggtgaataacattgtcatttgtcattataacatttataacattataatgcaataacacttgtcattataatcaagagtgccttttcttttttcccttttttttttttaaatgaataatcctggcacagtttttcacacttcccctgcttttgctttgtgaaatgaaagcgagacacatgacaatggtgctcttgaagcgctcaaaggtttgggcaggactttatcttttatgatatgattatggatcataatctctaatctacctagtaaactagatgtctccctaatgggtagataatgcattgggtagagtaaataatggaagttaaagttacttttttttttcttttaatttaaatagagacagggtctcgctttgtcaccctggctggagcacagtggcgtaatcacagttcactgcagcctcgaccttctgggcttgggtgatcctcctacctcagcctcccgagtggttaggactctaggcaggcatgagatcgctctttagggaaaaagcgaagtcgtgggtacggaactgtgaacatcgtgcccttcatttagcacagcgtgccagtgaacagggtggcacaccatagctattgatctcatgcagggagtttatggtgctatcctgggctcctccccgtacgtcgttaatgttatctagaagatagagccagcagctgtgagtgaagggatatgcccgtatgaacagagttggtggaggcagcaacttcacaggtgaatcaaagacaaggcaagattggaaacatggccaaagatgaggatagcaaaaagtctggaaccaaaactgccgacttcacattgttaaatatgaggaagagaagctggaaaaatcagcatcagtcaaaaagatccatgtcaaatctgattccggtcagtacagtgttgggatagggtatctgtcctcagtaacagcctgttgaccacctttatcttgaactggccacaagcctcctacttaatttgacatgatatgcctagaaaatgtacacatgtgttcggtataatatagccacaggggccaaccacaatttttattttcatggcatgcatcaaatttttactatagtaaatccacaagtaaaggaacatcttactaggtaagactgatggcattcagaagccctcttcagtgatattctgatggataccattttggggaaacttgggttgatttattgttttatttaaatctcagggtgttgggccagggacggtggctcacacctgtaatcccagcattttgagaggccgagacaggaggactgcttgagcccaggagtttgagaccagcctgggcaacgtagggagaccctgtctccttaaaaataaaaaaaaaattaaaaaaaagaaatctcagggtatttattttgctatatatgtttctggttgcagatttctctataataagcatagtccttaggcctctagttgttagtgtttgtgctacttttatatcaaactctttggagctgccacttgtcagtactacaggttgagtgttccttatcagaaaatccaaaatgctccaaaatccaaaactttttgaatgctgacacgattctcaggaaatactcattggcgcattcagattttggatttcaaatttttggatttgggatgtttaatcagtataatgtagatattcgaaaaaaaaatctgaaatccaaaacacttctggtcccaagcatttcagataagtgttactcaagctgaagcaactttacctcctacctttgtattttaggaaggcacacctgcctttatgacatagcactcccaactcttgtccattgatgtgtggccactttatggcttcagtatcaaaaagcctccaggcattggcttgagggaaggccagagttaaaggcaagaagctttgatcctgaatccataaaattagaagtctttctagttctcctttaagccctgagcactttggagagtggaatactggaatttggttgttttctctacccagagtaactatggactataagatggttataagtcaagcctggcacagtggggtgtgcctgtaatcccagctacctgggaggctgaggcaggaggatctcttaaaccctggagttcaaggccagcctaggcaatatagcaagaccccatctcaaaaaaagatgatttcaagtcaaaataatgacttacaaaatagaacctgctaataaggaacatgcaaaaagcacatacacctaaatgaatgttgtgttttaaagcaagcttgtccaacccatggcccaacacagattcatataccttttaaaaacatttatgagatttttctgagtttttcttttcttagctcatcagctgtcattagtgtattttatgtgtggccaaagacaattcttcttccagtgtggtccagggaagccaaaagagtagacacccctgtgtcagtagtctttcttggtctcacatctttttctgcacctgcttccctctttgttttccgttgcttcactcaacttagctgtactctctgcctttgttctttggaggggcagtgggactgggctggagaagggatctcctccttctgcgcttttctgctgtgcattcacgtactgctggctggtgagcagcctccgtatgtgcagtgggggaggagatgccttcaagaggagcacacctgtactatacttgtgctacacttggaaataaggctgtgtgacagatctcttgctcttcacaggtgggtctctttgtggacttttttgtgcgactcttcacccaactcaagttcggagtggtacagacatgtatccttttcacggttcctggtgttcgtggacttcagtggtcaccaagattctttcttacatagaaatgggtctaacagtaagcatagtattagaagggccgcttattagctattcagctttaatatttctaatgatcactgaaggacacaaaagaaggactttaataagcaaagacatatacctatgtttgtggttgataagattacagatgccgcaaagatgcctgtactccctaatctgtaaatttaatgtagttccaatcaaaattccaatagaatttgttgtggaactcagaaattctttgtaaatttgtgtagaagagtaaagggccaaaagcagtcagtatagttctaaatgacaagaaggtggacttgaccctgtcagatatcaagtcttataaaattaacaagtttggggagttagggaaaaaaaagtcataaaatttaagatacagtcattgaaattggtcatattggtgcaggaatacctagacagtggaaaatgatagagaagcagaagctggtcctcacatacatggaactttggtgaatgacagttaatattacaaatcagtgagggagtgatgaatgatttaataaaagacgctgtgttatttaataaataaaagatacacatctctgtagtcccagctacttaggaggtgagcccaggagtttgaggctgtaatgcaccatgactgtgcctgggcagcatagcaagaccctgtcttaaaaaaaatgatgctgggacatgggtgatccatatggaaaaatagttatattcctatttcatactataaataagataaattccagatgaagatgtaaatatgcagaacaaaacttcgggagactatatgttgtcaagagtggggaataatttcttaaaactccagaaggcacagactataagaaaaaacatcaatggggccggacacagtggctcacgcctgtaatcccagcattttgggaggcagaggcaggcggatcacaaggtcaggagattgagaccatcctggctaacacggtgaaaccccgtctctactaaaaatacaaaaaaattagctgggcgtggcggtgtgcgcctgtagtcccagatgctggggaggctgaggcaggagaatggcatgaacctgggaggcggagcttgcagtaagccaagatcacgccactgcactccagcctgggtgacagagcaagactccgtctcaaaaacaaacaaacaaaaacatcaatggctgggtgcagtggctcatgcctgtaatctcaggactttgggaggccgaggcaggcagatcacctgaggtcaggagttcaaggccagcctggctaacatgacaaaaccccatctctactaaaagtacaaaaaattagctgggcatggtggcgggtgcctgtaatcccagctacttggaaggctgaggtgggagaatcgcttgaacccgggagacagaggctgcagtgagccgagatcgcgccattgcactccagcctgggcaatgagagcaaaactgtctcaaaaaaaaacaacaaaaaaaaaaaacaaacaaaatcaataaatttgaccacatcaaagtacatattgtatttataaagacaaaaactccaaataacaacaataaaacaccataaataaagtgaaaacaagtccacagcctgagagaggttatttactatgcatttaagaggcagataattagtatccacaatacaggaagaggctgggcgcggtggctgacgcctgtaatcccagcactttgggaggccgaggcaggcggatcacttgaggtcaggagttcaagaccagcctggccaacatggtgaaaccctgtctctactaaaaatacaaattgagctgagtgtggtggtgtgcacctttagtccagatacttgggaggcagaggcaggagaatcacttgaacccaggaggcggaggttgcagtgagccgagattgcaacactgtactccagcctgggtgacagaatgagactctgattcagaacaaataatacaggaagaactcctgcaactcaatcagaaaaacaacagatggtccaatggaaggaaaacgagcaaaggatgtgaactggaattctcaaaagagaaaaactggccagtaaacctctagaaaaaggaaggtgcacattcctgtgactcatacattcctcttagaaatttgaaccgtagacatgtacaaaggtggtaattatagctttatgatagcaaaaagctggagtcaccaaatgggagaatggaaaaattatggtacattcatatggtatcattttagacatcatgtcatttctgtagattgtaaaataaaaattttagacaagtgaaagtgaacgaaccacagagttgtgtgtatcaacatggctaattctcaaagacttaatgttgagaaaaaaagagcaagttacagaatatacaagtgccgtgtacaacagtgtggacacttttgaaatacacacaataatttcaggttagtggtttctcccaggggagagaggaaggaaaactgtttttttttttgttttgttttgtttcttaaaatggtactgaatgttttcttttttaaaaatacctggagcatatatggcatgttgttgagatttgttaaagctacagttgtgagggtatgggtattcgttactttttgtaatgtttgaagtatttcctaatgtcaaaggcatctcaaacaattttttcttttttttaagagatgaggcctcacactgttgcctaggctggaatgcagtggtgcaatgacagctcactgcagcctcagcctcccaggctcaagcgatcctcccacctcagcttcttgagtagctgggaccataggcatataccttttgtactttttgtagcgacatggtctcactacattgcccaggctggcctccaactcttaggctcaagtgatcctcctgcctcagcctcccaaagtgttgggattacaggcatgagccattgcacccagtcatctcaggcagtttttaaaaaatttttatatatagagaaaaagtgcactcagcagccagcatgatccaaaggagaagcagctgcaccctctcaagtgatgacggggacacccctcggctgatgaacaagtttccttaacccagtttccgcagcggtggaggagtgcagccagaaaggctgcctcgctctgtctctccttgaactcctgggttttaacctcacctttgtcttcctggcaagcctccttgttctcattgaggtgaggtggtttggattcacctgctcgcttaggaggttttagagtcccgcactccttttccccacctccttccagaatgtcaggaaactgagaatgcagattcctgcagaaagtggcctcttgttcactaaaggtaaaggtttcacctctggtgagattaaagaagaaaggcctcccaggtgatgctcattcacagggaacttgtacagattctggggggaggaaaaaagggggaaagggctgaaaacaaaactgttgggtgccatgcgcactacctgggtgacaggatcattcatgtcccaaacctcagcatcatgcaatataccctcgtaacatacctgtacatgcaatccctgaacctaaaataaaagtggaaattatttttctttaaaaagtgcaagtctggccactttgggaggccaaggcgggcagatcacctaagatcgggagtttgagaccattctgaccagtgtggagaaaccccgtctctagtaaaaatacaaaattagccggtaaaaatacaaaattagccgggcgtggtggcgcatgcctgtaatcccagctactcgggcgactgaggcaggggaattgctggaacccagaaggcggaggttgcaatgagtggagattgtgccattgcactccagcctgggcaacaagagtgaaactctacctcaaaaaaaaaaaagaaaaaaaagtgcaagtcctcccattgcccctcagacctcctgagtcagatcctctggagtggggcccagcagctgtggttctgcaagccctccaggtgacgctcacgctgctaatgaaggtggccagctctccctcttccgccgcccagattgttgagggtaagccagagaaccaatggatttcgagttatgggtgtgcctgctctcctccatcagccggtggcagcaggttccgggatacccgaggtcaaatgctatctgaatggcgtaaaggtgccaggaatcgtccgtctccggaccctgctctgcaaggtccttggagtgctgttcagtgtggctggaggtaagaagggtccaacttgtatccttcaaatactcaaagggcagagacgacaagaagcatgatgtatttcagttattagatttggactgcagggcccagcctcaaacagctgatgtctgcactttttgttgatgggctgtttttaaatgcagacactgttcgtatgttaccattcagatacctgacaaacacactcttcagttttgggatttggaatttagcttgtggaattagcttttgtcaaaattagcaagctttttgtgtcaacagccagatagtaaatatttaaggctttgtgggccaagaatcagaatggaagctcttatgtagatgtttatgtaactatttacatgtgtgcatttaagaacgtaaaagccagtcttagttctcaggccgtgtaaaaccaggagggagctggtggtctgggctcacaggctctcatttgctgacacacaatttagaatgtagagtgttttctcttctagcaagacttgaaatggagcttatttggtgggaatttggctctttctcttataaagtcttaggatcatctctgttcagttgtcacgaggaaggtttttgtagccaaggtctcctgacccaggggcgtttctgcactgactgttggtctttcctttttcaccctgcccagggctcttcgtggggaaggaaggccccatgatccacagtggttcggtggtgggagctggcctccctcaggtaagatgggctgagagggtgtgggcctctgggcaggcctagtgggaggtctggttacactgggccaaatccattgggacaccctgacatcacattggaacctggtgccattctggcttcacgtgtaaaccatgtgtctatctctcaggaaagggcataacttatacttggaagttttaatgatgccctaccgagccctaggagcaaaaatgagacatagagaaaaactgtgacgtggcggatgaaagtcactgggtgcttccatagccatcaccaggcgcctctatatagggtggctgggtggatcatctcagtgctgccagatccaagaggctcgaagcatcgactgacatggttttaggcacagttccgtgctgattctagttggcgtggtacagtcataataactgctgctaattatggtctgtgtgccagacgccatgtatactaactgctttctccttatagccaccttcaatgattcgttgttattattacccccatcctcagatggggaaactgaggcttagagaggttgaggtactagctcgagacctcaaagctcccattcttgggggctactccagatccctggctgctgttggagaagtctcagttccctgtgaactgtcactcttagtcatttccctctccagtcctgagaagagggagttattgtggttgggagtctctgaggtgaaggagggaagattctttcgtccagagctcgtcttttggtctctctcctgctactgccttgagcaccagatctggcagaagtgagccaaggggtggaaggccaggcgtggagtgggcatcagtgtgcacctttgtggggcagacagaggacaggctctgggcccttctcttcctggcgctgctgagcagagcagactcggtcttctgcaacagcttccgcgtccccttccctcagctcagccatttgcctttattctttcagacttgttgactctgcacaaaatgggatttcagaaggtcctagaaacacgagggcaggaaaaataagctcctcccaagggtggggggtaatctccttttttcccaagtttttttattttcattttttgagacggagtctcactctgttgcccaggctggagtgcgatggtgccatctctgctcactacagcctccgcctcctgggttcaagcgattctcctggctcagcctcctgagtagctgggattacaggcatatgtcaccacgcctggctaaattttgtatttttagtagagacagggttttgccacgttggccaggttggtctccaactcctgaccttaggtaatcagccgtccgcctcggcctcccaaagtggtgggattacaggcgtgagccatgagctaccacgcccagcctccttttttcccaagttgctgttctggactttccttcctgcagcacacttacccaggtgtgctcaagcagaggggcctcccctgatgccgtggattcccatagtttcagtcctaggctgcccctgacctgtgttcttttttttttttccataattactggggtacaggtagtatttggttatatgagtaggctctttagtggctctcttttctcttgctttagtttcagagcatctccttacggaagatccagtttaacttcccctatttccgaagcgacaggtatggaaaggttagaaattggtttcttttttggaaacaacatgttcatgcgctgcgggtcagactcgacacttgctctagcctggcagtatcccctgcggggaaacccgactgggagaagggggcgggctttgaacttttcttctggaaataagaagccaaagcaccaggctggcatcgtgacttttattttgtcatgccgtaaggcctagaagcatctcaggcaaatgaagatggtcccagattaaaaacccaaccaagaaaggccacagacaggcatattcttaggaaggcgttttgtattccccagtgattcacttggtcagccaccctcctgggtcagaaggtactcttagtagacttcttagccctgtatcagatgtgtgtgttactgacctgccggcctcgtaaggctctttcaatcagagactcagtttagagtcacggaccaccttctttttgtattcctgcaagttcggcacatacccagaaggcaccttgatgtttttactgatgccggggttttctggaaggaagatccggtgggaacatggtgcagcagtgatcgtgccgatctttgatctgccccctgagctgggggctgagattctgagatcacagaaaacacagaggtcaggggctcctgttcccaggcagagtagccgccatgctgaaagggactctggtgctaaggtgtgtggctctcgggtggacacactcgcggcaaaggctgcctcaccagtgacctgcccttccaggatccctgcctattcattcacaggtgtgagaaaatgttcatgataaggaagtcagaaaccaccttttgggggctgggggctctttattggataacccgtctctctcctctcctcagagacaagagagactttgtatcagcaggagcggctgctggagttgctgcagctttcggggcgccaatcgggggtaccttgttcagtctagaggagggttcgtccttctggaaccaagggctcacgtggaaagtggtgaggaggaccttcagtgaaagcattaaccacaccccccgaattacactgggtgtcccttactcggtacatggaatggtagttttgatgagactgggggggtcaactggatcagaaacagctttcctcttgtgcccataacctccacactggactttctgtacttctcatatcaataccctccctaaccccaaatcaaaccgctgttactttttttttttttttttttttttgagatggagtcttgctctgttgcccaggctggagggcagtgacgcgatctcggcttactgcagcctctgcctcctggattcaagcgattctcctgcctcagccttatgagtagctgggattataggcacgtgccaccgcatccagctaatttttgtatttttagtagagatggggcttctgacatcaggtgatccacccgccttggcttcccaaagtgttgggattacaggcgtgagccaccacgcctggccttgttatcctttcttgatgaaccacctgacatgaaaatgtgaaactggctgttgtcataaagcaggaagtgatggggcttggactggagccggtcttctccctcagagcaggctgtccttccctttgcattgatccttccttttggtgcaaggtctggtctgtaaaggctgtaaataggctctcatagtagagtaggctgctggaacggaaacttcttaaagcccaatctagagttggtcatacctggggtgtatctactgtaagggtgactagatctctgtacccggatgtagattccggaggtctctgcgtagagcagtgggtaccaggaggaagggttgggagagagtaggacatgccactcctgaaccttcttgtcttttgtcacctctcccctagctcttttgttccatgtctgccaccttcaccctcaacttcttccgttctgggattcagtttggaagctggggttccttccagctccctggattgctgaactttggcgagtttaaggtatgttttgtcctttccccaaggatttttaatttgacccatgaaaatttcctctcaagtgaaggaccagagagaaatgagcagagggctaggtacaacttccagggacacatctcacccattagcctctgccgtgcgggaaagcagccccactcttgcttctgtcttctcttctgtctcttccggttctcatggctgctatggtttttctctccctctccctttccccttctctcagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcaggtatctgcacagtcgcctcccccccgagcctgctgcggctccctgagcttggtgtgggccgcgccatctctcccgaggagcggaccctgcctccacggctttgatttctcatctaagactgagaatctaaacacggccatgcatcttccctacttgacaggccaaagggctgagccagcttaattgatgtcagagttgctggttgactccctgcctgtcctgacttggccactcggacacatgacaaggttagaagggtcaccgtggccctgccgagcagcttgctctcaggaggcttctcgccccaggacttattataatggaaagccattcattccttggagagagatgatgtggacgtagcagcccactttaactgtccactttttacaaacaaattgctggaatacagcaaatcacggatcaattctgcacacatgttgactgaccaggggctgctgtgaatgctgtttggagaaatcggggctgggggtaggcagggttatgttttgaatttctgagaccagagcttctttctgtggcgttgtaacagctgtgctttgcctcctagagtcttagagagcctccttgtgtctctggtaaccaccgtggtggtgtttgtggcctcgatggtgttaggagaatgccgacagatgtcctcttcgagtcaaatcggtaatgactcattccagctccaggtaaccccagtgcacctgctacctttatcccataccacgaggaagaatccagaaatgtatgaccttcctctgttgagaactaatagatgtgttgggttcatccttccacacccattacctgagcgttgagagatatgggaatctgtagtcgtctttttacctcagagaaagtgcacaccacatgccctgtgtctttgccacttctgtgaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcatcacagaggggaacctgggaacgaccctggcgtcacagaggggaacctgggaacgacactggcgtcacagaggggaacctgggaacaaccctggcatcacagagggcaactcctctctgttgaacaacactcatgggaaacagacacttggaaagctgacagcaaggtgctttctgagccccagttactcttccacctccccttgcctgaaggggccacagcccagaggctcagcacccacctcatggcctctgtgactatgacagtcactcttgagaggaagaaatatctgtgtcagggcaaggaggcttctctcttcccagcatcctctgcctcttcccggcgttgggtcctttgtgggtgcgccaccctcctgcactcctccttttcccttcttggggggcgcgatattttccagaggctttccctgaggagtggtcccatgaggtagtccgtggagcctactccacgctgtgttctttcggtccaacccggaggctctgagagctacacctgtggttcagtgagtcagccagatgtgtgattccagcccttggctgcagacaggtgagcattctctaagtgcggtcggccatccacatttgtgggtcctgcatccatggaattacgtagggtcaaccaactgtggagcaaatatattcaggatgcaaaacataaaaaagaacaagacaacagtaaaaaataatgcaaataaaaaacagtacagtgtaacaattatttacatagcatttacattgtattagggtattataaataatctagagatgatttaaaagtatataggaggacctacataggttatatgcaaatatacaccattttatatctgggacttgagcatccctggattttggtatccatcgggatcctggaccctatccctggtgaatactgaggaacaactgtactcttttcttgttgcttctctgtaaccacttgaatctctcagatccccattggggcccttgtcttggaggacagcctcttcagtgtccccagttatatgtatatattttatatatatatatatatatatatacacacacacactatatatatatacacacacacacacacacacacaaacacacattatatatttctgtttgtttgttttgtttttttaagacggagtcttactctgttacccaggccggagtgcagtggcgcgatcttggcccactgcaacttccgcctcccaagttcaagtgattctcctgcctcagcctcccgagtaactgggattacaggcacccaccaccatgcccagctaattttgtatttttagtagagatggtgtttcaccatgttggccaggctggtctcgaactcctgacctcaagtgatccacccatctcggcctcccaaattgctaggattacaggtgtgtcaccacgcccagcctggtttatatatatatgtttttgtttttgtttttgctttttttttggcaaagtctcactctgttgcccaagctggagtggagtggcaagatctcggctcactgcaaactccacctcctgggttcaagcgattctcctgcctcagcctcccaagtagctgggacttcaggcacgcaccaccattcccagataatttttgtatttctagtagagacggagtttcactattttggctgggcttgttttgaactcctgaccttgtgatccgcccacctcggcctcccaaagtgctaggattgcaggcgtgagcccaccgtgtccagctggtttatatatttttaaagggttgagagaaaaaaaagaatatgccgcagagactgtacatcactggcaacttctaaaatatttactgtctggctctttatgaaaaagtttgccgacccctgttactagttattcccaagcctagctcattaccagacagataccttgatgcgtgtgatttaaagcatacaaaaaacgattctgtggtcaaatgggctaggaattaaatatgcttctttatctttttagagacaggatctcactctgtcacccaggctggagtacggtggtgtgatcatagcttattgtaacctcaaactcctgggctcaagcgatcctcccatctcagcctcccaagtagctgggactacaggtgcatgccaccacatccagcttatttttatagagacaggatctcactatgttgcccaggctggtctcgaacttctggcctaaaatgatctcctgttttaggagtgctaggattatagacacaagccatagcacccaacctaaatacgttcctttagtacagaacttctagggccttattcccataagtgttataaatgtttggtgtctttattgtgtaccagatattccactgagtactttatatgatttcatttaatccttatcagcactgtgcttgctggccagtagctgtgcccccattttacagctaaggaagctgaggcacagtatggtcttgaccaaaaaccttcagctagtcatatatagtgagagggtaggtgttgttaccattttataggtgaggaaactcacaaaatgaaatatccttctcaacgtcactagagagtggcagagtttagagacaaagccatctgattttggagcctgtgctcagcttttagcagacacactgatttccaagaattgctaggatgtttctcagtgcagttgaccacaggactctctggaaagccttcaggactgaacttcctccagacagtttgggaaacactgcatgtgtctattatgaagccatcagctgagctcatcccccgtgcactccacaacgctgaggctctgcacatggctcaccagtgccaggtgctgccagtcagcagtgccgtgctgtttgcacagcagcctgcatacgtctatattgcccagcccgtttcacctggcggggtcacacaaaccaccccctggtattgttagcacgtccacataatggcatctccacagctgtgtcatccagaagaaacccatagccttgattaacctttgtaataagactccctatttgcatgcacagtgataggtgtgaagtacaaccttgtaccgttgtacactgtcaactagaaaataaaacagcacacttgaaacacccttgccttctagcaaagatcccatcttcccacacagaatgatggcaagaaaatgaggtctaaaatgtgtagaagtagtagaagaaataatctctttttctgtttgggttttgttccccagatggggtctagaaggagaggcagcctggaggactgggtctgctctccaggcattatggaggtgggttttcttttgcagcaaattcaggtgcttttttttttttttgtagcaaattgcagcaaaatcaaaggctttttctatttggaaccagagttggggctttcggtcaagtggtgccctggattttcctccccagatacctgtcaactcccagtcacttgctctcacctgcctcatattcccccagtcctagggctctcaggccaggcttctagcagcatcacttagaaagttagcaccgggagaggaagcagaaccaaattcacggtgaatcacggccatagtgacattttcatcatgagtgtggatgaacaaaaggccctcatcccgattctttcatctgtgcattcagaatgtgaagaatacacttgcccgtgtggctgccgttggtagaggtcagtttttggcctgtttgattgatggggaaagctgtgcagccacctgttttggacccggctggagacatcccacttgaagactcaaagtcaggtgtccttgtactgattttctgattccttcttctcaggtcacagaagatgtgaattcaagtatcaagacatttttttgtcccaatgatacctacaatgacatggccacactcttcttcaacccgcaggagtctgccatcctccagctcttccaccaggatggtgagtgtctgcactgcagcccaatcgtgggtgattggtgtcatctcggacacagccaggcttgcccttcattccaagcaagaccaggacttctttgtaacgcccacccagacaaaagattggtttctgcctcctgtgttggaaggggaactggtatggggtgtggtcgggcccggtaggtctactgggccttggcaggcatccggtagtgggactcaggttggctcttcccttgcaggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaaggtactctgtgtgtgtgcgtgtgtgtgcgcatgtgcatgtgtgtgcacgtgtgcgtgtgtatgcatgtgtgtgcgtgtgcgtgcgttgatgtgtctgtgcccatgcatgcacatatgtgcataggcacaagagtatgagctgtaggtcctccccacagcctatcagtgtggttcaaagccatgttctcggtgttttccttcactagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtgagcacactccctccaggcccctgtcaggctcagggccacgtccgccccacaggacctatttttaggtctttgctttgtgtttcaggtggccaaatggacaggggactttttcaataagggcatttatgatatccacgtgggcctgcgaggcgtgccgcttctggaatgggagacagaggtggaaatggacaagtaaggccatgattttgctcatgtcctagtttcagaatgtataagctctgaggcctaaggaatgttgttattagggtaggaaacagtaactcacttttcttgggctgaaagaagcaacacacccattcctgagcatgtgtgagaatgtggagcagcccatgggctgggggctgcgggggcagggcaggggacacgggcactgtgggactgcagtgggcagggcctcttcgtggtggtttgactcccatggcattctggttagatatgaggtgaggtctctggatcaagttcgtgatgtgattgaatgtttaagggtatgccaagccccaggagtgagaatagcctgtttcacatgtgcccaccagaatgccctactgccagccgggattgttctgggcataatcacctcataacccacctgctaatccacaggtacctgggcttcctgtgtctagatagcaggcaaggcccttacgggctaacacgggggccagcaagccgtttctgtggagggccagacaggagtttattttcaactttccgggctgtatggtctctgtcacgactactcgactctgtcattgcagcaggaaagcagtaagcgtgacggacttgatcagtgggctacagtttgctgtgccctgatctaaagggggacccaagtgctgtgtttattttattattattgtttttcttttttgggacaggatctcactctgtcgcctaggctggagtagggtggcatgattatagctcactgcaacctatgcctcccaggctcaagcgatcctccacctcagcctcctgagtagctgggatcacaggcgcgtgccaccacacctggctaatttttaacattttttttatagaaatggggttttgctgtgttgcccaggctggttttgaactcctgggctcaagcaatctgctggcctcggcctcccaaagtgctgggattacatgcgtgagccgctgcacccagcccacccatttacccagttgtggtaaatgctgtagcagaattagcagttcaggggtagtatgtggagcgtgctgcagggcaccgaggagggcgtggccagcccctggaccagcagccagggcttcctggtgaggggatgttgctgttgagctgagggatgagcccgagcccatcagcctggtacagcagggtacgacattccaggtgcgggaacagcatgtgtcgggggatagaagtacaaaggaatgcatcgggtttgagggagagctggggcagttcagaagagccccccaccccgcccgtggtctgagcagggctggagagccagcacagcttgctcccaggggcctgcgggcactgtcatgaggctggatgacttgccctcctcccccaggctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaaggtaaagaaaacggcatgagaggaaaggcaggtgagagacaagcggtcccgtctcacacggcttagtgctttgcccacccctggctggggtggacttaccggctctcaggggaagttggcactgttctcatcacatgcgacagggagagtagatttgacagcaggggcagctttatcaggccgtgaagatgtgtgtgcgttcttgccgcaatgagcatgtggacagatctgtttttcaagtcagcagctttcatggtttgtttaccatgtgagagtatcagggagagttctagagatgccagcaacagaaatggacttcgacctccttaagaaagagaaagaaatccacaggaaagctcaggacagctgggaaagctgaaggaccagaaccatgtgctgtggggagcagtgcagggtctagcagacatcccttgggtaccaggaggaaggagcactggccctgggttcctcctgattccgattcagaatccagggagagggggtatcctgttgcctcacttgggtcatgtgccactccttggctttgggggcaggcacgttgattgaaaattctatcaagacaggatgtaggagatggcttgttcccctctggagaatcaagctgctcttcccagattaaaggaaaccacagaagctgcagccaggtcctagggttcaggctcatttgaaccaccagcctgagccactcttttgaacctcagccccattaagttcctgcgtccggatgtgcttctgaccctccctgtcacccaaatccttaagctccatcagtactgctgtgttcgtttgcccatgcgcagtagcctgtggcctccccacccacagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggaggtgagagcctggcggggcccccactgcccgcagggctacacagcggtggggtgagcctttggctcagatgttgtgaggtggctcctgagtttcctgggaaagttggatggggagcgggctgggaacatggatcagaagcgctcccgctgagggtatcccaggcagcatctggtttttgtgtaacagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcggtaagtctctccgaggcagaaatcagccaggccagacctgacgaagctcgaggggttgggcgctgccggcgggccgtgaacagtgccatagggaaagctgaatgcaaggcgagaagtgcagagtggacttaggggaggagtcgccacagccgggtggtgagaagcaacagcggtttattccttcatagttcaaggccagaagtacaaaatccgggtgtcaccagggcagcgctccctggctctggtgctgtccttgccccttcctagctcatgggagttgcctgcagaccttggtgctcctgactgtgaacacagcccccatcctcgccactgtcatcacacggcgttctcctgtgtatcttctctcctttccctaaggacgcttgtcaccggatttggggcccgccctaatccagcatgggttcatctgaactcggtcacatctgtagagaccttgtttccagaaaggtcgcattcataggtactagggcttaggacttggccatatcttttggtggggggacacattcaccccccagccactttacttagtgctttctcacttaaacttcctaataagccatttgcatctcatgaatcaggaagaaagggagtgcagacagatcaggggacttgcccagggtgccacagctaggacttggccaaggacttggtttgactggagagctctcactctggagcgcttgctgctgctgcaccacctgcctcagcagcctggagctgggcatattcaggcatcaaggggaggggctctaaggtgaccctgctggccactgctgcctgagcacggacagtgtctgggttggaattgcagagcgccagccagccgcgcctctcctatgccgagatggccgaggactacccgcggtaccccgacatccacgacctggacctgacgctgctcaacccgcgcatgatcgtggtgagaagggctgccccggcctgtcccatgcggagctgcctcttcatgccgttggcgtctcaggcagtcagtgacacgtggtctctttgcaggatgtcaccccatacatgaacccttcgcctttcaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccaggcttctcaccagaaacgtaggcatcccaccaggaggggagagtgtggcccaacactagctttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaattattgctgcagactttccttttttcttctttttagaacttcattattttcttattacacaaatattttcttattacacaaatatgatttcattgtaggaaaatacaaaaacacatatgagcaaaaaacaagcaaaaaccaaaccctcgtccctaccctgtcgcggtagccctggtaacttttcaaggccaccctctcagtcttttgttgttgttgctgttgttgttgttttgagacagggtctcactctgtcacccaggctggagtgcagtggcaagatctcggctcactgcagcctcgaccttccaggctcaagcagtcctcccacctcagcctcctgagtagctgggaccacaggcatgcgccactatgcccagctagtttttgtatttatggtagagacacggtttcgccatgttgcccaggctggtcttgaactcctgaactcaagtgattcacctgcctcggcctcccaaagtgctgggattacatgcgtcagccactgcacccggcctcagtcttttcttctatgcggcacaaccctggcatgcatagtgcgtacttacacaggttttgttgcagtaggttaacttatgtcccttgaaatgtaattgccaactacactgacagagtcctaacatagtttatgacgtggctttggagttcccaacaacagtgacacgtgggaaccactgtaacgacctgtaacaaatgactcccataggtcactttgcaaggtggtgagtatgaggcatggcaggggtcataatctcaggagacttcaagggccccaccgcttgcacatctgtgaagcaggctggtcatgatgggagctgagcgctgagcatgtgccctgtggaaggacattttagttcagatgccagctggcccaagccctttttggagctaaccttgtccccttggcctccaatgtgtgagccctcgttagctgtttatcccaatcaagctgtgtctggctgtgcactatccaggcctccacattctgtgacaaactaacagggccggctcctgtcactcctgttctcgccagcgggttttaccctgaaggtgactcaggccttctctttgccctagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctcctttagccttttgtctccatgctgctttctttctttctttctttttttgagacagagtctcgctgtcacccaggctggagtgcagtggtgccatctcagctcactgcaagctccgcctcccaggttcacgccattctcctgcctcagcctcccgagtggctgggactacaggcgcccaccaccatgcctggctaattttttgtatttttggtagagatggggtttcaccatgttagccaggatggtctcaatctcctgacctggtgatcctacccgcctcggcctcccaaagtgctgggattacaggcgtgagccaccacgcccggccctgctgctctttctttcaagggatacttgctttttattttactccccctctttctgatgtgtggaaattacactaggacgtagttttagagtctcagagctctccctatgcagctgggcagtggggctcttcattcttgcgggtccacttctctgtattagacagtgaccttaataagaacagatttcatcctgtggatcttagcagaggtcaccgttgtctgtttctcccttcagatgaacactcttcctgatcctctcctctagaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgtaagtcccaggggcattttctgccttgtgtttttgtcatttttcaatcagtttcattcaatgagaactccctgtgttacctgtgttacggtgacaccttgagaatgggctacttcccctcctagcaacccgcaacaccatcccagacctcaggagccaggtttgggccagtgctgtctcctgtcgctcttactttcatccttgtcattctctaccccctggttttcctggtatttaaagtccaggtagagaagattttgactggaggtggttaggtgaggctctccccccacctcaaccccctgccattagttcactgggagcctccccctttcctccgcaaggagcaagttactacttcatttcctcttttcccaatttctggacaagaccaaggcaatttgaccaacatttatggggcatcaactctgagagtgctgaaggggcatttgccctcaaagagcttgcagtctagggacgtagacacaagcaattgcacataggcaactcgtgttgtgtgctattataacagttacatgtgcaacactgcctacgaagggactcattgttactaggcatgaggtaccaggaaagaagtagtgttcatatgagccttaagaaatcagtacaatgtcctcgggaggaccagaggaaggacaccccaggtggaaggaacagcagaaataaaggcacagtggcatgtgtgggtgtggggtgttggagtgtcatagaatctgatgaggttgggatccatgggggtaacaggtgggaaaacagtttactctgtttaaggtgaacttattgcctggtgttttgtgctcagagcaaataccctcttcaggagcagatacaaaaagccggcatcttctccagcagctcttatcttagtaaaatacaagcccaggcccttcagacccggattaggcaaagactatgtctgttttccaaatacttgttagtacacaaaaggcacatgaacttgtagtttgtctgcatggcaaacctttcttcactttgctcagtttttatttttttgagacaagtctcattctgtca

SEQ ID NO: 13911 - DNA, 40897 bp, Human; identical to SEQ ID NO: 13910

SEQ ID NO: 13912 - DNA, 40897 bp, Human; identical to SEQ ID NO: 13910

SEQ ID NO: 13913 - DNA, 40897 bp, Human; identical to SEQ ID NO: 13910

SEQ ID NO: 13914 - DNA, 84763 bp, Human
ctcctgtccctgtctggttctgtcattatcacaggcaggtcacttccataattgcttacctcattgtttaacatagtcccagctcaaacagcctaagatactgggcctggtacatccagaggagagtctggaagtgggtctcttgggaaggggcatgatggagcagttttcccaagtggagtccagcagccccaggagggttgagcatggagtggtcagttgtggagaccttgctgggaagttcctggtgggaggttatcactcctaccctatagggccttcacctgatggaggcctggtacctcgcaggacagatcaaggtagacacagaagccagagtatccttaggctattctgggctcagggaaaataactggcccacccttaattagagcacctaggactgcctgcctatttctgagccttggctttcacatctgaaaaccaaacaaaatcagtcaaaagaacccttgacctgtggcccacccagcagatgctcaacacagacacacggaatgtggaataaaaggagcaaagagaaaacccaggggatggggaagcactggaagggaaaatcattcaccagcaaatgagaacatagtacgaggaggcttgaatcatttctgttaggagagagtgccagccgcctcctccaggaagaaaactctaaagggtcaggcctcagggaaataaaatgatctataccatccatcagttcctccaacattcagtccatccatctaccaatccacccacccatttacccactcacctgctgctcatccatccatccatccatccacctatgcatccatccatccatccatctatgcatccatccatccacccatccacccacccatttacccactcacctgctgctcacccatccatccatccatccatccatccatccatccatccatccacttatgcatccatccatccacttatgcatccatccatccatccatccatccatccatccatccatccacctatgcatccatccatccatccatccatccatccatccatccatccatccatccatttatgcatccatccatccatccatccatccatccatccatctatgcatccatccatccatccatccatccatccatccatccatccatccatccacttatgcatccatccatccatccatccatccatccatccacctatgcatccatccatccatccatctatgcatccatccatccacccatccacccacccatttacccactcacctgctgctcacccatccatccatccatccatccatccacttatgcatccatccatccatccatccatccatccacttatgcatccatccatccatccatccatccatccatccatccatccatccacctatgcatccatccatccatccatccatccatccatccatccatccatccacttatgcatccatccatccatccatccatccatccatccatccatccatccacctatgcatccatccatccatccatccatccaccaatttatcatccactcactgattcattttacagcaaatgcttatgaatggggatgggtgggtgatggttgctttttctgcagtctccctaggccagttgtcccttccaaagaatctcaagggcatgggagaaggtcctggctgatcgtgtcagggacaggaaactactcacatttcaccgtttcttggggcaggagtggaggtgggggcattggaacccccttggggcctcctaatatcctgtgagtccccacctccagggccagaagctgcctgcctccgctccccgcagcccaggtgcggcgggcagcacactccctagagccaggaccactagttccgtcaaatccggggcgggccattcaaacagctaagggaggcgtctcctagtgtgccttttcctgagtcatctctgcacgtgtttgcccccttttttcttcgctgcttgtagctaagtgttcctggaaccaatttgatacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggtaagcgggtgacgggcgcctggggaggtgccggcggtccagagcccggacagtgtggggtgcgtgggacgcaagggaggacactcctcaccccgttccctgcccagctggagtgagggggcgcgggtgacaagcaggaacaccggaatatgctagcacccacaggtgggaggctggctgaagggctagtggtggggggcgcctccttctcaccccgcgatggctgggactgattcattcattcagtgtgaattggactgagagcactgccatacgcgggaggcgctctttagcccgcctacctgcgggcccgtcggggtcctgggcagatcaggtgaggccgtgggagtagtgggcaggccagatggggcctcccttagccatgggaggttggtcgtccgcgctctaccctgttgtgtgcgcggtcccgtttgcccccttcctaagctggccactggctggagggtcaaggaaaggagggagagttggctgtgggtgagagtggggtgagggtgcaggaccaccgggattagcttccccgatccgcgtccggcaaagcaacgctgtggattgaattcgctggagcacgtggtgggcatttgcccctggaagaaggtcagtggtggggctgaagtctatggtgggttgcctcagaattgagtttggggactgctttaggaaaactgagcacttaccagtggccagcgccaaattaatcactgtggggagaatgcaaagtaaccaggcgtgtttcacggagcccaggggctgctggagagagaggccctcagctgacccaggaccccggtggacccctgcatagaaccatagtaggtgcgagtggatgcctgctgaatgatacagagggaaaggaaggagcaggctgttagtccagcggtgggtcacggtgggggagagggaagacccagttcccctttaatcctacaggaagagaggactccatgctatggatcaattctagtcatctgaaccttaggcagtgggaggagagtggcagagtgggctttaggcaggagggaggaactatgcagcaaaggaggaactatgccctcttccatttccaatgggcaatgtgaggtattccccctttccccccaagagggcagaggggacaaagccctggctagagacaccctgtcccagctctgcaagccctcacctgggggaaggtaagagtttggagtgccaaggtcttggggagatgaagggaaggaagagatgtgagaggtgcttggggggctttgctggtttggtttggcagctgaagctcatgtgcttcctttctgtagagtgaagccccctccactttttttaatgttagagacagggtctcactctgttgtccaggctggagtgcgatcataactcactacagcctgaactctcataccaaaccttttttttttttttttttttttgagactgagtctcactcttgttgcccatgctggagtgcaatgctcgatctcggctcactgcaacctctgcctcccggattcaagtgattctcctgcctcagcctcccaggtagctgggattacaggcatgtgccaccacacccggctaatttttgtatttttagtaaagatgaggtttcaccatgttggtcagtctggtctcgaactcctgacctcaagtgatccttccgtctcggcctcccaaagtgctagggttacaggcatgagccaccacacccagcctcccataccctttttaaaataaaaatactatatatttaattgcacaaggaatatataaatatattctcaaagcaaaactgtaaacgctacagataaagccaagtcttttgacaccgcctcatcctgatcccttcaaagatataaccaccataattgatttggtgtgtttcctttgcagacctttataaatgcatgtccatatttatattgttttaatagacatatatatagttttccatatactataccctacagtacatatggttcttcatttggctttataatgtctatgaggcatcttggtgagctttccatgctgaaacttacagatcctctgcctatcttttaaaatgctatgtgatcttttgccaaatgggatgtttcatagtttatttatgtcctggatggatgggtgctaaggttgccaccattgttctttctttctttctttgttctctactacagtgcacagccctatatggatgcttttggaaataaatgtctgtgattctttcctagacaagagactgagaagagaatactgaggttgcagggcgaaaatgcattcaaattaaaagacaccaccgaactgccttccagggtggctggacaatttaccctcccgctagcagtgcaagagagtagtaactttcccacatcctaaccgacatttgatcttatcagcattttaatttttctcaatgtgattagtgaaaagggttatatccttgttgccttaatttgcatttctcgcctaccggggaagctgagcatctctctgggctcaggcactaggtcatttcttggcaggagtcagggagtccttggggaagggactacctgcccaacacagtactcctttttgcccctcaagccttctcccacttctgttttttccagtaaaggttcgggaagctcgttattttaaaaaaaaaatcccaaattagggcttgaatttccttgagtttaaaatttttttttttttttttgagatgaagtctccctcagctgcccaggctggagtgcagtggcacgatcttggctcactgcaaccaccctctcccaggttcaagtgattctaccgtctcagcctccctagtagcttggattacaggcacttgccatcatgcctggctaatttttgtattttagtagagatggggtttcataatgttggccaggctggtcttgaactcctgacctcaggagatccatccacctcggcatcccaaagtgctgggattacaggcgtgagccaccgcccccggcctaaatttttttttattttttgggacagtctcactttgtctcccaggctggagtgcagtggcgcaatctcagctcactgcaacctctgcctcctgggttcaagtgattctcctgcctcagcctcctgaatagctgggattataggtgcctgccacctcacccagctaatttttgtatttttagtagagatggggtttcgtcatgttggtcaggctggtctcgagctcctggcctcaagtgatcctcccacctcggcatcccaaagtgctgggattacaggcgtgagccaccgtgcccatcctgaagttcttttttcatctctatttgatttttcccaagacgccatcatttttcgcctggtattctgaggcaggaatgctttcttgctagctggcaccatctgagagttggcctctgatgcttcgtatcactgtcttgtccaattgtgtttttttgtaatatgacccaggattaactggtgcatatctgcagagaaaaatttattcccccatagctccatccttttcatccaggcaccatgtggtggggttgcggggcgggggaagccccagctttcctgtgaactctgtagacttagaaattccccaacatcatgttccttgccagtgctaaggctaaacaagccttcctcccacatccatgtacccccaattccagccagatgtaagcatctttgctctgggttagtgtgcaggctgggaccaggaaggttctcatgaaagtatcttagctggggccgggcgctgtggctcacacctgtaatcccagcactttgggaggccaagacaggcagattacttgaggccaggagttcaagaccagcctggtcaacgtggtgagaccctgtctctactaaaaatacaaaaattagctgggcatggtggcaggcgcctgtaatcccagctactcaggaggctgaggcaggagaatcgcttgaaaccagaaggcggaggttgcagtgagccagcactcccgcctgggtggcagtgagactgtatttaaaaaaaaaaagaggaattttagctggggtgatagaaaagctctatgtgtgactcctccatctagcaatttaactttaaaagcttagctagttactccatacagtgtagtgctaatcgtggaatttcagggagtggcaagagggcaggagagattttctggttttgttttgcaaaagggacatttccagggctgctcaaatcctgcagggaggcaaggacggcgggggggcgggggggggacctggagaggaggggaccctgaaggagtggaaggagggtctggcttgtcttaaagccatcccttcccagggcggcactagtgctctggggtcagggagtcgtgttactcagcttgagagcagtgagtgccggaaggaggggcgtttactgtaagtttctgcttctgctcccactcatatctgacttagactcgtttcttgagcagattgtgattcattctaaggtttttatactccctcatcacccttcttcacatcaggacaatcatcagaaggaaaatggggctgaaggatgactgtgtctggcccgggggagtcctggaggcttgagggtccttggcaatgacagtagatcagcccagcctgggccagcttgtccagccggtgcactgaccctgggtgtggcccatctgggatcacagtcctcatttcacagacaaggattcagtgcagaggcccagaggtaggggagagtcttgcctacagttccaggactggtcggggtagagcccaccacagactagacacgcagaatgtcaaaaaaaggcagctctcggccataccagttctccacttctctctctcccctcccaggtccacccaggggatactggggtgggggtgggggaccttcttccggtatctatggttgaaaaccactgggcattctcgtggccttgctggtggggagggactttttatacatggctcagtctagttactccctgaatgcctaagtcttttggtgacatgcaagtattcatgcatgcatgcatccagcagatctgaaatgagcagctgttctgggtcaggcatggctccagggacttgcattcagcctctgcctgtatgccccccgtgacaggatgcttgctccttgctgaggcagctcacaccatcctgggttagctttggcatttagatgatcttcatgatatgctgaaatctagtttctttttctttctttttttttttttgagatggagtctctctctgtcacccaggctggagtgtagtggtgcgatctcggctcactgcaacctccgcctcccgggttcaagcaattctcctgcctcagcctcccaagtagctgggactacaggtgcatgccaccatgcctggctaattttttgtatttttagtagagatggggtttcaccatgctggccaggctagtctctaactcctgacctcgtgatccacccgcctcggcctttcaaagtgctgggattacaggcatgagccactgcacccggcctttttttttttttttttttttttttttgatggagtttcgctcttgttgcccaggctggagtgcaatggcgctgtctcagctcactgcaacctccatttcccaggttcaagtgattctcctgcctcagcctcccaagtagctgggattacaggtgtgtgccaccacgcctggctaatttttgtatttttattagagacgggatttcaccatgttagccgggctggtctcaaactcctgacctcagacgagcccccccgcctcagcctcccaaagtgctgggaatacaggggtgagccaccacgcctggcctgaaatctagttttgaaaatgagtcacctccctgttcttcagaagcgcctctggcaatgtgaagactgtgactttgggtccccggagtctctcagccagtcacacacctgtcctccaacatttattcctcacgtagcgtgagctcaaggctcctcatctgcctgttctcttcaattcattcattccacaaacacttattgagcaccttctgcatgccaggaagcactccgggtgctgcgagttcatccatgcaccgcatagcagggtctctgccccacggaactgacattccacaggggtgacagtcaacagactgctgctagttgcaatgagaggattagaatcctgtagtgtgagagagacgggcggctccctaagatggggaaaacaggacttgcagacggtaacatacacacggaatgaaaagagggaggcagccagtgggagattagcagaaaagcatccaggcccagggggtaaaagccccaagaggctagaggaacaggaaggaggccggggtggctggagggaagtgagtggagaggggtggttaggagaaggtggcaggaaaggtggtagatcgtgcagacctttgtggactgtggtgaggtttttggcaggggagcaatactgcatgatagatttaaagttccttctgtctgctgtggggggctgggggattggggggagcaggcaggatgggagcaggaagccaggtcattgcattgatccaggggaggggtgagcagaggtgggaatgtgctttttcttcttttcttttctttttttgagacggagtcttgctctgttgcccaggctggagtgcagtggtgtgatctcggctcactgcaagcttcgcctcccaggttcaagccattctctcgccttagcctcccgagtagctgggactacaggcgcccgccaccacgcctggctaattttgtttttgtatttttagtagagacagggtttcaccgtgtcagccaggatggtctgatctcctgacctcgtgatctgcccgcctatgtagagacagggtctcactatgttgcccagtttggtctcaaactcccagggctcaggtgatcctcctgcctgcgcctcctattgctgggattacaggcatgagccactgtgcccagctggaatgtgctttcaagctagaatcaacaggacctgtggatgggtctggtgggagcgcagagggcaggagggaaatcagggatcctgtccgtatttgggagctcagaatctggctgcatggaggtgtcattttgggatgtgggaaaaaacaagcaaaggatagaacaggggttttggagaaaagttctattttgcccatgctcaagtaccagtgggggttgggtgttgaaatgtggagctctctacagagttcaagctgctgatatgaatctctgggtaccagagtcaactgtagaagtcctggtgccacctgggccaaagaccactccccagtagactcaccttacttctattaaccaagcccaagaccccctttttttggcccccacattatctgttcattcgttccaacccaagcctaggctcttttattcagcctggttacagtatatgctagttttcttttgctgctatagcaaattagcacacatttggtggcttagaacaacatgaaggtattgtcttatagccctggtggtcaaaagtctatgacaagtctgtaatcccagcactttggaaggctgaggtgggcagatagttggggccaggagtttgagaccagcctggccaacatggcgaaaccctgtctctgctaaaaatacaaaaattagccaggtgtggcggtgtgtgcctgtagtcccagctactcgcgaggttgaagcacgagaattgcttgaacctgggaggcagaggttgcatcaagctgagatcgcagcactgcactccagcctgggtgacagagcaagattctgtctcaaaaaaagaaaaaagtctatgataaggcagcagagctatttttcttctggatatgctgtagcaaaatgtttccttgcttttttccagtttctagaagctgcctgtgttccttggtccctggccctgcatcactctgaactctccttccatcctcacatttcctctctctcttttttttttgagctcgatctctcggctcactgcaacctccacctcctgggttcaagtgattctcctgcctcagcctcccaagtagctgggaccacaagcacccgccaccacgcccggctaatttttgtatttttagtacagacaggtttcaccatgttggccaggctggcctcgaactcctggcctcaagtgatccacctgccttggcctcccaaagtgctgggattacaagcacgtgccaccatgccagctaatttttgtatttttagtagagatggggtttcaccatgttggccaggatggtttcgaactcctgacctcaagtgatccacccattttggcctcccagagtgctgggactataggcatgagccacctttgagagacagtagagcatttcgttaaaggtatgaacttttttgtcagcctgtcaaggttatcccttgcttctgacactagatggtgacttgagcaagttaagttacctctgtgtgcctcggtttccccatctataaaatgggctaataacagtagctaccttgtattgtagggctggtgtaaggatgacatgagttaatatgtgtcaagtgctgagagcagcttctggacacagtgagtgctgtgcaaataaaggtgagccttattaggtgcctgttgtatgtggggcattatggatacagccatggagatgaaccagttccagtccttgccctcgatggggggcagtgtgggaaggggaatacagaagagagggtggccagtactgcgtaggggactgtctggggcctgcgggagtccagaggagcccatctttacttctgcctgggtcagtaggggaaggagcctccagagtttgcagtgatgaggctctgcaccacagatggtgccattgtccttgccagctttgcccagggctctggaggcagcagaaggggtcagaggttaaacagcacatcagtgctggtggttggggcgagcctggggcctgctttggaagccccacccagcaggttccccttgggttcttgggtcctccagggggctaagaactcctagaggcgtcgcccacagcttcatttcagccatcaactttcttgacggattgctgcctgccaggtacggttcctgctctcagagagtgcgtgcacagataatgtggcctccacacagtttactgaaatggttccaacctgctgagaccaggaaactcctaaaccccaccttcaccttcccagcctgggcaggcacccttcccactcttgattcgggtgagggaggccaggacgcagcggccaggccaagagtttcctctctctccaaacggtctggggggcatgtgccctgccccttccccacacatagtctgggagagggaggtgggcaaggaaacacaccaggctgggcgccaaggctcacgcctgtattcccagcattctgggaggccaaggcaggaggatctcatgagcccaggagtttgagaacagcctgggcaacaaaaaattagccgggcatggtggtacacacctgtggtcccagctactcaggaggctgaggtgagaggatcacgtgagcccaggaggtcaaggctgtagtgagccgtgttcatgatcgcaggactgcactccagccagggtgaccgcaaggccctgtcttaaaaacaaacaaacagacaaacaaaaagtaaatacacaagccccttctgagcaactggcctgaggctggcgcaggaacctaaggcacctccaagaggatcagaaagtcgaatactcccagggagctgggccccgcttccttttccttcaggtccactatatccatctctctctctcttttcttccttccttccttcctttcttcttccttcttcttttcttcttccttccttccctccctccctccttctcttctttctttctccctttccgttcctttccctttcgttttccctttccctttccttttccctttccctttttctttttcttttttttttttcattttcttgacagagtctcactctgtcgcccaggctggagtgcagtggtgagatcgtggctcaatgcaacctctgcctcccgggttcaaacgattctcctgcctcaggatcccgagtagctgggattacaggcgcccaccaccacgcctggctaatttttatgtatttttactagagatggggtttcaccatgttggccaagctggtctcaaacgcctgacctcaaataatctgcctgcctcggcctcccaaagtgctgggacttcaggtgggagccaccgcacccagcccactgcatttttctttgtagctgccattgtcccgtggcggctgttgctgcccgggaacgtacttcagggctgggtgggttttaccttgtctgagttgtagctaaggatgcagctccaacacttgcttcggccctggaatcttcaggatccctgcagtctcaacaattggctcatggagccggcacgggattgctgggaggcaggagggatttcttggtgggaagtgaggatcgaccagttgctaaattcggactcaaggcgtgatcttgctaaaacggactcgctctcctccatcctgtccacctccccaccacattaatgaccctgaaaccctttaatgcttccctagtgccaaaggcaacatgtcccaaagtcaccttctttctttctttttttttttttgagacagaatctcactctgtcacccaggctggagtgcactgatgtgatcttggctcactgcaacctccgcctcccggcttcaagagattctgctacctcagcctcctgagtagctgggattacaggcgtgcaccactacgctaggctaatttttgtagttttagtagagagggggtttcgctgtattggccaggctgttttcaaactcctgacctcaagtgatccgcccgcctcggcctcccaaagtgctgggattacaggcatgagccaccaggcccggcctcaaactcactttctggcaatggcagttctgagaaaaaaggttctatggccaacgaagtgggagaaacattgcagagttttctgactagctcccatacccttccttggagaatcaaatagtaagtaaccacatcaaggttctgagaagccccgtgatctaaaatggaaacctctcgaatggactccagtgattatttgtgtttgtttgtttgtttatttatttatgagacagggtctcactctgttgcccaggctggagtgcagtgttgcaatcatagctcactgtaacctggaattgggggctcaaacaatcctcccaccttagttccttgagtagctgggactacaggcacatgccaccatgcccagctaattaaaaaaaaattttgttaggccgggcacagtggctcatgcctgtaatcccagcactttgggaggccgaggcaggtggatcacttgaggttacgagtttgagacatggtgcaacccaatctctactaaaaatacaaagcttagccaggtgtggtggcacatgcctgtaatcccagctactcgggaggctgaggcaggagaatcgcttgaacctgggaggcagaggttatagtgagccgagattgcaccactacactccagcctgggcgacagagtgagactctgccaaaaaaaaaatttttttttttttttaaagagacagggtcttgctatgttgcccaggctggtcttgaactcctgggcttaagcaatcctcccaccttggcttcccaaagagctgggattacgggtgtgaaccgctgcgcctgtccgtgttctgcctatcatctgttaccatccggtagccccagcatttgatgaaacgctgtttgggaaatgacagtgaagagcttccatactcatctctttttctgactccctgactctctcttctgcctccctcttgcatttttaagttcccttaaattgcactgggctcccctggataatccagaagaatctcccatctgaaagtcagcgggttcacaacctcgatgccatctaccaccctgattcccctttgccatgtaaggagacgtatatgagcacatatgtgaatatatcaccctaggtcctggggacccagtgaggatggtatgattcttgctaactgacagagcaggagcgtcaccatcttggacaagcatcgccgttttaaattctccttgattaaaaaccgcctaaatccagccccaaaacatcagcctaacggctaacgtcagcatgaccataaaccacaaatgacacctccaaccagaaacattccaacacccccatccgactggagacatgccagccctgagataacctcccctctgaccagagacattcccagcatacagtaaaactctcctccacacagaaacattcctagcctgcgaaaagctcccatcccagaacccttaaatacccttagtccataaaaacaatgctgctgaacgaaattggccagaaggccttcttggttttattcttttttttttctttttcttttttttttttttgagatggggtttcactcatcttgcccaggctggagtgcagtggcgtgatctcggctcaccacaacctctgcctcccgggttcaagcgattcttctgcctcagcctcccgagtagctggaattacaggcataagccaccatgcccggctaattttgtatttttagtagagatggggttttaccatgttggtcaggctggtctcaaactcccgacctcaggtgatccacttgccttggcctcccaaagtgctgggattacaagcgtgagctaccgtgcccggcctcagttttattctccaaaataaacctgtctttggtaagccgcttttcatatttttttcttctttcttcaactcttacacaaaaatcatttcaaggtgcttgcctgtccctgagttccttccagccagggactccaggctccaccctctatgctgtttccgtgtccactgtctttgggttttatctccaaccctggggccaggcagcatggggccctgcacactctttctcagctgtgcaggaactggggaaaactcaactcggcacctgcttgcagtgggacaactgtgagaggtgctgcctgtggccagggatggagcctgtggccagggatgggtgtgtttaaagaggtggaggaggaggactttagtttcaggtagtctcttggtctggagctcaagtgagcactgagtgtggagagaggggttcagagtcctacagttaggaggtgactactgagttcggcgtgtggtggtatagtctagtggttgcttaggagcgagggtgtggcggtagacgcatagtcccctaaaacgtccatacattctacattgttaatttgggacagggtctcaccctgtcacccaggctggagtgcagtggcccaaccacggctgaagagattctcccatctcagcctcccgagtcgctgggactacaggtgcattccaccacaaccagctaatttttgtatcttttgtagagacgggtttttctcctttgccgtgttgcccgggctggtctcaaactcctgagctcaagtgatcctcctgcctcagcctcccaaagagctgggattataagtgcgagccacttcgcctggccaaatgtccacacattctaatccttgaaacctgatactatggatcttgagacaggaagatgatcctggattatcagggcgggcccaatctaatcacaggagtccttaaaagcagagaacccttcctggctgtgttagagagagatgatagaggcaaagagagagatgtgatgtgagaaggactcagcccaccattgccggctttgcagatggagtaagggggccatgagccaaaggatgccacagtccctagaagcagggaacagcccttagttggctgtcagcaaagaaacaagacctcagtcctacaaccacaaggaactgaattctgccaacaaccttagtgagcagggaaaccaacagtcccttaaagcttccgctaggcacacagcacatgacctggatgggggtgatcagagagggcttcccagaggaagtggcactcatgagtgaggtctcaaggatgaatgggggtacactggatttagggaccagtgcaggcagggaaacagcacgcacaggctgctgcagggagtggggtgcccgtggggtgccagtggcaaaaagaggctggtaggagagagtaccaggggcttcacaggcaggcaaggagggcagggcttcttgggccactgttaagactttggttttttttttttttaaatatggaccgtttcatgaatttccgtatcatccttatgcaggggccatgctaatttctgtattgctccaattttagtatatgtgctatcgaagcgaacacaagactttgggctttattcatagctgggttggaagccatctgagggtcttcaataggatggaggggaagacagtagatcgtgttttcaaaagatcagtctggtgtctgcactgtgagctgggcgtggtggatggggtagacgagaggagaccctcgggtggtcactgtcaagtccagatggcgggaaggtgaggaagagctggtagatgtgggggtaaaactgcaggttaaacagacagaactagtgataggttgggggccagggagaagcaagcatttcaaaaagcagtcagtctcggccaggcatggtggctcatgcctgtaatcccagcactttgggaggctgaggtgggtggctcatttgaggtcaggagttcgagaccagcctggtcaacatggtgaaaccctgcctctactaaaaatataaaaattagccaggtgtggtgccaagcgcctgcagtcccagctacttgggaggctgaggcaggagaattgcttgaacgcgagaggtagaggttgcagtgagccgagatcgcaccactgcactccagcttgggcgacggagcgagtactctgtcttaaaaaacaaaaacaaaaaaaccctcagtctcatggggagtggggagcagggatctcagagccctgaactacagcacccccccaccccaggcagcagaagctggcggatcagagcacgtgccaaatcctggccctaacactgaccagctgtgtgactttgggcagatttctcgtccttacgtctcagtctcccccatctgtaaaatgggctgacagttgttggctattagaattactttcgctatggaaagcaaaccgttccagcatttgcacttctttctgctcagcttctgctaggtcagcgcatctcaaactccctggggctcttgttaaaatgcagattccaattagggaggtctggggttctgcattttgagaaagttccaaggtggtgcccctgctgctggcccggggcctcaccttgaataacagagcgcacagcggtggagatccccaggagacagggaggggaggggtgcttacctcgctggccctgctcagctctggccccttcggggattttgcatttgatctaactccccgctcaccccacaacttctagactcgtctcccacaggtatggtccggctgagaccaggtggggctttttgaaagtgaactttaactggtcttgtagggaaaaccaaaccaacctgaaaatagacagacctgaaaatggtaaggttttaggccaccctctctttatcttgatgccactaaggtggggcggagggcctccggttgcacagctcattaccttgtggacacctcactttgccttgaacctgcggggaactccacccaaaagccccccctccagtccttgggcttccccctcccactcttcgctttctgatccctccttccctcccaggcaagggcccgagcacatcccagctcccctctctctcttccccagggcagcaggagctgatgagccaggcagggtgggcctggaaattcacagggccagacttctccgggcagcggcagacgccccggcccttgcctccttctccaccgggagctgggacaggtgaagggcctgtgtaaggggaagggggtgccccttcctcgctcagctccacatggaaaatggggccctaagtcctctgctcctccttccaaggggatttgagaggcacaggctggccatcccaccaggttgagatcccacagcccctccgcacagcaagaagactgccctccggtggcaagctatggatttaccgagaattattgctgaaaagaagccaccacctcccagcatttcgtgtccttgagatgctatttacatatgtggctttgtacatctgtgttctcactctctttacatatacttatcactactttatttttatcactactttattttttaattctctatttttttttttttttttgaggcagggtctcactctgttgctcatgctggagtgcaatggcgtgatctcggctcactgcaacctccgcctcctgggttcaagggattctcccgcctcagcctcctgagtagttgggattacaggcatgcaccaccatgcccggcttatttttgtatttttagcagagacggggttttgctacgttggccaggctggtcttgaactcctgacctcaggtgatctgctggcctcagcctcccagagtgctgagattacaggcatgagccaccgtgcccagccaagatgatcccagttttgttggcaacatccaaagcattgtaatcaggagccagtggaacatatgccttcttctctccatccggccgaatcagggtgctgaccttggccacatccatgccatagagctttgtcacagcctgtttgctctggtacttgttggctttaacatccacagtgaatacaagtgtgttgttgtcttctatcttcttcatggcagactctgtggtcagtgggaacttgatagcagagtggtcgagcttgtttctcctgggaacgctctttcgaggatatttgggcttttaatacctatttttatttatttttttgagatggagtttcacccttgttgcctaggctggagtgcaatggtgcgttcttggctcactgcagcctccacctcccagattcaagcgattctcatgcctcagcctcctgagtagctgggattacaggcacccaccaccactcctggctaattttttcgtatttttagtagagacggggtttcgccatgttggccaggctggtctcaaactcctggcctcagctgaccctcctgtctcattctcccaaagtgctgggactacaggcgtgagccaccgtgcccggccctgggatttttttattttaaagatgggtagcctgtggcccagagatgggggagaattggggacacggtgaagctcaaacctctctgcacttagttgctgtgtgaccttgggcaagtggctacacctctctgggctgcagtttcctcatctgtaacatggggtagtgatctggccccaaagagctagcagtgtgtaaaggaggagttgtgtgaaagcaggcacccaaggccagactcgggggagtaatgtgcaataccatgggctccccattctctgcaccccctacccctccattgacccaggtgtgatggcaggagggaagcataagcagccagagccccccaggtgtgccccaggccccagcagagtgagcagggcctgggcccatggtccccatagactccgtagctgtcagtgagattagcaggcaggccgggaggggagaccaaggacaaggacccagaatgttcccacactcagcaggccttgccagtgagccctcacacctccagccagccccaggcccaggctactgaactcacccagtgagatgctgtgggttaggagcacttcgggtgtcctggcaggttcctgcccccctggagaggctcccaggagccctctgggtgacttaagagaggacactctcctctcctactggagggaggagggtgtcctcaaggcccggggctctggattaaataagaagggagacaactcaagcgccatgtgactattgggcaaatatcacgttcatgtattatttcaaattaatatggtgacatgtttcagacatgcaaaaaaaaaaaagaatgatgtaaccaacaccccatttatccaccttccagccacgctgctgctttctgctgcttcctgaacatgccggaagcttcactgctccctcgagtggagagaagagtcaggcagccctttaggccagccaggcctctctcctggggaaaagtggcttctgcttccttccctaaaccaagaaagccccacatcgcaccaggggccacctcctttctgccaggcaccatcttggatgctgaagacatggaaatgctacaaggcttcctccctgcctcttgcctcacttcctgcttcccttctcttgcctcacttcctgcttcccttctcttgcctcacttcctgcttcccttctcttgcctcccttcctgcttcccttcttttcccttttgctccaccctagaagtttcacatcctggatcaccccagaaaagtgcaatggcgttcccctgtcattccatctggaaagacaaaactccttccctggaatctcaacaaagaatttcctctcttgaatcctttcttatgatggtgcttcactttcaaagaacccttgaaacacatggggggcttggtaaaaacatatcttcctgaggccgggccaggtggctcacgcctgtaatcccagcattgtgggaggctgaggcaggaggattacttgacctcaggagtttgagatcaacttgggcaacatagcaagacccagtctctacaaaaaaataaaacattagatgggtgtgggggtgcatgcctgtggccccagctacttgggaggctgaggcgaaagagaggactatttcagcctgggaggctgaggctgcagtgagccatgattgcaccattgcactctagcctgggcaacagagtgagaccctgtctcaaaaaaaaaaaaaacaaaaacaaaacaaaaaaaacccccacaaaaacccacaaaacaaaaaccacgccttcctgaaaagagtgagcctctccgacccctacttcacaccatgtacaagaatgaaacttgaatatgaacgattaaacaatctcatctaggagttaatgtaggagaatatctaagtgacactgagtgggcaaatatttcttaaacaggacaaaaaaaggcattaaccataaaagaaaagattagtatatgtaatttattaaagctaagaatgtctgttcatcaaaagcctccaaaaagaaagtgaaaaggcaagccagaggatgcgagaagatacttgcagtacatataatcaacaaaagccgtgtatctagaatatgtaaagaaccctacacatcaataagaaaagccagacaacccaattaaaaaaaaatggccacaagacctgaataggcatcttacaaaaaagaatgcctaaatggttaataaatgtgggaaaaggtgcccaacaacattacttatcagagaaatgcaaataaaaaccacaatgaggtatcactacagatccaacaagatggctaaacttttaaaaactgataccaccaagtgctgacaaggatgtggagcaattggaatcctcagacactgcagggaagtgcctactagtacgactactttagaagcctggatggagaatctatcagaactgaacatgccttatgccccagcagttccactcctaggtatatagccaacaaaagcgtgtacgtttggacactaaaacgtgtgtacaggaatgttcccagcagcactatcataataaccaaaaagtggaatgtctatcgagagcaggcccggagtggtggctcatacctgtaatcccagcactttgggaggccaaggcgggtggatcatttgaggtcaggaattcaagaccagcctgaccaacatggtgaaactctctctgctaaaaatacaaaaactagctgggcatggtggcacacacctgtagtctcagttacttggcaggctgaggcacaagaatcatttaagcccaggaggtggaggctgcagtgagttgagattgcaccactgcactccaacctgggcaatagagcaagactctgtctcaacaaattaaaaaaaagagagtagactagacaaataaattgtgcatatttgtgtgatgctatactgcaaagcaatggacagaaatgagcaactgttatttgcaacagtgcgaatgattctcacaatataatgctgaattaaagaggccgattgcaggggaatggactgcgtaattctactttatgtaaaatccaaaagcagtcaacactaatagagcgatagaaatcagccttttgggaggagtgtgtgggaggggggatgacggaggagctggggctggcaaggtcccatttgatgagttgggtgctgattgcctggtgcgttcatcttgtaaaaatgcagttggctgtaacttgagatctgtgcacttttttgtacgggtgtgttagacttcaacaaatacgtttaccagaaatttgtattgttgggcccatcccagagacaaggtaggaagcaattatgttaatcccagggcaaggggatggtgactagccccaggtgaaggtggtgatgattatggtatgaaaagggccaggagaatttgctgataggttgtttgagaggagagagtcaagggagacgctaaagtttctggcctgagctggagtagcagggggaagcgtaagggcggtgtgggtttgtggaatcaggagttctcgtcctgatttctctcctatattacaaagctccgtctcaggcctcctgggactggtggggacagagggagtatggatatctgggatccacctggcctcaccagcttttctgacctgccaggatcgacccttcgaggacacctgtcatggaaaccccagccactactatgacaaggctgtcaggaggtgctgttaccgctgccccatgggtgagtgggggcgttgggggtggggagaaggggggaaatttgtcctcaattgatgaccctcttgggggattgatgagtggggaaattggagccaaccgtcatcgtcataattggctacagttttctgcaggtcattcctagtgtcgcggagtccaaggactctctcggaaggctagggctgtagaattgagactgtgtttcttgctgccaccagaatgtccatctccatgagtttttatttttaacgtagagctgccctttattggacacttactatccatgagtccgagacctttatatgcacggcatcatctcattaagtgcttgcaatgatcctttattacactcaatttgcagatgaggctactggggcttggcagggttaagttccagctacttcccttgatgaccagggtcacacagttgggaaatggtggaatgatcagggctggggcccagggctcagagacctcaaagcctgggctgtcaacatcctctgaccacccttcatttctggggcccagaagtcctttgcagttctttcttttctctcttatttttatttttattttttttgagatggagttttgctcttgttgcccaggctggagtgcaatggtgcaatctcggctcactgcaacctccacctcccgggttcaagcgattctcctgactcagcttcccaagtagctgggattaccggcatgcaccaccacacctggctaattttgtatttttagtagagacagggtttcgccatattggccaggctggtctcaaactcctgacctcaggtgatccacccgcctcagcctcccaaagtgctgggattacaggcatgaaccaacgtgcccggcctaatttttttatattaatttaaaatagagacaaagtctcgctatattgcacaggctggtcttgagctcctgggctcaattagtcctcctgcctcagcctcccaaagcactgggattacaggcatgagcctccatgcctggcctctttgccgttcttgactgccccagctcaggacaggtgtttatcctgggacaacctggacaatagatttctctgagaccagtctcccagaccagagctccctttctggaatgttcccccacccccagcaccgtgattgacttctagtcaattaccaggaaatccttctggagctggggtgagtgttgttccttccattttgtagatgatgcttaggcccgaggagataagcagctggaatagggtcatgaggcatttctgcccctgtggttattatcaaaagtcccaaggcaccaccagtggtcttagatgggcggggcaggacataacgatgccctcgtggtctctgacctccaggaacagagattgtcacggggacatcagcctttagctgtgccagcaagggtgggagggagtctgtgtgtgtctggttcatcatcgccacttcttgctttgaggacagcaggccattgcaagtgggcgggcatcgtctggagggcttccgacagtgggggcggaggggcccatccacccagctgtactgtctggagggtggtgacaggttatggccatcagggctattccactggagctgcgcgggaacccaggtcagtcagttcctagacttgtggcctcaactcccccatgagatgcagaccaggctcgtgctcaggccaccaaaggacagagggaaacattcttggaaagaatttgatgtttttgtatttgattttgatttgtatttccaacaatgattcaaagtattcattgtatgggcaaaagtagtgggttggatgctattggactttcttgcttttatttttggtttagtgttgattttgaatgatctattaggtgggtcccctggttttttcagtgcttcactggtcggccatccacccacccatccaagtacctgcccccctcacccacccacccatccaagtacctgcccacccacccatctttttaaccactcaccaacccacccctcccatcccctttccatttttcttcccatctagccactatccatccatccatctgtattagtttgctggggctgccataacaaaatactgtagtctgggtgacctaaacaatagacatttatttcttacagttctggaggcttgaaggtccaagatcaaggtttttggaggatttggtttctggtgagggctgtcttcttggcttgcagatggcagtcttctcatggtgggaagatcgatctctctctctctttctctctctttccccctcttcatatatgccaccaatccccctggattagggccccatccttatgacctcatttaaccttaattatctcctaaaagtcctatctccaaatacagtcacactggggttagggtttcaacacatttaacatatgaactttgtgggggacacaattcagtccatagcaccatcgccttcccatatccctccaattatcctcccattcaccgcccccatccatacacccacccctctcctggccattttctcatctacctttctatccatccatccatccatccatccatccatccatccatccatccatccatccatcatccatccaacaaatttttatttctctctctctctcttttttttttttttttttttgagatagagtctgtctctgtagtccaggctggagtacggtggtgtgatcttggctcactggaacctccgcctcctaggttcaagcaattctcttgcctcagcctcctgagtagctgggattacaggcatgtgccaccacacccagctagtttttgtatttttagtagagatggggtttcaccgtgttggccaggctggtcttcaactcctgacctccagtggtctgcccgccttggcctcataaagtgctgggattacaggcatgagccactgtgccaggcctagtttctgggcctttggacatgcctgtccccatgtgggatgccctcccctccgtccctacctgctgcaattctggaaccccttcctccatgaggccttcccttgctagcctgatggttggtggtggttcccactcagttctctcagggcccgcttgctgtggtttttatcctctggaatggagtggcccacagtgttctatgacttttcatgggacccacaatcccagccacaaggagaaagacacttccttctcatcctcttctggcccctttgactccagcctgaaagggccttgatggggagtgggtggagagaaaaatgacatctcaggtcccaggctccctccacttaaaagctgtgacttaggaagagggggctccctcctccccacttcccctctctaaggcccagtgctggctggggctgaatactccatattggtgtggtgggtggggcattttactggtgttttattgaccttgtgcttccgtgtagccagagaagaaaaaagaaaaacccacaaaaaccccttctttgatctctcggggaaatttcttgacattttgcctgccctgtgcagccagcactcagctgtgtggccgggtttgcttgtgggcgggttggtggaggaaggaagctgagggacctttgagattgaaaaatgtagatgtcatcgaatccctccttgcacccaggcctgtgatgccctctccagcattcctgagagcaggtccccagccctttgcttacatactcttggtgacggggagctcattcactgactcataacaatgaccacgattcataccgatggagcacgctatgtgctggccactgtgctgggccctttaccgaccttaagttccttcaatcctgataagaaatccagagaggaaacttggacaccgaggggttcaggaatttgcacaaggccacatgcgtatcagtggctcagccgggccgtgaacatgaccaccgagtgcagtctcctgagctcttcaactgtagttgatactgaccctcaaggcctcgaatttgggaggcagaagagtttacgagtgaagagctaatgcgggggctacaaagcccttcctgttctccatcttcctggactaccctctctttgtgtgcagactcgctccccacaggaaggggtctctcctgcagatgtttgaggcctgcccaggttcaggggaaggatgtgaggccaggccaagtgttaggtagggagcatggcaggtgtatcccatcttgtcccaggagctgagggttcctccgaaggctgtgaacaggaaggaggaggaggagggggtttgtgggttcccccagcttccgctgcccttgggtaaagctcagctttgtgcatgggcacgcccatttggcatgacagctgctgcccctgccgcctccccctcccccgcccagtccctcttcatcctgggcttcagctgagtgtgctgggctcccctgtgccctctgacactgtcccagcagagccccctcacagcacctcctggccccccactgtccctgtgtgcttgactcacacctctgcattcctcagggtccacttaagtgtaggccctccctgaccccagcctgggccacagagcgagattctatctcgaaaaaaaagagaaataaacatttgttggatggatggagggatggccctccctgaccccaagccagctcagaggtcttggctctgggctcttggtgcctcccatggttccactttcctaacactccttccatgtgtcatgacttgtctatcgtcttcctgcaggatccccagccctgaccccagggcttggcacatagtagagtctcaatttttgaaagaataggtgaatgaatgaatatggctaacttgccccgcatactcttctgtgacagccagccattgcctcacagggccaagcttccattgtccccctggcacctccctctgctgaagtcagaccagcctctctctcctgtccatcccactcgcaggtacatcctagtcttttctttaagcctgaaaaatccaccagggttcttttgtataggaggaagtatgtgggcgtggaagggaggaaatggaaggcagtagaaggaaataggactggcccaatgcagcaagcatttattgagctctgttggatatagggttatttgggggagagaaggacaaggtcctgcctcctgggagcaacccactagtaggggaggtgacatgcttatatatatctgatactccagagggtatctgtgctaagatagtttcaaaggaggaagaatgggagcttacagtgaggaaaagcccctataccactggtctgcatccacccatccatccatccgttcatctacacatccatctacccatccacccatctacccactcatccactcttccctaacccatccatctatccacctatctacctgcccatccacccttccccatccatccatccatccatccatctacccatccacccatctacccactcacctactgttccctaacccattcatctatctacccatctacccacccatccacctttccccatccatctatctacccatccatctacccatccatccatctacccactcatccactcttccctaacccatccatctatccacccatctatccacccatccacctttccccatccatctatctacccatccaaccatctacccactcatccactcttccctaacccatccatctatccacccatctatccacccatccacctttccccatccatctatctacccatccaaccatctacccactcatccactcttccctaacccatccatctatccacccatccacctttccccatccatccatccatccatccacccatccgtctacccatccacccatctactcactcatccactgttcctccacccatccatccatctacccatctacccacccatccacccttcccccatccatccatccatccacccacccactcatccatccacgtacccactcatccatccacccacccactcatccatccacccacccactcatccacctactcgtttatccattcacctatgcactcactcatccatccatccacccacccacccactcatccatttacccacccatccacccactcattcattcattgattcacccaatatgttttgtgtatttgcattctatcagaccctagagattcaaccatgggggggcagctatcatcttgccctcacaaactcaatctcaataagacaaatattataccaatttgagacttttctacctgcttgtaagaaaagggggtgccatagtttgaattcccccagaagtagactgttatgggctgagtcatgcccgtatcccccaaccaattcctatgttgaagtcttaaccccagaatctcagagtgtgaccttattcggagatggggtctttaaaaaggcaattgagttaaaataagttcactaggataggcccaaatccaatatgactggtgcctttataaaaggaaattaggacacagatatacacagagacaagactgtgggaggacatggggaacacagtccatctgtaagtcagagagaaagagctcagaagaaactagccctgcccataccttgattttggacttctggcttcaagagctgacaattaatttctgttgtttaagccaccctgctgtctgtcgtagtttgttatggcagcctgagcagactgatgcacagactttgaggcaatgatctgagtacagttggtgatgcctggaaacaccaatttggaagtagggaagtggcagacggaagggaaggcagcttataaagttgtgttagaaagctagttactgctgtgggcaactggggcttaatccctctgggggcctctgggagccagtgcagaacagctgagggtgagggagctggggtatttatatgccaatgtccatcaaacattggtggaactgctcctggggtggtacatcttggtaggtctggcctgccacaccctggcagagcaggctctgggtgctctgagagggtgattttaaagggacccagagagaggatctgggtggggtcagatgatcaggaaagttccatgagaagatggtatttcagcctgatctggctgggtgtgaagggttcccagtgggtggaagatggagaagccacttagcctgcaggaagaacatttgtgttagtttgctggggctgctgtaacaaagtacctcaggctgagtggcttaaaccagtggtccccaacctttttggcaccagggactggttttgtggaagatgattcttcccatgaaggggggtcagggatggttttgagatgaaactgttccatctcagatcatcaggcattagagtctcatgaggagcatgcaacctagatcccttgcacgtgcagttcacaatagggtttgcgctcctatgagaatctaatgcagttactgatctgataggaggtggggctcaggaggtaatgctcgctcaccgtcactcacctcctgctgtgtggccccgttcctaacaggccatggactggtactggtccccggctggggactggggtcgcctggcttgtggcagcataactccaatcttcacatggcattctccctgtgtgcacatctgtctctgtgtccaaatttccccttttcttatttattttatttcatctgtactgtattgtattgtttcagagacagggttttgctctgtcacccaggctggagtgcagtggcatgatcatagcccactgcaacctctaactcctgggctgaagtgatcctcccacctcagcctttctgagtagctaggagtacaatgtgacatcacacctggctaattttctattgttgtagatggggtcttgccttgttgcccaggctagtctcaaactcctggcctcaagtgatccttccatttcagcctcctaaagtgttgggattacaggcatgagttaccgtgcctgaaaatgtccaattttccccttttcttttatttttcttgtcttttttttttttttttgagacagagtctcactctgtaacccaggctggattgcagtggcgtgatctctgctcactgcaagctccgcctcccgggttcacgccattctcctgcctcagcctcccaagtagctgggactacaggcgcccgccaccacacccggctaatttttttgtatttttaggagagacagggtttcaccatgttagcgaggatggtctcgatctcctgacctcgtgatccgcctgcctcgacctcccaaagtgctgggattataggtgtgagccaccgcgcccgacctctttttattttttttgagacagagtttccctctgttgcccaggctggagtgcagtggtgtaatctcagctcactgcaacctccacctcccaggttcaagtgattttcctgccccagcctcccgagtagctgggattacaggcacatgccaccatgccctgctaatttttgtatttttagtagagacggggtttcgctatgttggccagggtggtcttgaactcctgacctcaggtgatctgcccgcctcggcctcccaaaatgctgggattgcaagcgtgagccaccgcaccggccaagtttccccttttcatgagaacaccagtcagattagattaggcccaccctagcggcttcattttaactggattgcctcttcagagcccctacctccaaataaagtcacatcctgaggtactgggggttaggactccagcatatatatttttttggggagacacaatttaatccataccaacattcaggatgtatgaggggtgttagagaaaagatcaagatacccagactggctgtagtagagagtgcatgaagtgagcaatgtactagaatgccagactgggaagatggagacacagtgtgaggcctgggagtgcaggctggggaatgccgtatgaactaggttgacagaacatgttttaatgaaatatgtgtgaggccctatgataggggaggcattggtgagtggacatagaaagactcatcctcaaggagctgacttttttttttccttgagacagggtcttgcttcgttgtccaggctggggtgcagtggcgctatgcccgctcactgcaacctctgcctcctgggttcaagtgattctcctgcctcagcctcccaggtagctgggattacaggtgtgcaccaccacgcctggctaatttttgcattttcagtagagatgaggtttcaccatgttggtcaggctggtctcaaactcctgacctcaaatgatccgcctgggctgggtgcggtggctcacgcctgtaatcccagcactttggaaggccaaggcgggacggatcatgaggtcaggagatcgagagcatcttggctaacacggtgaaaccccgtctctactaaaaatacaaacaattaaccggtcatggtggtgattgcctgtaatctcagctgaggcaggagaatcacttgaacctgggaggcggaggttgcagtgagctgagatcctgccactgcactccagcctgagcaacagagcaagactttgtctcaaaaaaaaaaaaaaaaaaaaaaatccgcccacctcagcctcccaaagtgctgggattataggcgtgagccaccgcacccgatggagctgacattcttatggggaatttagacactgtgaagattgagctcacaaataaatgtgtgattacaacagttaggtgttgaagggcaaggaaatgagtctttgtttttattggggatcacgaccaaggctctgagacagtgatgctttgatcatgatgtgaaggctgagtgggagttactaggggagaggagcattcggggcagaggaccagcttgtgcaaaggccctggggtggcagaagggagcattgcccctttggggaacagggagatgccagtgtggctagagatcagagggcaagggggacataggtgagccgaacctcactagccatggtaaggacccatcctgggagccatgagaagcctttgaaagttttcagcaaggagtgaaggggtcagatttacctctcagactactggggaactactgaagtgtctgagttaaagagtgacagccatgaagctagtttttttttttttttttgctttttttttttgagacggagtctcactctatcgcccaggctggagtgcagtgacgcgatctcggctcactgcaacctccgcctaccaggttcaagcaattctcctgcctcagcctcctgagtagctgggattacaggagtgtaccaccatgcccggctaatttttgtatttttagtagagacggggtttcaccatgttggccaggctggtcttgaacttatgacctcaaatgatccatgcgcctcggcctccgaaagtgctgggattacaggtttgacccaccgcacccggctcgaagctagtatttttgagaggttcttgcgtgttgttctagggcagaggtgcttaccctggggtccatggactcaaaggtagatttcacagggttcatgaacctgaatggattcaattattttaattagcttctagctaaaattcacttatgaattccgcccattatgaattaaggcaacaaagcacagtggtaattgtagtacacggctttgtcctcagcggaaatcatagatattctcagattatattacagtagctgcagatgttgtgaaatgttgtctgggctcatcattgctttgaaactgtggagttattttaccctattatttaatgagtttacaaagaatcacatgttactgtatctttttttttttttttgagatggagtttcgctcctgttgcccaggctggagtgcaatggcacgatctcggctcactgcaacctccgcctcccgggttcaagtgattctcctgcctcagcctccccagtagctgggattacaggcgcctgccacgacacccagctaatttttgtatttttagtagagacggtgtttcaccacgttggccaggctggtcttgaacccctgaccttatgtgattcacccacctcggcctcccaaagtgttggggttacaggcgtgagccaccgcacccggcctgttactatatgttattttgtttaatgctttgataaccatattccaaggtagttggattcctctgcattcctgcatattttattcatgaattcatgattctgtgcagtgtccacaggcttccttagaatgattaggggcacaagaaatattgggaaccccctggtctattttcattgtaactggcagaagggctcaaataagacaaaagagaaataattggctccctaacagagaagtccatggacaccctacattcagatgtttgaacgatgtcctcaggagcccatttctctccaactctggcttctgctggcttctgagtcacctccttcttaggcaagtcctgcccacaccatgcccacgctcaggctgtgatgacctgggcagctctgggcttaactagccctttcagccaggaatccagtagataaacggaggacatctttctggattgcttttgtgaaactctcagagatgaggcttattggctggcatgcctgggtcatgtgcccatactaaactaatcacagtggtgaggaacatggagtactctgattggcctgcttgggtcatgtggcaatcctgagccaattatattgatgggaagaagtattctgattggcctgcttgggtcatgtgctcatcctggaagcaaggtaggcagcgattgctgggtgacttgtttatctcgaaatcaggctggattagggtcttagtggcaggagtgtccaatctttcggcttccctgggccacattggaagaagaagtgttagtgtggaagaagtgaatttagtctaacactaaggatagtgttttagcttatagctgatgagctaaaaaaaaaaaaaaaaaaatcacacacacgcaaatctcataatgttttaagaaagtttatgagtttgcgttgggcctcattcagagctgtcctgggccgaatgcggctagtcgtgggttggacaagcttggtctagactttcatggtctaaagttatggctctcctaattcctgcagtgagataagacccctgcagagaatgatgacaaccggtgctcatatagtgcttgttgggtgccagggactgctgtagtactttatacatatttatcttcacagtccattcagtcctttcaagaacactaggaggtgggtcctattactaacttaatagtgctaaatatatacacgtactatgtaccctcacacacacacacacacaaatagtgctgacaaggtcattatcacgcaattggcaaatggcagccctagaatcccaggcccagctcttctctataactatgttgcttttccttgcctgctaggggaccttaggcgagggttgcccctcctgggtgtcagtgcttccatccataacacaagaattggactgacagttttcgggggttggaggtggagctgggaggggcgtcagggatgagaggtgtggggcattgggtcataaggcctttgctaagtcagcctggcttggagcttctctgtttcttttcccagggctgttcccgacacagcagtgcccacagaggcctactgactgcaggaagcagtgtgagcctgactactacctggatgaggccgaccgctgtacagcctgcgtgacttgttctcgaggtaagggccttgttctctctccagggcctccttctagggagcatgaggggtcctcagaggagaggtgaagaatctggaaggtggagagcatcatgatttgatgtctgttctctgaattgtcctcctggtgcctcagtttacctctctgcatttgtgatttgatatcagccatgaccttttgcatccatactttcacagagacttaacatgtttcctgaaggagaggactcacatttttttgagtttaatcctcaccacagccctaggggaggatttcttgcttatccttactttacaatgaggaatttgaggatagggaggttaagggcctttccaaagttacaaaactctggtaagtggcagaactggagtttgagttgtggcctgacaccaagagctgtgttcttttcctaagatcacaggacttccaggaaaactgtttcagtatgaccttttattgttagtctcttattatggttagagaatgcagtctgtgtgctatctagtgtttatttttgtgtggatttttttggggggtagggtgggggaaatttgttgagatctttttgtggtctaataaataataaatgatcatgtattttcagagtgttcagtgtatgggtgttttaaaatgtgtattctgtttgttgcgtataaagttctctacatatctattaagttaagcttgttaattgtgttatttaaataatgtgtacccttatttacttttatcacctttatttctgagagatgtgttaaaatcttatctcccagtatacttgttcatctattagattttcattgtgttctttctatttttgcttcatatatgtcaaagctatgttattaggtacataaatgttcatgaatgttatgtttttttggtgggttgggctttttatccacatgaatatacctctccattccttgtaatgccttttcccttaatttcacatttgtttggcattaatattgctattccttcctggaagaagtagcaaaggttaaaaagaaagaaaagtaataataatactgccatttcttctttctttttattagcatttatctggtgtatctttgaatttctaaaagtaatgactgcattttatgaaatgaaaattataaacatttattatttaaaattcaagcaatacaaagagtgtaaggaagaaaacaaacattgccctccccagccctccatctatagataactactattatcattagatggctgacacgcctctacctctctgtataaagatgggtaggttagtaaccagacagcctgtacacacttacaaagaaggaattttaagagaatggcaacatatttatggcattaaaatgataatatttaattttagtcaaaagtatcagaaaaagaaagcgaagtgaaacagaagaatgccaaacctcagtcagattaatgtatcttcagcaaaagatactgcaattcctttaaaaaaaaaaaccctctaaaattaagaaaggaggttatgaaaatcagtaagtggttaataatcatttcagaatctactatctcttgcagtaaaggcaaaatctgcttagtttgagttttggacagtagagaatagattgactccctgtaatgaagaacaaagtaattatttttcccacctcctcatcctcttcctgacttttattccttacacaaattttactttgtcataatctataatgtttatattctcatctgcaaccataagtcccttggcatgttagccttaacattttttattattcatgatgagtttatttggcacagcttctctgttcctgagtttttcactttgattcatcatttgagtgattggattacactgtcaggtggatttttcaagaagggctcgtctttgcaatattctctgttatttcatgtttgaggatgcttgtctgttgcctatatttttgttttcttttttttctttttgagacagagtctgactctgtcgcccaggctggagtgcagtggtgcaatctcggctcactacaacctctacctcctggattcgagcgattctcctgcctcctgagtagctgagattacagggatgcaccaccacgcctggctaatttttgtatttttagaagagatggggtttcatcatgttgcccaggctggtctcaaactcctgacctcaagtgatccagccgccttggcctcctaaagtgttgggattacaggtgtgagtcaccattcccggcccaatttcttatctttaaattttaagacagggtctcactttgttgtccaggctggccttaaactccagggcttaagtgttcctcctgcctcagcctcccgagtagctggggctgcacttgcatgttactgcacccaacttacaatttttttgtgtgtctctgaggatataaattatagtcatgtattgcttattgacaggaatacattctgacaaacgtgtcattaggcaattttgtcgttgtgcaagcatcctagattagtgtacttacacacacctacatgatgtagcctactgcacacctaggttctatggcagatccttttgctcctaagctacaactctgcacagcatgtgactgtcctgaatactgtaggcagctgtgacacaatgtgagtatttgtgtatctaaacatagaaaaggtgcaataaaaatacgacataggccgggcacagtgactcacacctgtaatgccagcactttgggaggccgaggagggtggattacctgaggtcaggagttcgagaccagcctggctaacatggcgaaaccccatctctactaaaaatacaaaaattagctgggcgtggtggcacgtgtctgtagtcccagctactcaagaggctgaagcagaagaattgcttgaacctgggaggcggaggttgcagtgcgccgagatcatgccactgcactccagcctgggtgatagagtgagacaccatctaaaaaaaaaatatgatatgaaagataaaaaaaatggcacacttgtacagggcacttaccgtgaatggagcttgcaggacacgaagttgttctgggtgagtcaatgagtaagtggtgggtgagtgcgaaggcctggggcattactatgcactactgtggactttatcaacactgtacacttaggctatactaaatttataagacacatttttctttcttcaataataaattaaacaactttttcactttataaactttaactttttaaacttttggctcttttgtaataacacttagcttaaagcacaaacacatcgtacagctgtacaaaaatattttctttatagccttattcattacacttttttctactttaaaattttattattttattatttttaacatttttaaattaaaagctgagacgcaaacacctacattatccgaggcctacacagagtcaggatcatcagaatcaccgtcttcctcctccaaatcttgtcccattggcagcgtgcagtgactcacacctgtaatcccagcactttgggaagccgaggtgggcagatcacttgaggtcaagagttcaagaccagcttggccaacatggtgaaaccccatctctactaaaaatataaaaattagccgggcacgttggcatgcgcctgtaatcccagctactcaggtggctgaggcaggagaattgcttgaacccgggaggcggaggttgcagtgagctgagattgtgctactgcactccagcctgggtgacagaatgagactctgtctcaaaaaaaaaaaaaaaagaatcctgtcccattggaaggtcttcaggagcggtaaggtaacatgcatggagtatcgtctcctatgataacaatgccttcttctggatacctgcagaaggacctacctgaggctgtattacagttaacttttgttttaataagtaggagtacactctaaaataatgataaggccggcttggtggctgatgcctgcagtctcagcacttagggaggccaggctgggagaatcacttgaggccaggagtttgagaccagcctgggcaacacagtgagatccccatctctacacaagataaaatacattagctgggtgtggtggcatgcgcctgtagtcccagctactcaggaggctgaggtgggaggatggcttgagcccaggaagttgaggttacagtgagctgtgatcatgccactgcactccagcctgggcaacagagcaagaccctgtttcaaaaaaaaaaaatgataaaaagtatagtacagtaagtacgtaaaccagcaatatagctttctatgatcattatcaagtattacatactatccataattgcatgtgctatgcagcacttttatacaactggcagggcagtaggtttgtttataccaacatctccacaaacatgggagtaacgcacgtgctacgacattgccgtggctatgacatcactaggcaataggaatttttcagctccattataatctcttttattgttttttttgtttgagatggagtcctgctctgttgcccaggctggagtgcaatggcgcaatctcggctcactgcaacctgggttcaagcgattctcctgtcttagcctctcaagtagctgggattacaggcatgcgccaccatgcctggctaatttttgtattttttttaggagaggcgggatttcaccatgttggccaggctggttttgaactcctgacctcaggttatccgccctcctcggcctcccaaagtgctgggattacaggcgtgagccaccgcgcccggcttccattatgatcttgtgggaccatcatcatgtacgccatccattgttgactgaaatgttgctctgtggtgcgtgaaggtatcatttctaatgttttgttctgttttccctcttttctgcctccttgagtgttagtgctctttgcattcagagctcctcttccttggcgctggttttcctctgatgtttggcgacttctagttctgtgcacatcatatctcatgatgccggtggtctgcgaatggggcttctgaaacccacctctgagggcaatggggctcaggtggggctgcaacagtctctttgcgggaagacgcgtggcctctggctctgtggcatgagtgatgaggagctatccagagcctttcccccttcttcagagagtcccccttggctgcattctgggctgtggtctccttcactctgatcttatctgtcctctgccttccgtatttcggggagttgtcttcgtttctgatctgccaagcttgccccttcttggtctccaggcctgttacacattaattattagttttaccagtgctatttttgttttgttttgttttgtttgagacggagtctcgctcttttgcccaggctggagtgaagtggggccatctcaactcactgcaacctccacttctcgggttcaagtgattttcctgtctcagcctccccagtagcttggattacaggtgtgcaccaccacacctggctaatttttgtatttttagtagagacagggtttcactatgttggccgggctggtctcaaactcctgacctcaggtgatctgcccacctcggcctcccaaagtgctgggattacaagtgtgaaccaccactccccgcctagctgtactttttatgtctgttaaccaacctgtgatttcctgcttttcctgccagcagttgttattatctgtctttttgattcgagtcattctagtggttgtgaagtggtatctcactgtgattttgacttgcatttccctaatggctaacggtgtgggacatttttcatgtgtttattggccagctgtgtatcttctttagagaaatgtctattccagtcctttgtccattaaaaaaattaataaactatttctggctgggtgcagtggctcacgcctgtaatctcagcactttgggaggccgaggcgggtggatcacctgaggtcaggagtttgagaccatcctggccaacgtggtgaaaccccgtctctataaaaatacaaaaaattagttgggcgtggtggtgtgtgcctgtaatcccagctactcaggaggctgaggcaggagaatcacttgaacccaggttgcagtgagccgagattgcgccattgcactccaacctgggtgacagagtgagactctgtcttaaaaaaaaaaaaattaataaactatttcttagagcagttttaggtttacaggaaaattgaacagaaaatacagagttcctatataccctcaacccccttcccaatctcccacagtttcccctattttttgtttgaaacagggtatcactcttttgcccaggctggagtgcagtggtgcaatcacagctcactacagcctcaacctcctgggctcaagcgatcctcccgcctcagcctcccaagtagctgggactacaggcatgtgctaccatgcctggctaatttttgtattttttttttgtagagatgggatttcaccatgttgcccatgttttatagagatgggatttcactatgtcgccatatgagggcaaatgatcctcctgcctcggcctcccaaagtgctgggattaaaggcgtgagccactgcacccagcctcccctgtcacgaacaccttgcattagtgtggcacaattgttagcattgatgacctgataatgatgcattattattactaactgaagtccatagtttacagcagggttcactctttgtgttgcccattctagggctttagacaaacggatgatgaccacgtgcccaccatcaccgtggcatccagaatattttcactgccctaaatgtgtcctgagctcgtcggttcacctctccctccccctgaacctctggcagctactgatctttttactgtctcgatagtttcatcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctcaagagctatctggagagacgccttccttctgttcccctctgtgacccctgtctgtgtcccttagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggtcagtgtccccacccttaactcaggacagagatctatgctgttgctgctgcaccttccgcccaccccagtgcactgttgacttccgacctcccgcttcccggagactgttggacagatcatgtctcctttggcgatgggccagggatgtacccagcacccagcccttctgctgccctcccccaccttgtgttccaggtgcagagagaccctgctgtcccctggcatagacctggctggaggaggtcttgctttggtttgaggctcaaggcagaagttatctgatgccccataaacaagaagggaacctcaagtctctgtcctgggagtttcctagaagattggggttggcttccccctttcaggttcagggcattgggagttagaggtgctgagagatctggccccaggctcaagacttgagaaacttgggtttcttttccaacttaccgtgtgacctcagacaagtttcttacctctctgacttctacttctctgatagtacaaggtgtcagggctgcttttaaccagagaaggggtatgggccacagaacctgtctgggtggagttgggaccatcttccagaagggaggcatgaggagtgggtgggctttggagcacagcacagagtggctgccgcagttgcagactgtatggagccggggagatgggctcagaggcagccctgtgtccactgtccactgaggagaaaagtgccacaaagtgcctgtggtccctcccccaaccaggtccttctctggagtcccatgccctgttgtgcaaacctggggattggcagtcacccccatcgctaccactgcctgccccttttatccttccctcgttccctcatccttcacagccagcccatcctcgagtcctgtagatttggcctccaattatcttccccaccttctcaccccgaataccttctcttatacagcccccatggcagacagccagaatgacccttgcaagaccaaatctgaatctgatcctctctctctctctctctctactcactcactctctctctgtctcacacacacacacacacacacacacacacggatatatacctgaaatgcttcagtatcttcctgttactctaaagataaggacacaaggccaggtgtggtggcttacgcctgtaatcccagcactttgggaggccaaggcaggcagatcacttgaggtcaggagttcaagaccagcctggccaacatggtgaaacctcatctctactaaaaatacaaaaattagccagccctggcagcaggtgccctgtaattccatttactcaggaggctgaggcaggagaaccacttgaacctgggaggcggtggttgcagtgagctgagattgagccattgcactccagcctgggtgacaagagcaagactccgtctcaaaaaaaaaaaaaaaaaaagaaaactccagggactcaccacggtgtccttcaggtcccaaggcccccagttgacctgccttcttctcttcatgtttcagagccttcttacatttattttgtacataatgtccagggcttttagcggttcttggcgggaggatgaggggaaaacgtgtctaagccatcttcccagaatcagagtctcaggatgtgatcccaacacagccccctcctttctcccagcttcagctctcagcaccaagccctcactctctgggctccacctgcgctgcccttcttccaggttggaggacgtgtgtgcttctctgtcccacccgccctctgcacgtgctgttctctctgtcggagacacccttccctccccattcacttagtcaaatcctactcagccctgagctctccaccccacttcctcaagaggccttccctggcctctcactagggaagctggtagcactgtgtcctttgcaaatgtggatacatacctctctctgtctcttggcttgatcaatgtctgtctccctccctggctggaagcttcctgagggcaaagaccatgcccctggtgtccatcaacatctccccactgcctgatcaaatgctaggcatggcacctgctccccatagagattcattgaattaagatatggggacacctgacagggagctccgagctggtgggggggtggagttcaaatctggtcaaattccagggtcgggggagagcgctctgctaaggaatgatggaggcctccacccataagcaggggagagtgctggagtggactgggcagcagatacctaggattttgcaaagatttgcaactgtggggcatgttcccacccgcctctggacctcggtctccccatctctcaaatgaggaggtataactgaaggccttgggggcctctccaaaaaggccaaacttcccaaaagtttccagctcagaaacttctgcatctttgtgaaaaacatcttgagttcagttgttccagccaaggcttcctgctggagggactgtctgggcagtgttcctgagactgccacacagcggcgccagaggcctccctttgctgcccctggaccccagctgcccaatgcagtgcccctggcccgtggcacgtggccacgcacttaaaatgcagctaggggccgggtgcggtggctcacacctgtaattccagcattttgggaggctgaggcaggcggatcacttgaagtcaggagtttgagaccagcctggccaatgtggtgaaacctcgtctctactaaaaatacaaaagttggccaggtgtggtggcgggtgcttgaaatctcaactacttgggaggctgaggcatgagaattgcttgaatccgggaggtggaggttgcagtgagctgagattgtgccactgcactccaacctgggcaacagagttagactctgtttcaaaaaaaaaatccgataaaaaataaaaaaaatgcagatacgtctgcattgagaagtgctgtgtgtacaatatgcactggatttcgaaaacttagtataaacaagaatataattaattattttttatattgattgcctgcaaacatggtaatattttagatatactgggttaaataaatatactatgaaaattaattgcactgatttctttttaccttttaaagtgtggctcccagaatatttgagctggcctgtgtgactcgcatatctctgttggacagcactgttttagaagtgttctaatctcagctgccaaaccctggttaatctctggggtcccctgtggactcacccatggggcagctctccggggttgttgttttttttccagctgtaaaatagaaagcagtttctgcctccagtcagccaagccccacgctaagagccttcactggctgtctctcctgaaattctcacgtctccataagacagacagtattagccccattttccaggtgtggaaatcgaggtccggagatgggaggtaaattgcccgcggagacagagcaggaaatgtctaagcttaggtgtcatcactccaccatgccacagaacacgagaggtcagcattgctcgcgctcacctccacggaaagcttcagagcgaagtcccacacatacaggccaccatttttttattttttttttttttgtgatggagcctcgatctgtcacccagactagagtgcaatggtgtgatctcagctcactgcaacctctgcctcccggattcaagtgattctcctgcctcagcctcctgagtagctgggattacaggtacctgccaccatgcccggctaattttttgtaattttagtagagatggggtttcactatgttgtccaggctggtctcgaactcctgacctcatgatccgcccacctcggcctcccaaagtgttgggattacaggtgtgagccaccgtgcctggcgacatacgggtcaccttctaagtgatgggatgggagtccagatgggtgtaaggacatagcatttaccatatgtcatgcaatgtgatgggcacctcacgtgcactcttctgtttatcctgacgacagcctggtgaagagtgtatgattataatcatttgactgggctgggcacggcagcttatgcctgaaatcccagcactttgggaggctgaggagggtggatcacctgaggtcaggagttcgagaccagcctggccaacatggcgaaaccctgtctctactaaaaattagccgggcgtggttgcaggcacctgtaatcccagctactcaggaggctgaggcaggagaattgcttgaacctgggaggcagaggttgcagtgagctgagattgcatcactgcactccagcctgggcgacagagtaagactctgtctcaaataaataaataaacaagtaaataaaatggactttcctggcacagttaggacatagcaggcaaactgaggggcactggctagacgatgtgtgtgttttcttctccactctgcttctgtccagcattcttcaggactccttggattgcatgtagcaaaatccccaattttttagcacatgtagcttaaaagtctggggatagctctgagaagcttcaggcatggctggatccagggctccatcttgccccatctctcacctctatttccctctctgttggttcatcggcaagatacttacaagcagctctgcccagcgccagtgggaagacagcttccctttcttacatttttaatatccaaaaccaaaacctttaaatcccaaaccagaatctttaaattctacctcacaggcttgggtcacatgtccgtccctgaactggctcatcgtggccagaggaatgcaacggattgattggtccagcctggtctcatggccactcgggaaagggggttcagtcggtcccaacctctaaccacagatgctgagatcagagggagagtaattccccagggaaagataggctgctttactctgaaggggaacgggtgccaggcgggtgccacctccagatgactgctgtgttttccaagggccccatctccgactctggcctgtggtagtgaagggtgtattccgggagactttgggtccccaacactgattctgaaggcactgctgtcccccctgcaggcacggcgcagaagaacacggtctgtgagccggcttccccaggggtcagccctgcctgtgccagcccagagaactgcaaggaaccctccaggtgactccctggctttgcctcctcctcttcccccaagctggctttcagatgaggctgccccaccccacaggacgcccatggtacaactgggctgggggtgtaagcgggattcagcccatggtgtcagcactttggggtgcctctctgccaagcccctcagatcatttgaggccctagggtgtgcccagccctgccctgagcacatgggagacccacagggcttagaaaacacaggccttgctcccaggagcttacagtgggcccgccagaggcagtgggccaagggcctgggaccccatctctgtggaaactgttactcgtgagcacaggcctcccttgccccattggcagaattatcagtcccatctctggcttcttccccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtaatttccccatgaagctgtgggtcgtctccctggggtgctcgattggtggatggcccatgagtgggggtgtttggagcaggcgggcagtgatctgtggtcttttcctggtggggagagaagacggtggtaaggtatgatctagggctgaaagcattgaggggcagaggtagacaccagagggctcattcatttgccagcagtgcagagggcctgccttgtgccggacacccgtgccccatctctccctctatttccctctacgttggtttgtcagagggaaatgggtcccactctgctgttgtgacacttgcgactcagctggccagcctctgcacgtgtccatctgatgccctcctggtctccatggcgaagggtcgaccctcagtcatttttctttttcttttttttgagacggagtttcgctcatgttgcccaggctggagtgcagtggcgcaatctcggctcactgccacctccacctcctgggttcaagcgattctcctgcctcagcctcctgagtagctgggattacaggtgcccaccaccacgcctggctaactttgtatttttagtagagatgggatttcaccatgttggtcaggctggtctcgaactcccgacctcaggtgatccgcccacctcggcctcccaaagtgctgggaggattacaggcgtgagccaccgcgcccaacctagtcccattttattactgaatagccctccatggcgtagatatgccgagctctgtttatccagtttttgaatatttgggttgtttctgccttttgactataatgaagaaagaaaaatacatctttgcgtgtatgtgctttcctttctcttgggttggttttgtaaaaaaaatggatttgtgggacttctaacaattttgggttggagctcttttcctatagttgtaccttctcccgctccatggctttgcttattctctctatgatgtcttttgtttgtttgtttgtggtttgtttttttgaggtgagtcttgctctgtcgcccagactggagtgcagtggcgtgatctcggctcactgcaacctccgcctcctgggttcaagcaattctcctgcctcagcctcccgagtagctgggattacaggcgcctgccaccacatttggctacttttcttttttttagtagagacggggtttcaccatgttggccaggctggtcacaaactcctggcctcaagtaatccacccgcctcagcctcccaaagtgctgggattacagacgtgagccaccgcgcccggcccacaccagtctttaaaagagggaggcaggaggcacccagcccctccctgcccaataccattctgaacaggagttacgctagtgtgctgagctctcagggaagctgttcccaaagttttgagcaggggagtgacagagccatgagacagggttgggggaagctgtggcatggtggcctcaggaggaacagtgggcaggggctggttggggggcaatgagtaccctcctctcgtgtggaatgcacgcagcattcctgtcctctctgagcctcaggactccctctgaaaggctggactgagctgacatgcggagtttgggagctggccacggtgagggatggggggcttcagggttgggtggggagtgaggcctttgccaaggcggcctggcctgcagcttctctgcttctttccccaggtctgtccccaacacagccatgcccagaggggtctggtgattgcagaaagcagtgtgagcccgactactacctggacgaggccggccgctgcacggcctgcgtgagctgttctcgaggtaagggcctcgtccctccccgggcctcagtttacctctctgcatttttgaaccgtgaacttccagtaactactcccccttatgtttgtgggtttttgatgggggtcgcctcttttcagagggcttccattggcatattatttccttccaggaagcgtttgtgaatcacccacctgttccaaactcggctcatcaatgtttgtaactactctgtgattcaagcattgtgatcattccccttttacagaggaggaaacggaggctttgggaagtcagggaacttccaagggctgtgggctggagtttgaacccagacaggtgccaccaggttccaggttctcgtccactccactcgctgcccctatgagccacttattctttttttttttttcccagacagggtctcactccttcacccaagctgcagtacggtggtgggatcatagctccctgcagctgtgacctcccaggatcacatgatccttttgcctcagcctttcaagtggctgggactataggtgcacactaccatgcctggctaattaaaaaaaattttttttcatacagatgggggtctcactatgttgcccaggctgctctcgaactcctggactcaaatggtcctcccaccttggcttcctaaattgctgggattataggcatgagccaccatgcccggcctgcgagctgttttgacaagcacttactgagtgcacagacacagcacgatgcaggtgtggggcttccctgtgcccagcccatcacaacctcccagcgccagcagcaccccgaggggcatgtgggcagggggtgttgctcaggccacaggctgctgtgactgttagaggccctggctattcacggaggccactgggaatgtgtgtctgtctccttgtccagagctgcttttgggcagcaaagcagagtgaagggtcaggggaggccaaaaagaaccacagacactgtttgttgtcattggaggtctctgtcctagttactaaggctgcatagcaaattttcttaaaacttaattgtgaaaacaaatcattctttgtactcacagattctgtgagtcagaattcagacagggcactgcggggacagcttgtctctgctccacaatgtctgaggtcttagctggaaagcccaaaagctgcagatcaggaacttctgaagcttcattcattcacctgccttggggttgatgttggctcctggctgcagccttggttcccttccatgtcggcctcttcgtgtcttacctggggcttcctcatggtctggtggttaggttctaaaggcgaagtctttttctctttttttctttttttgtatttttagtagagacggggtttcaccatgttggccaggctggtcccaaactcctggcctcaagtgatccgccggccttggcctcccaaagtgttggaattacaagcatgagccattgcccccggccataaaagtcttgagagagagagacagacagaaagagagagtgagagagagacagaaagagggagagaaagagtgagagagagaaagagagagacagagagaaagagacagaatgagagggagagagacagagtgagagagagacagaaagagggagagagagagacagaaagagaaagagacggagtgagcgagagagagagagacagaaagacagaaagagagactgagagacagagagagacagagatagagtgtgacagagagaaagacagagaaagagagagagagagacagaaagagagagagagagacagacagaggcagcagccacccctccttttatgacctggccttggaagtcacacagaacttctaccactttctgtttgttgaggcaaccacaaatgtcacttgagaccaagggaaggaaaacagttgtacttcttgacaggtaggtggcaaaggctctggaagggccagaacatcactgcagccatgttttggggaaatacagtctgccacaaccaccatgtggacatatggagaaagaggtgttggctctgggcccagtaattccttcagctctcctaactgaaaccccacgaggcagtggagtggtgtattagtagctaaaggcatgagctctagaacccgagtgccgggttcagatcccgcctctcccacttgatagcctataacctcaagcaggtttcctaacctctctgtgcctcagtttcctctgctgcaaaatgggcatagtattatctatctcagagaaccatgtgagaattgaatacatgattgtaggttaatctgggtagagtgctgagactactgtctcacacatactcagttatcttaagagctataataataatgataatagctgccattgtcccaaatggtttcattcattgctgagctcacacacaccctttgcacaaattccccaaatcctgcccagttcccttgctctggatgttgtaagaagagactgtccagcccttatcattatcatgctgggtctctaagtatcctgctgattgagatctaccctcgcggagaggtcccatttgcctaatctactgatgcagtcgttctgtatttacctctaagtggagcgttgcaaaatattcccgaatacgtacaaatgcattattacacttattaaaaataatacctctaacatggtttttttttgcttttggaggaaaaaaaatctttttttttttttttttttttttttttttaaatagacagagtcttgttctgtcgcccaggctggagtgcagtggcactatcttggctcactgcaacctctgcctcccaggttcaagtgattctcctgcctcagcctcctgagtagctgggattacaggcacgtgccaccaggcatggctaatttttgtatttttagtagagacggggtttcaccatgttggtcaggctggacttgaactcctgaccttgtgatctgcctgcctcggcctcccaaagtgccgggattacagtcgtgagccaccgtgtctggccaaaaaatctttttattattaaaaatttcaaacatattcagatgtagagtgagtcagagatggctgcgtactatcacccagctttaaacggttatggagtcatggccagtcttggctcctctgcacccatgcccgctcaccccgtcccctggaggactttcttttaacagctttagggagagatagtgggcatatggtaaagtgcatagattaaaggatgcaatctgataagttttaacaaatgcatgcagctgagcaaccagccatccccctctaaaagttacctcgggttgcttgtcaccatttcccatcccctgcttatggtcaccatgcaatagcttgcatgtaaatgcgacatacagaataccctcgctttttgcctgccttctttcaccctgcagaattattttgagcatgctgggagagctgctcaacggcatagtcagacgagcatttattttcttgttggatgacccttggacaactgcttctctgtcttcctgggggctctctggaccccctgcccttgccatactgatctttctccgtgatcctcatctgtgtcccttagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccagggtaagcagttcccaccccaggcctcgaccacggggtggagtctgtgcccccactgttgtgcctctccccaccaacagccaggggtggaggcaaatgacctacaccctcggctgttcattaggtcaggtttgggttctggttatcctttgagtagtcagactcagtgaatggaatgataaaatccagttttagcattttggcaagagattctgttgattaaaaaaaaattcttcctgaaattattgggctggtaaaatctttatatttttgagatggagtttcgctcatgttgcccaggctggagtacaatggctcaatctcggctcaccgcaacctgcacctcctgggttcaagcaattctcctgcctcagccttctgagtagctggggttacaagcattcgccaccacagccggctaatgttgtatttttagaagagatgcggtttctccatgttggtcaggctggtctcgaactcccgacctcaggtgatccacccaccttggcctctcaaagtgctgggattacaggcctgagccaccatgcccagccccgggctggtaaaatcttgacctgtttgcaaggctgttttattgacttagagagatgaatatcaagtttctgaagagatttctaacaggacggttggctttaccagtgtgcaggaaactaaaaccctgacagttttttgttgttgttgttttttgttttttaagggctttgagagattttaacaaatctccaggtggtttaaaacagatggaagagtggtgacaaaaccaaggggaatggccaggcgtggtggctcacgcctgtgatcccagcactttgggaggctgaggcaggtggatcaccttgaggtcaggagttcaagaccagcctgaccaacatggcaaaaccccgtctctactaaaaatacacaaattagctgggtgtggtggtgggcaccgtagtcccagctactcaggaggttgaggcaggagaatcgcttgaacccgggaggcataggttgcagtgagccgagattgcaccactgaactccagcctgggcaacagggcgaaactctgcctaaaaaagaaaaaaaaccaagtggagggaaggtcacccaatgtgactctgtgagggctgccagagaagtgaggggtgacttgcttctaggacccccagagaggctctgggcttggaagaggcaggcagatgaagagcgggagggaagttgagaggtgtgaggtgtagtggcctgggactactaaatcttcaaacacaacttcaaaatgtattacaatggcatggcatggccactgaccagtttgcacagatgatgcctgagtttttaatccccagtattgtctttttttttcctctttttttagagatggagtctcgctgtcttgcccaggccgatgtgcagtggtgtaatctcagctcactgcaacctccgtctcccgggttcaggcaattctcctgcctcagcctcccgagtagctgggattacaggtgcccgccaccacacccagctaattttcatatttttagtagagacggggttttgccatgttggccaggctggtctggaactcctgacctcaagtgatctgcccgcctccacctcccaaagtgctgggattacaggtgtgagccaccgtgcctggccaacaattgtcttcttgagtcagaacattgaaggaatatccggggaaagttcgggccactagtggggtgctgtcactctgtttgtaaagccctctttacttgggtatttggaagtgcacctgtcaacaggctagccacaccccatcaccctgaaatggaggctgccagctcacactctccgcccatgggcccagggttccctggccaacttcctactcagggaagagacccattgtgaacaggacatactaacacagcagaagaaactgtccccgctcagtgactggaatattcagtagagtccttaggattttattttgtttgcataaatgtatggggtacaagtgtaattttattacatgcttagattgggtggtgaactcaggacgtttagggtatccctcacccaaatagcatacattgtaccccttaaataatttctcatggtccacctacctatacctcccaccccctcacccttctaagtctctgttgccttttattccactctccagctccgtgtggacacagtatttcactcccacttagaagtgagaacaggcagtatttgtctttctgtgtctgaatgtctgcacttaagaatatggccttcagttccatccatgttgctgcgaaagacttgatttctttccttatgatggctgagtagtattccattgtgtatagatgccacatttatctattggtggatgcagcataaccctccccccccacccttttctttttgagacaaagtctcgctctgttgcccaggctggagtgcagtggtatggtctcggctcacggcaacctctgcctcctgggtttgagctattcttgtgcctcagcctcccaagtagctgggattacaggcgtgcaccaccacacccggctaatttttgtatttttagtagagacggggtttcaccacattggtcaggctggtctcgaactcctgaccccaggtgatctgcctgcctcagcctcccaaagtgctgggattacaggcgtgagccaccgcacccggccaagcataacccttttaaaataaatatgaatgagcaaagatttgtaagaaaaaccagccctacaaaggagaataaaaagatacgaaaccagaaattcttaccacacatgaagctttgataaatccaggaatagaagagtacttagcaacattaaattcgtgtctgcagaaaaattcacgaagtcgttacatccataaggtgggcacagaatgctatgaaaaggaacaatatgggatcagagggcaagaaaaggctttttagaaagtgtgcttgtgatcagcccatcatctctaggttctccattcacctttccatccctgccctgccatcaacgatggctccgcctttctcctctgtagggagcatgcagttaagccttgccagcagagggcgctagagggccatcgcaggaggaaggaggcttctggttgcatttgtttttttgtttgtttgtttgtttcttttctttttttgagacagagtctcactctgtcgcccaggctggagtgcagtgacgcgatcttggcccaccacaacctccacctcccgggttcaagcagttttcctgcctcagcctcctgagtagctgggattacaggcacgcgccaccacgcctggctaatttttgtatttttagtagagacagggtttcaccatgatggtcaggctggtctcgaactcctgacctggtgatccgcctgcctcggcctcgcaaaagtgctgggattaccggcgtgagccactgcgcccggccatttgtttcttcttgctcctgctgcctggcctggtgaccaccttgatgtggctctcccaatgcagacattggcacgtgccaggcctcatgtctgcaaaagtgtcctgactccctgattccctctgtgcatcccccaccagccacaggtctttggcaccccaaagtgctccaggcgtctcccccacagtggcagcctcaatttctctgtgcacctgaccagaagcatagacttcaggtcaaaaggacctaccaagagcaaagcaggattaatggaaattacccacgctacatgtaatagatgcaccaccatgattttatctacctgccggttgatggcatttgggttgtttccagtttagggctattatgaatgaaaacagctgtgaatattctttttttttttttaacatgtatgaatttatcttatatcttttattattatttttattatttttagagacagggtctcactctgtgttccaggctggagtgcagtggcatgatcttggctcactgcagcattgaactcctgggctcgggcgatcctcccacctcagcctcccacagtgctgagattactggcatgagccaccatgactggccgattcttgtacaagtctttgggtggatgtatattttcatttttcatgggtaaatacctaggaggagtggctaggtcattgtgctggtcacatagtcagaatgtttttgaggactagtcaaagctggatacctctggtctgatacaaccccttcgttttacacccagagagaagcacagggccgaagctagaaccagaatgcagggatcccaagggtcagcccagagtacttccactggaagacaccacccacccacctccttcttagttctgaacctagaatttacccagctaaattacagtcacttcagctaaattacaatcaagtttgaaggcagcataaaaacattttcagacataaaaggtccagaaggcttttcttcctatatcctctcctaggaagatatttgaagatgtaattcagctaagtgagggggcaaaaaagaaaaacaacaggaagccatggaatctagagaccagcactccatcctagcagagcaaggaagggaagtcccagaatgatgtggtatagaccagttgagccagatcagagcaggaaaatggaaggaaggctccgaggaagtgttcccaggaatagaagagagaattgtagtaaatttcatgattagtagagttgaaaagcctgaggatatggtgagggcacactgtccttttatcaacaagaaaaagaaaggcaattgaaaactcccgggaaaagaaaaagatgacaagaaatatacagtccaaatatgaagatgaaatttcacctgattttaagcgattgctggatgtacaaaaagagaatctgtttggccttgatgctgagacaattctttaaatggcccaaggactgggtgtttggatttaaagagaagtatatccatctggtaaataatattttttttagttcttaaatggaggctgagtaggcaggttcttttcttctcttccagtaggccattaccagagaacacaggcagaccaactaggggctagacaatgccttctcctcaccttcaaatccaaagaggaggaaaaggggaggatcactgactcagggaggaagaaggaaagttacaagttaggtatagtatattcagagaggggatgagaggcacccaagggatactaggttccccccttctgcacatacaggagggacagcagatctgtcgctggatttcagcaggtgtttcagcagcagctgagaccatgggcctgtctagttacatcaggctgccttggagagcaggcagggggctctctcctcatgatgctgactgggaatagccacagttaatgggtttgagcatcagagctccagtccactcaaagtaagtgttcactgaaacccaatgacctttcaaacactgattcaaatactgattaacgagcatgtaggaaccatcataacacatcgcatcatcttccccatagtctccaggctccagctaattcaggtaagagtccagtgaccttccccaaagaggggggttcctcagaaccctacaatgcaagaaataaattaatcctggctttacttttttgtctatttgaggaaaaatctgagaggcgtcacgaacactttgtagaggggagatgtgggtatgtgtgtggggttgctttgtaccacatcaaaaaggggtgcctccaccagggctctgggggtggagaggtgtagtgactgagcataacccacttctaatgtgggccaaattatcctgccccagaaaagcaggaagctttgaagaaggtgcccagtccccaggcaggaggcagtgccatccagaggagagtgctctgggctggaactcgccatctctgtttcctggctgtagctccagccctgcggctctctccatctgtaaaacaaggtagctgggtcagaccagtggtggccagctatgaactggccttcagagacattccgtctggccagcatagcaatccagccacccttcctaggcactcaagaggaatgaaattatacgttcacacagaggcacgcacaagaatactcacagctgccttgttcgtcatagttcaaactggaaacaacccaaatgtccatcaactagcgaacgggtatgtaaacagtggttcatctgtacaacagaacgccatttggcaacagaaaggaatgaagctgaatgaatatcaaaaacattatgcagagtggaagaagccagaccccaaagagtacatactgcatgattctgtcgacatgaaattctggaacagatacactcctctatagtgacataaagcagatcggtggttgcctggatctggaggtgggggcagagtgagtgaggaggggcactagggaaccttctggagggatgagaatgttctgtattttgattggagttagttacctttgtcagaactcatcaggctgtacacacttagggacattttctttttttatttttacttattaaaaatagagacagggtcttgctatgttgcttaggctggtttcgaactcctgagctcaagtgatctgcctgcttcagcctcccaaagtgctgggattacaggcgggagccaccctaccctgccaggggatactttcttgtatataaatgttgccttaggctgggcatggtggctcacgcctacgatcccagcactttgggaggctgaagcaggcagatcacttgaggtcaggagttcgagaccagcctggtcaacatggtgaaaccctgtttctactaaaaatacaaaaattagctgggcatgttggcaggcacctgtaatcccagctactcaggaggctgaggcaggagaatcacttgaatccgggaggcagaagttgcaatgagctgagatcgtgccactgcactccagtctgggcagcagaggaagactcaatctcaaaaaattaaacataaataaataaataattccttaataaagttgatttaaaagaaaaaaactttaaaaattgaggctgtatttaaacattaggcgatttcagttttctcttaaaagcaaaaggtctagcgtcactgtttcaccttcctgggtgaccacagctgttagagacaagtagcaacttctccactttgttttatttattttgagtctttctctgtcgcccaggctggagtgcagtggcatgatctcagctcactgcagcctccacctcccgggttcaaacgattctcctgcctcagcctcctgagtagctaggattacaggtgtgtgccatcacacctggctaatttttgtgtttttagtagagatggggtttcaccgtgttggtcaggctggtctcgaactcctgacctcaagtggtcctcctgcctcagcctcccaaaatgctgtgattacaggtgtgagccaatgtgcctggccagcttttccactttgatcttttgaaacacaaatctgactgtcttagctcccacggtgttgcctcgctggaagccaccagtccctgctggttaactctttcctggagacaccagcctccttggcgctggttctcagatgttacgtcccctctgcagatatggctgagaaggacaccacctttgaggcgccacccctggggacccagccggactgcaaccccaccccagagaatggcgaggcgcctgccaggtgactcccccaccccttctctctgtttggctgctgcaggagggagctgtccctgccatgcccaggggatgcctgggaggcagctgggctgggggtggaggtggggcctgggctgctcttttgttaaatgtgtgcccatctctttgctgacaccattggaaagccagaaggccttgaaacccagtccctgccctcaaaatgcctggcagagactcggggcagaggatctaggggcccaggctctggttgcgcagtctccagagaaagggaattattcctgaagacccacttccctcttcccatcttcatcactcctgccttgggcttctccccgcagcaccagccccactcagagcttgctggtggactcccaggccagtaagacgctgcccatcccaaccagcgctcccgtcgctctctcctccacggggaagcccgttctggatgcaggtaatggtcccagcccactcacccctactcccagcaggggcttcctcctggggaagtgtggattgggggagccaggagggagcttctcctttgtgggtatggtctgagaagggggattaaggttgaccccaggtttctggcttcttgagttggtgctgtggctctggcacttgctagtgactattcttttctttttgaaacagtctcactctgttgctcaggctggagggcagtggcacccatcttggctcactgcaacctccacctcccaggttcaagagattctcctgtctcagcctcccgagtagctgggtttacaggcgcttgccaccacgcctggctaaatttttttttaatttttagtagagacggggttttgccatgttgtccaggttggtctcaaactcctgacctcaggtgatccacctgcttcagcctcccaaagtgctaggattataggtgtgaaccactgcgcctggctgctagtgactattctttaattcttgtaggcaggaatttttttcacagcttcatcctcgtggcttataattgctactcagaaaataggtctttgttgattgatttcatgactttgactagttgttcgagcctttgagcctcagttgtctcatctatacaatggtaatggcagagaccgtgcagggttataagcagtgtagcattgtagacggcctctgtcagagttagctcttaggctggacgcggtggctcacgcctgtaatcccagcactttgggaggccaaggtgggtggatcacgaggtcaggagtttgagaccagcctggccaacacgatgaaaccacatctctactaaaaatacaaaaattagccaggcgtggtggcgcgcgcctgtaatcccagctactcaggaggctgaggcaggagaatcgcttgaacccgggaggcggaggttgcaaggttgcagtgagccgagattgcaccgctgcactccagcctgagcagcagaatgagaatcagtctcaaacaaaacaaaacaaaacaaaacaaaacaaaacaaaacaaaacaaaacaaacaaaacccccaagagttagctcttagggaaagatgccaggttactcattttaggacttgcagttctagtggctgacacgaggtggcagtagtgctccggccagagtttctgaaagtgcggtcccgtctggcagcattggcaccggctgggaacttgttaggaaagcaaattatgggccccatcccagacctagagaatcagaaactgcactttaacaagatctccagggcactcatgtgcacattaacgtttgagaagcacttaactggcatatactactttttaaacatctaaacatggacttcaataaagtgcaatcactagctctatgatctctgtaagtgacaaaagggaaaaacgaagcgagtttagtaccgaggtgtgaagaagtagatctagataggggttaagagcgtggccctgcagtccccccggcctggcctggcctgggctggggctctgccacttactctcagggtgaccttgggcaacttaacgaactttcgtgagcctcagctcccctcatttttaaactgaaggtagtgacggtgcctagggcatagggttggggatcattcattcagggaacgcttgtggggtgtgtttatgtgcagtggggactccatgcctgccctcatcaagcaggtctagagggttggccgggaggggactgggttcaacctcttccttcccctcactgcttggccctccccaccctgactccggccacaccagcagtgctgccagatgccggtcacaccgggccctcgtccacagtccccaaattttggtctattggacctcaattcctttgttctggctcctagacgcctcaatttctcactctctagacacagtttgcccttctctcagccttcaatagttgatcagcttcctggagccaggcgagggagggctggatgagataagagccttggcttggaaaggacctgttgttgttagccatgatggaagctgtgtcccaggagaaggaggaagtcgtctggggctggggctgtcttgtgtggttgcagcaaggcaaagagtgtggggcgtctctgtgttccagggccagtgctcttctgggtgatcctggtgttggttgtggtggtcggctccagcgccttcctcctgtgccaccggagggcctgcaggaagcgaattcggcagagtaagtggctgtgtccttggggccttggggaggacaggttgctctctgccagcctggcctgggttctttccctgcctgctcctgctctctgaggccgccacccccagccttcctcctggtgtcgtttcagagctccacctgtgctacccggtccagacctcccagcccaagctagagcttgtgggtgagtgtccagccgtccaaaggggctgcccgagccagaggaacacagggcagctctgggcccggggcgtgggctccagagactgaacttctaccccagcctcgaagctccctgtctgtggctcctgtcgcattctgtacatctgtagggatgcaatgtgggtgaaaactcatgcgtgtggagaatgcaatgaggtgaagactgtactgggtgtgacgactgtgtggcttgcccagagcagcacctggatggatgctggcatgaacgtttaaaagtctatcttgtctgtcactttttcctccagtacccccagggggcattcctgccagccttgccttcctctctacattctaccctccctttctccctctccctccttctctttctctttcccctctctccccctcttctaccacctggcaagtcagcccaggggcaggaggggaaaggagcacatggggcaagagggaccctggttctgccacttacaagctgtgtgaccccgggtgagttactgaattgtcctgtgtctcagtttcctcatccggaaaatgcagatggtagaatctacttcagaggcttggcctgtggattcgtcgaggtcgggctgttaagcgcatcgtggagtacctgcctgcagtcggtggctgctgcctattgacaggctggcctgtgcctggggctttttccttcctggaagcttcaggccttcctgagtcctgggtgcttctgaccccctccctggtccctgcactctgatccctgcccagcctctgggccagctcttccaggcagcccttgggagctggaaccctcctcacctgtccaggcagggtcgtctatacagcgtgtgtcttctagctctcacctggggcagggggctcccagctatcttgtgccaagcaccttctctctcctgggcagccccttcaaggcaggccagggtcttcctcagcactgcatggcatggattgggtgcctgctctgtgctgggctctgatgggggaatcgtctgagccttcgtttctgatttgcaaggtgggctcccatacaggcttcctgtactcccccagtgatgacctttgttctgcaaggaggaggcagggctcagcaaggtggacggctggcccagggccacacagcctggcagtggcacagccagcctcaggcactggtcctaggggttttggtttgtaaagggctcagccctgtcccctcttccttccccctgccagctctgtccaccatcgcaatgcctacccaagagccacgtgctcagcctaaggccaggccctggcccgtcccctgatctccccaggacccttgcagaggcccttgcataggctgactgttgacttgggcacaaaaacacagtccactgaggcatgttttgaatttgacgagtttcacaagcaagcactgtggtccctgtgcaaggggggtttttgtgttttgatagtttcaagcctgtttccatgacctgtcaggctgagtgtctcattgaaaccggcgtttgctttcttgacatttttctagtattagaatttccattgccgtcagtttattttttttcttcaaacctctgtgagagcagttttgttacagaagaaaaaaagaaagaaagaaagaaaacaccttcccctaagaagccaggtctacaaagaactgagccctgagactcaatggtggacatcttatctcaggtcgtttttgaccctctagcttctggtgggaccttggggtctgggttccgaggctcaagatggacagaaagtgaagccaagacaggcaagctcacagggcaccgggtgagaatggaccgagctggccggatgcccctttccctcctgagccgtgggtggtgaaggagggaaggagcactggtttattggcactggtttattggttcgttcattcatctattcacatggtcttcacggagcacttcctccttgcaggctctgtgccgggcccagaagctgttctagctccctccaagcttttagactaattccgactgcccgcagaggccaaaggcagacgggaggggagtgtgcgccccttggcctcccacatcccagacctggggcagagggtgctcttggttcctttgagcagtgagcacatcagggatctgtggtccgtgcaggtgcgatgagaggcccaccaaccagccctcgagtggatcaaccttcccgtgtgtgtcctcggtgacaggcatttgcaaagcacacacgtgatctcatccactcctccggtggcctgtgaggtacttactgttatccccgttgcacagattagcagcctaaggcacaggatggtgaagtaattcgtttaaggccacgtgctgggtgagccgtaggacggggattttatcgtggttgttgagatgtttgtaaaaagatttttcacccttggcaccattgacatttgggaatggatggttctttgctgtggagcgctatcctataggacgttgtacagcccctctagatgccagtaaccttccctacttgggacaaccaaaaatgtctctagacattgccatgtggcccctggggaaaacctcctggttgagaaccactggtctaaaattctttttttttttttttttttttgagacagagtctcgctctgtcacccaggctggagtgcactggtgccatctgggttcactgcaacctccgcctcacgggttcaagtgattctcctgcctcagcctcctgagtagctgggattacaggctcctgccaccatgcctggctaattttggtatttttagtagagacggggtttcaccgtgttggccaggctggtctcaaactcctgacctcatgatccgcctgcctcggcctcccaaagtgctgggtttgcaggcatgagccaccatgcctggccttaaaattcttttaatccttcatttttatgagcacttgagtcaatttctattattccagggagatttaggttgaaagaaattctttttttgttttgaaacagtttcaaacttatagaaatggtataagtatgaagaattcattttgacctgaaccatttgagagtaactgactgactggatgtctctcaccccgaaaacttcagtgtgtgtttcagacagacaagggtgtattttacacgatgtggtaaggatcgtcagaattggaattcacactgatacatgacccacaatgaattctcaggccctgttgaagtttctttatttgtcccaataatgtcctttatagcagaggactccagctcagggccacgtgttacatttgcttgtctggtttctcgagtctccttctgtccggatccgttccccaggcgtttctttcacttactgggaagagcgcaggctggtgatttcatggatgctccttgctttgggtttgtctggtgttttctcccgagtggattcaggtcatgcatcttgggctggaaggtcccaggaatgatgctggcctcttctctctcagggcgtcctgccaggtttcgatgtctccctttcctggtgctgtgtactttgagcgctcgacggaggtgatgtcctgccgggcctctccactgtgacgtctccatttgctcctcggtcattactaagtctttaggggcgttacttgagactatgtcaatagcccattcttcagcagaccttcattttctctatttatttgtttatttttttgagacagggtctggctctgtcacccaggctggagtgcagtagtgtgatctcggcttactgcaacccccgcctcctgggttcaagcaattctcctgcttcagcctcccaagtggctgggattacaggcgtgtgccacacaatgcctggctcattttttgtattttcagtagagacagagtttcaccatgttggccaggctggtctcgaactcctggcctcaagtggtcctcccgcctcggcctcccaaagttcagggatgacaggcgtgagctgccaccgcgcccagcccagaacttaattttcttcacttacatatttatatctgtatggattcatggggccctgttctgttcaatgggttgtaatctcttaccatcattttttattttggtgctcaaatggtcccagatgaggtcagggagagcccctttaagctggctcttgtgtgctttggtgtatcctcatcctgtgctttgagcacgtcccttattctgagatgttcccagcttaacttgtgtgctcctgccccggccctggaatcagctgcctctccaaggagcccggggtttgcatctcggggtacctgttgccaaagcctagctgaacctctgtgccaaattccccccttgggcctgttctgcttcccacagcactggggaatcacaggccagagaggggaggggactaaaagtggagaataacagggatggaagggaccgagagctttacatcgcatgtgagaacgcacgtgctccgtgagcgtgggcttcagagcagcctgtgacaccgtgcacttgtgcaagggggcctgctgctgcccagcatggtcctggacttgtgtccctgggggtaccagacaggcttacaagaagacagtggttattccaaaaggcaaggaaaccaacaaataagactagcagatagaatcaacatttttaggggaagagcagttatgaaatctgacctctgtacttggcaagatttgttctgggtctttatcaaaatcctcatgggttgtaacacggctcttgtcaatgtcagagccttccagattccgcctttttacctctgtgattttacacttgtttgggagagtcggtattgaactctgactttccattcagtgtgacggagtgcagagccatgttacttaccatcctgggcttttcctgaacctgctgtgtgctcaacagcatcctggacaccttctttttaaaatattttaatttttaaaaattctaagtaggccaggtgtagtggctcacacctgtaatcccagcactttgggaggccaaggtgggtggatcacctgaggtcgagagttcaagaccagcctggccaacaagacaaaaccccatctctactaaaaataaaaaaattagccaggcatggtggcacacacctgtaatcccagctactcgggaggctgaggcaggagaatttcttgaacctgggaggtggaggttgcagtgagctgagattgcaccactgcactccaggctgagcaacagagcgagcctccgtctcaaaacaaacaaacaaacaaacaaaaaaacattctaagtggccttcatttttaagttttttgttttttgttttggagacagggtgtcactctggagtgccatggtacaatcatggctcactgcagccttgacctcctgggttcaagtgatccctcagcctccccagtagctgggactacagatacacaccaccacgcccagctaacttttctattttttgtagagaccaggtctccctttgttgtgcaggctggtctctaactcctgagctcaagtgatctgcccacctcggcctcccaaagtgcttggattataggcgagagccactgtgcccagctagtcctcattttttttttgaggcagagtctcgctctgttgcccaggttggagtgcaatggcgcaatctcagctcactgcaacctctgcttcccgggttccagcaattctcctgcctcagcctcccgagtagctgggattataggcgcgcgccaccatgcccagctaatttttgtatttttagtagagatggggtttcaccaggttggccaggctggtctggaactcctggcatcgtgatttgcccacctcagcctcccaaaatactgggattacaggcatgagccaccacgcccagtctcatttttaaaaatagttttagatgtacagaaaattggagaagacagcacaggagttcccacatgccccacacccagtttcctctgtgattagcatcttaagccagcatcgttcatttgtcgaaatatgtgaaccattattgacacaggattacaaacgaaagcccacactgtgttcagggttcccttgcattgcctaaggttccaggatcccatccaggagccacgtcacattcagtcatcatgtcgccttaggctactctggcctgtggccgtttctcagatcttgtttctcaagaccagtttccctgatggccttggcagtttttgagtattgatcaggtgttttgcgggacgcctgtctcctgggatctgtctgatgtcttccccatgattagactggagttatgcattgggggaagaagaccacagaggtgaaacgtcatgctcatcacatcaaatcttggctgggcgcagtggctcatgcctgtaatcccagcactttgggaggccaagcctggcagatcacctgaggtcaggagtttgagaccagcctggccaacatggtgaaaccctgtctctaccgaaaatacaaaaattagccgggtgtcatgacacgcacctgtagtcccagctacttgggaggctgaggcaggaggatcgcttaaaccccagaggcagaggttgcattgagctgagaacgtgccactacactccagcctcggtgacagagcgagactccatctcaaaaaaaaaaaaaaaaaaaaaaaatcaacctgatttaccactgggcaccttcacttttgatatctcttttaatcttctcaacaagccccaaagttgatgtgattcatcccattttccagctgggaggacagaggctcggagaagggaagtaatattgtgctgagtttcaccgccaaggaggcccctgctccagggtggctaagcggcctcattgtttttgacatttggctggttttcaatttgagggttattataaacccgctgctgtgctcggcctttttgttttctttcgggttatttcctgagggtgtgttccctcaagagggatgactgggtaaagagtgtgaggtttttgttgccagatggctctttagaaaaatggaaccagcctgcagggtatgggcagctctgcgatcccgttcacccacttccccttcaaggccgagttgtgtcatttttatttattttgttttgttactttgtcacactttttttttttttattctgttggccacccccagtgacttggtaccaaagaacagttggctgcttgtaaaactcaaaatcactctggagggaccatgatttagtttcactgacgtcattgaaaagaatgtgcctcggccgggtgcggtggctcacgcctgtaatcccagcactttgggaggccgaggcgggtggatcacgaggtcaagagatcgagaccagcctggccaacatggtgaaaccccgtctctactaaaaatacaaaaattagctgagcatggtggtgcgtgcctgtaatcccagctactcgggaggctgaggcaggagaatcgcttgaacccaggaggcggaggttgcagtgagccgagatcgcgctgctgcacttcaccctggcgacagagttagactccatctcaaaaaaaaaaaaaaaaaaaaattacccctggccgggcaaggtggctcatgcctgtaatcccagcacttcgagaggccgaggcgggcagatcacctgaggtcaggagttggagaccaacctggccaacatggtgaaaccttgtttctactaaaaatacaaaaattagccgggcgtggtggcacatgtcggtaatcccagctacttgtgagaattgcttaaacctgtgaggcagaggttgcagtgagccaagatcgtgccactgcactccagcctgggtgacagagtgagactctgtctcaaaaaaagaaaaaattacccctaagagtgtttcccaaactcacctagtgtccacacagcgtgttcaaatggtcagtcttgcgtatactttatcctacttgttgactgagcactggtgagcatatctgtgaggactcagggctggtggctctccagagctgctgaagtcagagatgtgtgcaggaggcggcgtggctgacatacgggcatcttggtggcagatttgtctagccagggatgtgtgcctgacaacagcatattccagatctccgtaggtagcgttctcaggagtggttaaaagctgggcatccctggaggatggtctgctctgggaactgacttgctccaggatgagctagatgcccggatgccctctcacctttctcagatggccagtgagccaaggttaaatgttaaatgtcaatatgtgcttgggcgtgacctggcccctgtttaatatgggagaacaatgggagtggagggtagaggtttgagatgagaagatagaggttgtgcgttgagaatcattgtatcagcacctcctgagcctacaaaaggatgggattgaaggaaatgagatggcccgagagcagttgtcctcctcgaaggctgccacctgggtgctttcaggcacaagaaagagaaaatcgaagtccagctggagtcagaagggctccacagcagactggcttcgggcgtgtcccaggcagggtccaggtggcatctgcaggatccatcatcctgtctccatgacctgccttgaggtcctccatgtgggttttgcctggtattccagagaattcggggctctccacaccctggagacagtaaggtgggcgcagcagccacagacgagcctctgacccagtggaagcctcctgggctctggttgggcctgtgcttctcgtgaaccaatccttgcatgtgcgcgggggtgggggttgggagagtggttcagtgtgttcattggtttagtcattaggaatgagagtggcagccaggtgtggtggctcacgcctgtaatcccagcactttgcaaggccaaggcgggcaggtcaggaggtcaggagtttgagaccggcctggccaacgtggtgaaaccccgtctctactgaaaatacaaaaaaaatagctggggttggtggcacgagcctataatcccagctattcgggaggctgaggcatgagaatcacttgaacccaggaggcggaggttacattgagccgagatcatgccactgcactctagcctgggcgacagagtgagactccatctcaaaaaaaaaaaaaaaaaaaaggaatgagagtggccaggggatagaggtggtcccctgtcctccatctgccactggagaagtgagcctccttgccttgagctggggtgggcactgactctgaaacccatcgagggctctccagactgaggacctgacccctgggctgagttcagcaccacctgtgatccaggaggaccatttgccaatagttggggcgggtggggccgggggctgccagactccttggtgaagttgctgctcttgctttttgcagattccagacccaggaggagctcaacggtaagtacccctcccttgcccccacctcagcttcgtgcccctaaatctgactccttccctaacagatctgaagttttgagagctgctgggggaagggagagggaggggacggactggccattcccctcccacagtgcccagggtgcaggcccgtcctgcaagttcaggctgagtctgacccaccacagggacctctgtgcacagaggcctcgcctggggcctcagccaggccttggctaaggatggagagccccaccctcatagcagcctccagctcctggctcagcctgccgggaatttccagaagggcctgcacacagtggatttggtttgggccacttttgggtaccaggtctggtcaggaggaagactgtgttcattttccccttttctttactcttccatgaatctcatcctccaagctggatgacagagcaggtggctatggtccattcctttttttttttttccccatctgtcagttcttccattactttcttttaattcaagcattcatacattaagaagggtttctatcctttcatttttcaatataatatacacaaccataatgctagttcagtttcaaattatgggggatcacattcgaatatgcttggatgtgacaagtggctgttacaatactgagaaatttcatgaaagaggtattcaacaatttgtaaggtaatcaaatatgtttttgctgcataggccaatgcattaatagtaacttgttttaaaatgcagtcttttggccggatatgatggctcacacttaaaatcccagcattttgggaggctgaggcaggcggatcacctgaggtcaggagttcgagaccagccttgccaacatagtgaaaccccgtctctactaaaactacaaaaagtatccaggtgtagtggcacacgcctgtagtcccagctactcaggaggctgaggcaggagaatcgcttgagcctgggggacagaggttgcagggagccgagattgcaccactgctctcccagcccgggtaacagagtgagactccatctgaaaaaaaaaaaaaaaaaaggcagtcttttagccttcatattattatgaaagagtattcaagagtatgtattaaggttggtgccatttgccattaaaagtaatggcaaacctggtttaacccttctgataggtagttgtggatgttggggttgagaacagaataatctttgtctggagtgacaccacactctagaatttccactttgaaaaatactcagttctttttttttttttttttttaatttttttagtatttattgatcattcttgggtgtttctcagagagggggatttggcagggtcataggacaatagtggagggaaggtcagcagataaacatgtgaacaaaggtctctggttttcctaggcagagggccctgccgccttctgcagtgtttgtgtccctgggtacttgagattagggagtggtgatgactcttagcgagtgaagaatactcagttctaagctgtggttcctggtagaacaaactttatttttctagctcagcagtgatctggaagctgaggaatctcagcgccttttaaaagttattatgtggttttgttttaaaaagctcctgttttgggaaagtagaatttatgggtataacatatgttcattatttgtacataaaataaaaccatttaaaaagtaaaaaataataataataataatggcaaagacgtgattacttttgcaccaatctaaaagatacgccctctgtgccttgagaatcattgcgtcagcacgggcatccctgcctcctctgaattactcacactcactccattttgaaggcatcaggacatttcatgaggccacttctttgcccttacctgtaaaaatcaaaaactaaactgacactttcctcatgacatagctgtttttttgtttttttttgttttttttttgttttttttttagcatttagaaaatatttattaataatatacatgaatttagattatatagtatagaggtcaccgggcttgtcacttgaactaacagtagtctgtttttagaatgcttgagtgtgatcataaaagactactttccaggatgtcggggctggggagctggaggggctgctccaggaggtgggggacctggagctggtacttacagacttgggtgcttatgagtgtgggttatggaccagatgccagggttcaaatcctagctcagatacttattgatggtataaccctgggccaattactcgactcctctgtgcctcagtttcctcatctgtaaaatggggagtgggctgttacccacctcatacagtggttgtgaggattaacatatgtcaaggactttaggacagggccaacggacgtggcgagcaccctgtgagtcgctgactgttacccctactatttagtacaaattaaaagcaacagacttcacccagaaagctgagaagcccggggcagctcatggcagcttttaaagcagaaagggagactcactggggtctgtagagatgaaaaaaaaaaggggcctcccagttcagagactggtggggaggttgggggtaccctgcagcagcacccattcccgtcccacagcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattggtgagtcagcctgttttgggaggtcccctgcagcccaggggcagatgggagatgaatacggggccctgggccctggaagggacctggagaccctggagttgaaaggcccaggaaaggagaggcatagattcttcaccccaactgaagtttctgtaagtagggacagcgagggtacttacctcgtaggccattgtgcggattcatgagccagtgtgcatgagatgcctgctgttactcataaaaaacgaacaccaccccagcccccaacaccgagcacccgaggggacaggaggaagacgtgccagtggtcacaggacctgccacttgtctggcgcattccgggcactgtgtaggtgccatctcttcatctctgatggtctcaccaccttctttggatggtgtctttctccccattttacagttggggagaccgtggctcagagggtgaagtgattttccccattgcatggctactaagtggcacagctggaactcgtcccgcatctgctgggccttgaagcccgtggtttgtccacgttaccacccaccctctgcagaagcaggaggacagatggggcccagatgttcagagcttcccaacggcagctgctgccagcctggacagacattggctttggcctcctgtgggcctccctgcctcctctcttgcttctcatcaccttggtacggcattttccccaaaatgtatacctgaccctattgcactcctgccgagaagcctccagcagcttcccattccctatgggatgaattccagcattcttattccagcactcaaggctgacagcaagttgtagctccccgaccagactcacctaccttctgaccccacagtctgtccctccccctcatggcagtctcccaaatttacagacccctctgtcacttctgagcttctcaatgggagctaccccctcgcctgaaatagccaactccactgccttgaatccagttaattctggatatcctggggaccctgcttatttgccccttcctccaggaagccttctgtgccctctccaccatgctatgctccctaagaacccaggcctcccctacccggtgtcctagcacccagtggtgtgactgcgtgtttatagccttcctccacctccacctggctttgtgctccctgtgggcagggccttggtggaccccacctctgtcgcttctggaagggtaactggcactgggataatactgaagagtcatttgtaattgtcctgtgcatttctatggcagacagtggtggccagaactcttcagggcagtcatcttctctttttattttttcagcctcctgagtagctgggattatgggcgagtgtcatcatgcctggctaattttttgtatttttagtagagatggggtttcactctgttggccaggctggtctggaactcctggcctcaaggtgatctgcctgccttggcctcccaaagtactgggattataggcatgagccaccatgcccagcctgggcagtcttttgtaacaaactgaagcttttgaaatggtagcttttagtaagttttatttgaaaagtatgtattttgggaaataccatcaaaggcttcttcagaattcctaagaagtcctaactggaacttctgagtccacactgagtacagtgcctggaatcccaggggtggggttcagagggtgtttgatggggaggagaaggaagtaccaggctcccaggcagctggctcaggtgtgggctgccctcccctggcatggcctgcaggccttgctggtgagtggatcgggggccacctccgccatggtggaaagggaaggccttggaggttctcttgggcacccaagacacaggcaacccccttgtcctcctaatgccagcccagggtagcgttcccccttcccatccagttcccaagaggggtcacactggggtctgtacatcgtccctcttcccctgggaaccaggcaagggaagaacccctttccccccaacttcctcacctgccctccccacatagccaagatgaattccctggactctggagctctggggagggggcaggaaatccatgcagcccttggaagccacccccacagcctggggagtaggcagcctgtgatgggggcagagccagagcggggcagacccctcatggccggctctgaagtttccagacccctctttcacttccgagctcagtgggagctgcttcctcacccagagcagccaattccaccgctttgaatccagttaattccagatttcctggggactcctgcccatttccctgaggaatgtgaggggaccagcctgtccccagctgtggctccttctccctaatccagcacccccaccctcacttccctcccacctgaccccacccgcctctcatcttctctgcccatccccctctgggccttctctcccctcctggggtctcctctctcaccacccccggcccccatcttttgcccagccctctatagggctcctagggctgggagcccacaagcctgatggaggtgtggggagtgctgaggccctgctctgttttggggtctgtgggggcgcccagcccatagcctgtcccgcactctgggccttctcctcttgctgccgtttggcgcacttctctctttcctgggggtgttcaaaaccagaatagaagaaccagcgtcatgcaatagggttgagggtgtgggggactcgagaacctttttggggttcctgaatccgaggggtataactgcattacccagaaaggcaggggtccctgcacccccaccccaccccagctctcaagttccctcttgagcttccccattctggcctccagagtccagcgcagaacagctgggagccagcccaccctgagccagacaccatcagctgggcggaggccaggcttccccactccccagctcctcgggccactgaacctgagcccccatgtcccctctatcagaaggccacaccagaagcccccacatcagactgtggcgaggaccggccctccgtccaagctcccaccatgtgctcacagcacagccatgcacgctgcaggcaggagaccggctgtgagcagtaagccccgaaattcacggcctgagccaggctgtctcaatcatgggctgccgagacctattgagggggccgggttttctgcaggatgtgacaggctggctgagtttgcccggaccgaggggactcccaggacacgggacttgcagtagtagaaccaggaatgttcccgggcaagctggacaagttggtcaccccgggttttggctgcaggcacacagataggagcagaaagggccaccaggcggagtgggtggtttttttttgggggatttctcctaactacgtggcgaccttgggcaggtcatttaacctctccaggcttcagattcttacctgtaaatgggaatcttgatggggtccgccttgcaggagggctggggacccaggagtgggggtgtggaaactgctcagctctgctgtttctgctcgtgctctggttacccacggctttgcctgtttttgtccacagtttgctttctgtcccaccctgtcctcttcttccctacccatccgcagagatgtgctgagaaaatcctaagtacaagtgggctggttcttaactcctcaaggcccagctcctagctgttctatttcctctgagcccccaggatgcctgtaaggtacatcagagaggctgtgccatcagcctgaagccacccggcaggtgtaccagcactgggcctcggcccttctctgcctctttgctcccatcctggctggtgctctggcctccctcgctcacccatccttttgccttgcagagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaaggctgaggacatgatcatcgaaattgagagtatgttattaatagaacccctgagcagaagtggctttgggagtctcccagcagggcagggattcccactgaacccccaggcactaaggtggccagtctctggtagattggatacttctggggccgggagcccacttcctgctggggcagtccttcttgttgctggaagattttccttatcactcgaggcaaattctttctccatgtaattgccgctccctggtccaaaggctgccctttgaggacactcaaagccactgtcggccagttgcggtgcctcacccctgtaatcccagcacactgggaggccgaggcgagtggatcacctgaggtcaggagttcaagactagcctggccaacatggtaaaaccccgtctctgctaaaaatataaaaattagtcgggtgtggtggcgggcacctgtaatcccagctactcaggaggctgaggcaggagaatcgcttgaacctgggaggtggaggttgcagcagtgagccgagatcgtgccactgcactccagcctgggtgacaagaatgagactccgtctcaaaaaaaaaaaaaaaaaaatgccactgttgtcacaaggctccctttaggtattcgaagaaaggtttctgggcctccccatggccttcctccctctgggctgggccgggcagccccatagctttggagaagggattctccaaggaacagcgtgagtgcccaagccctgggaggcagggggaggaccacaggtatctgggatccctgggaggcagggtgaggaccacaggtatctgggagtgttgggcttcagtgtctgagctgggaggagcccagcctgcctccctgggcacagctttgtggcactttagggccagcctccaccccaggcagccagcctgaggcctcctctgactgtctcctgtgcgaggtggagaacacccacagccacagacagaccctgtccaccccatccccaagactccagcccacacccacacatcagcccagccattgaaccagccatgcactcagtccaggagccagggtggatttccccatcctgcccagcgatgagcggaccccttctattctctggctgtgctcacgtccaggttggcagatggacagagctccctgctactcaaggtagcaattctcaggctgtgacgacacccccacacacctcttcctaaacatttgcgatcagagagggacagcaagtggtaagtatcagatggaagctgttgccttcaaagaaaagccattgtttcccaaggcacttttgtaggtggtaaaaaccattctacagttcacagaatctccacggctcgggtcagtccctaaaacggaacgaggggacctccctagagcgtctctcgctccatcacgacctcaccctccaacagtgaggtgtaaaagacccaaggctgggtcttggtcatctttgtcccatggtcactgggcactgattggttgggctaagtagaaatgaaaacctgtgtggggatgagaggcggctctccagccacagttcctcgggtgccttctctcttccccccacttcctcgatcctctgcagtgggggggcaagtgtggggtgggggttgcttgggccagaatatgtggggacatcagattcacagccacggcccaagagaaaagcttagtcaaggcgagactgttcagcttcaaggggggctccttgggctgaaggagaagctgctgaggacacctcaggcccctgcaccctccaccaggcccctctgccaggcacctcctcctaagccagcaccccatgctggccaaacaccctggaacccttgcccctggctgacccaggggagcaggtgttcaatgttggggccatgggtgtgagccaggcacagggcagagaggcttgcctgccattctctgcagctc

SEQ ID NO: 13915 - DNA, 120609 bp, Human
  misc_feature (1)...(120609): n = A,T,C or G
aatatataagatcagtaaatgctgccaagtcaacagaaacttaaaggttaaacctgccacatctctgcaacatattaaggcaattctccaaaggctaatgtttattaatgaccactttgaacctgaattctatgagaaataagtaggtgtttcaagattgcttttataaatgcatttgttttttgcaccatccattgtaggcaatctgcattgactatttggtcacatctgtttgaaatctagatgctgtgttacatctttgcatctgtgcctttgttgttgtagaggtcacagttattctggtagaactagtgaaaaaactctaagtatttcacttctatttaagtttgaagtttggagggcgagaggggcagatgtgtgggttataaaactgtttcatttcttctgatttgagataatcagaactaattcaagcttagtttacaagtgttataatgctttttgggttatggctgttgtattagtctgttctcatgttgctattataataaagacatacctgagactgggtaatttgtaaaggaaaggggtttaatggactcacagttctacatggctggggaagcctcataatcatggcggaaggcaaaggaaaagcaaaggcaaactcccctttataaaaccatcagatctcatgagacctattcactatcacgagaacagcatgggaaagatccgcccccatgattcagttagctcccattgggtccctcccacaacatggggatttatgggagctacagttcaagatgagatttgggtggggacacagccaaatgatatcagctgtcaaaaactgcatgtgcaaaaatatgaagtttaaataggtagtctaaaaagccttaaaacattataataattaattagagcagtatttcccaaagttcacacattcaagttctacttttgtgagtctgctcgtgtgtgcttattatctgcagatgatttatttttattttcatcgaattgactcagtaaacctgaatacctagtttagtcttcactgaagcaataataacaatgagatcacaactttgtggtgatagttatttatatttcaaatacatgttaaaataaatacatagctattagactaaaacaagttctgaataaactaaatcatcccttataacccctgatctgcataccacatccagagactcactagattcatgattactttggggcctgaactgaagatattcatttttttaatttttgaaattttcataacttcccacactacaccaatgttaggaggacattcttaataggaaaagaatagagccttgcagcatgggtcgtacattttggagatcctccactttggacataaagtagaggatgcagaacaattttaaaactcttcttgttggtgaccacagttcagaagtgttttagcagtgagtgttatcagaaatgcaaaacttaatagatacatacagcaggaggaaagtgctaatcaaccatcaccaactctgcttccgtcttctgagaaatgcagatgtgtaattttctaaatctggggaaggtttcttactgttgccgcatggggagctatgaaagttgtgacatttccatgcctctgttgttgtagctgctcatttgcattttatctttgccatgctgacatccaaatcacagttttgatgtgatgcttttggcagctgttcagagagactgtccagagaaaacagcaggtaactcagaccatttgtgaaaaatgttaggtgtgatacttatgctctcaaagggacaggtaagaatgaacccaaatgccaactcctcttcatggagggaaaaaagaaatcaatagatagctttttttttttttctggaaacttcgggaagtttattgcttttcaaacaatgaagattactgtgttcctatttatgaaacaagataggaatgagaggaatggtggggactgttgggaagtgaaactccacttgatacttcccaattctgtgccttctcaggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccaggtaagaaatttccgcatcctttaaactcagatgggcttaatattgtgaaatatgagagtgacatttattaagcctccttaatgataaagaacatattgaccctttcagattttggggtagaggggtttttgaaatgattttgttttgcaaaaaaatctcccattgggcagaagtttaaagtagaaattgtactatatatatctctcatgaggagctcagtttactgacaattatttctattaccttgaaaaccctaggggtgtgaaatagtattagaaagtgtacacttctttttctagaggagtgaacttaaaaatgtacacacatcacagtgaattgtgactatgttagccaaaaaaaaaaaaaagagagtcacattttagtagtcttcaagtgtcatggaaaaggaacatgctggagcctcaaagatgaattcattcattcattccagtttatggtggtctctactctctgccagccactgtgttagatgctaagtatgcctcagtgaatagaaacagagcctttctagcaggggcggtaaacagtatacacagaaacaagtcagcaatgtgtaattattaattggaatcaataatatgataaaagccaatactatagcaggtggtatctggagtgaagggaaaggaggtcagggagacaacagaagcaggcttgtcatgaaggcctggctgaggaagtgacctttaacagacttcaaggagcatgaaccaggcaggaagaggatttcaggcagagggaacaattaaaagctagaattacttttaaaaatttgagtttttaaaagaacatataaatacttgcctctgcattcatgtataggggtgtgtgtgtgtgtgcgcacacatgtgtgtgtatgcatttctttatgggcgaaagtttgattttctgggtcagggaagactcattagaaacatcattagttagggttcccttcccttactatttttaactgagtatttattaattgaaattaaatcttttgcctcgataatgccttggtcgagcctgaatctctattgcaaaatgcaagatttgtgaaattaaaacaaattttaacattcacaaatgtaagtattataaattaagataaaacatctgacccagacaaacaaatgatcaattttaacaacagaattataaagggaggtttaattaatcaatttgttgacagtactggaagcatagtgaatgatcaataaatatttgtgaaggaagttagtgatgccagattattaattataatatcctgtgactgaaagaaatttgattaatattggatttcagcagttttattaagtcaaaatttttattagtctaaaaatttctcatctatttcctttcaaaagtaataatcatttttaatggtatgaattctgaaattatagatggcacaaacttatatttgttttaaaaaactgaacatcatccagtgttctcttctgttagagatatatgaactctacatagtatatgtatatatatacatatataataatattacagaatgtgcattacattactatatatgtacacgtaagtataatctattatttactcacaaaaatgttacaaatagcaatgtacttttttatgcagaatgacatgtaagagaatttagtagcaattcatctcctttgaccttctccctatatatgacaccagatgtattctcttgaaccaagattatgttcaattactttgttcaaagacttatgctcatcttgaggcaaaacaccatgctcctggtgctgaaaaatctgagataagcgtatttccttgcttttatttaaggataaattattagctctgctataatcaggcaaaaaaaaaatcagtagttatatacactttctgtgccaaaccagacttctttctgtctgtctatagtgaatgggacacaggaaggatattgtatctcctgaataaggattattgattattctcctcaccataaaggcaagccaagtggatacaagtctgtgttgtggtcaggataaagaaatgggctaattgatttcttaatgattaagtcctaaagagacaaaaactgtatcatccatgccctaacaatcctcatctgctttcacagagccttgtggttctaaattgaataattaaataaaaaatggaaacattcttttttagttgactggtttgtacctcagtttcccttgcaaaaagtacagatacctccttaagtctgaaataactagctaaacacaaatagttaactttataaattcagaaatttaaaatttttcaatttttcaaaagtgctcaatattacaattcattttccatttgcaaatcatttcagtattggataaaagccaaaagtaaactttggatatttttatatctcttttatattatacagcctgtcaaaaatttgtaagaaacaattttccagaagttagagcattaaaaggatagacatgtccttcactgatgaaaggatgatgtacagtatacattagtttgtctacttttccaagcagttcctgctagatatcagagattttaagatcatcagtcataatggctcttctgtttattttttggttctcctaatttatttgttggacttttataaagtatcctggctgaatttatggctaaatctgtttctattaatatacacatcaactacattttggacaatgttcacccttccatactggatcagaaagccactgaatgtctcttcagtttttttgtctaagagagtatttctgatgaacacttaacagtgagcaagaaactgaggggagactcctagctctccttcagtcaacaatattagggagatatgaagcacccatagaagccagagaataaaatttgatggcatgatagattctgaatttgaatattcagttcctataattcatgacacagtattctatgattttgctaaggtacctgtgcttagatatatcataagtggtgagtgagcctcttcaattgctaggcaccaccagctcatgccagctttattgtcctgtacccatcaaatatacttttatggtctgaaggtgtaacttaatttgtctaattgtacctccctactttatatggaggagctcataatgaaactctactggcattagggaattctggaaatttgtttctttctaatttcaaggatctgcattttaatttcaggttctagattcagtgctgtccagtagaactttcttcagtgatggaagtattctataatccatgctttacgatatggtagccaatagccaaatatggctattgagcacttgaaatgcagctagtgccactaagaaactggatttttaacttattttcttacaaagaagcttgaatctgatggatttttatttttaattaatttaaacattgaatagtcacatgtctattgcctactctactgaatactgcagttctaatggttttgactgtaactgctattgcctaagatgggaattatgacttagtttgggaaccctttgtagacaaagtgagacctatgttcagttttaggacaacgccacagaaaatgagtctatgcctgtgagattgaggtgggcacaatgtggagtcactcgtcagctgcacccaacctgcagtatatcatagctctttgtagggacctggctttgtgcctactgaccattttagatcatcaaaaccatgcagcatgcagtgggcatgtagcctgtttctataacaggcactcagctttattgaagtattataaatttcatgatgaatcagggtactacaatgtgtcaaatactctgatctctgacttaaatttaatatgttgaacatcagaagaccttggagccataggaaccttacagattgtttgatgctaccccccttactagagaagtaaggacacaggtactggggagttatggaatataccgtggttggtggcagagctaagattagaatccaagactcttgaaatcaggatcagttcttttcgtcttaagtcctactctagtgttgtaagaactacccacaaatgtgaaaggccttgattagaccagcctgggcaccagtctgccttattacagtgtgccccattgattgatagtaagagtggtggtgcttcctggagcttcctagcttcatccatgtggagttgagcagaggtggcccattgcatcgatgcctactaagttctggatccttagagctgaggtctgtgagaaaaggacattgcgaatgggtttgatccacctgatggcagcaactgtggcatatatggagggtcacatatgggttcctgaataattacagtgcttctcaaggctgagaactgaatatcactggcagagagggcagggaagagctcacatagcatttctgcccatgtctggtctgccttgagcaccaagacaaccatgcattcagatgtcagaccttttactgagattaagtttttcttttctgtttatgtagatattgtttagaaaacttcatcagagcaaaaataggagctcatgctgaatgtctggtggaacacaggcaaattaatcagagacatctggcaagttgctggtatgactgcattttgctagggatgcttaaactatcatttgaaactattgttctttcatgaaaaggaaagataaaacaaagacttgccatctgacttcagatttgactccagttttaggaaggacaattcattttatctgtcactcccaccacaggagcagaataggtaaaagaagaaaatgctagtgagtcatacgtttaaataagatgtggaaaaggactgtggaagaatatgtttgtttttatttgcttcctttccaaagcagtactgagcatttgaggatgtgcactacagaacatgttttctttattgaagaggaatgtttccatgggaaaaaatatttatataccactaattatgtgccagtcaccactctgaatgcctcgcaaatactgaatcatttaatcctcacaataaacctataagatagatattattaatcactcccattttatatatgagaaaactgaggcacacagaattatataacctgccaaaggttatgtagagtgtaatataggaaacagaattcaaaatcagaaaacccgctgtccagattctgctctattcattcctatagataattttttcaagataacaatcagaggtggactcttgacctttttattggaaggccttatttaaaaattacatatataatcagaaataattttttttaaatgcaatgattagaaaaatctccctgctattgttatttttccctgaaaatgattcttccagaaagtgctactctattagcagtttgcaggagtgggaacttttgctggggaggaaacaccccttttttcccttccatgaaatactgacttacatgttgccatatgagaggctctatacctagattttacatagataattaaagatttttaagagtgtatatacaggcttttaccagttggacagttacaaaattggtatatattctcataaatactattgtcttaacccgggtctttagaaaagcaaaaattgaagctgtctatataggataaggcatggaagaagaaaaataatccagttttgtggtgatctgataccaagaatctatggtgaaggtaactgggtgatatatctggtgaaagttgtcagtatgcttgaaaacaaaaggttatatttcatagtgatagacaatgtgcatgtagacactcagatcaaaactagctactcagcgatgggatgaaaaaactaagttattggttggctattacatatctgtcattctccataattaactcatgaaggcctcagacttgcctaatgaggcatcagttttttgttttactgaaggtgaaattaaagcttggggtcattcaacttgctccaggttgtaatgtttatatatttttggaaacagttttccagtttgagtctgcttgatgtcaaatgtgtattctctaccacaatgtgcacaacatttatagcctgtgcagcctacagtgtgagtggcttcccttggggttgtataaccaggctgggggctatttttgtgggggtgaggtagggtgggtggtaccgttaagctccaaaaaaaggaagaggtaaaaagcatggaggaatttaggagcctgactggaattaagtggcagctgccttgacatctagatgaagttaaataagctttggcagccggtttgagtcctggcacccagccagtctccctttgtgcctctgtcttttcttttctctaggagccaatgagctctgggctctgctcactctgcttccccacctcagccctctcagcctctcaaatggtcttcttcttagttgatatctgccctttagtccttctcactttatccttaaaacttctagtcttagttgctaggcgttaggaaaaatatttaatgaagccttggaaaacactgaggatttgaaggctaattgttttgagtagtcaaaggtctaagagctcactgttagcactgtgctgactctgaggagcctaccctcgccttgtgggctacattcctaaggggatgcacaatgctatttttacactacacaaaaaccatggcacttttggacccagtacctagccttggctgagcagctttaatgtccaagtttccctttactccttcagattaatacatccaatgcaataaatatttattgaatattgaatcaatgaatccaattctttaatattttcttccacgtttgcttcccttttccttatttcatgttgtcttccctccttcatttttttttcactaattctttaatttggtttcttcctaatcttctctcattctcaatatctgactagtcaatggccaatactaccaattttgagtatcttatttggtacactctgctatgacctatctatagttatctcacttattttcacagttaacctatctggtaagtattattatatgaggcttattaagagtaagtaactagcccatggttatcactagtagtggctaaggcttctataaactcacctagatgttaaaacatctgcctcttaatcacaacaactctgaaatctattctcattttatttcgcttgctattgttttaatttatgtaggatatttatagcagtttctggatctgcttggttccaaattggttattccaggtgagtttgagcagtgctggcttttaacaagggtcctggttgcctgggcaggagccttcacctcttctcccttacattttctaaatgtcctctgaaatgggtggctccttttgaccctttttttttcttttctcaaaaacattctggacactgcccattccttgctagatacccaggaaggactgtagtagaaatagcgtcattgagaagacagtggacagtggtctttctttttcttgcttgctggataagagagaaacatcaccactggcctttgcctcctagtgagcagcattcagtttccacagaacctcccttttctttccataagcctgagcagctcagctcctgtcgcctctttctagagtttaaattgcaatacaattctcaagaaggggaacagatctgaagacaaggatgaaacgtttcgattttcagacactttggaagtccgttctttgtgaaaggtacatttcttgtatctatcctttaactaaaagtgtttcttttcattaaagtctcactttaaaatgatttgtcttctttctgctgactctccctagaggtatttgttagttgtagattttaaagtgcagttatgtgtgacaggtttctttctttctttctttcttttttgagatctatagccaggaatggccagagaatattttatattttatatatattttataataaaatgcgagtcatcagggtcccccaacatctgtttaatccttcttgggttatttgtgatgccaaatcaattttaattggtaaatttcaagcaggtgtttaaatggtctttttggggcttacagattaagctctgggaaatatgagagaaagaaagacctagagcttccagttccctctttccaggtgagatgaggaaagaggaagtacaagtgagaagaacaagatacaacttgaaatttcttgtcaacagaaactcaggaaatgcaagcatattggttttctattgctgtgcaataaattaccacaaacttagtagcttaaacaacacatatttgctatctcagtttgcagtgggccaagagtccaggtgtgacttatttaagtcatcttctctgacgtcagccacaaggctgcagtcaaagggtcaactggccgtgttcatttctagagctttctacaggaagaggtcctcttcccagcttacgtgattgttggccaaattcaattccttgtggttgtagggctgaggtccccattttcttgctagctgtcagctggggctgctctcagctcctagaggctgcctagagttcctgccttgcgtccctctcacaggccctctcatagcatggcagcttacttcttcagactcagctggataagccctttacagttaactaagatgaagtcttatataacctacccaggaatggccttccgtcatcattgctgtgttttgttgatgaggagcaagtcacaggtcctcactcctcattcaccaagccttttgcttctctggtgtgagattcctgtttaggaatattggctatgccgggtaggtaaagccatgcataaaaaatcttgtacatccatgcttatagcagtgttattcatagtagccaaaaagcagaaacaaccccgtgtccgtcaacagatgaatggagaaacaaaatgtagtatatacatgcaatgggatattattcagccttacagaggaactctgacacatactacagcaggaatgaagcttgcagacattagccagacttaaaaagacaaatgcaggattccatttatatgaggtacctcgaatcgtcaaattcatcgagacagaaattagaatggagattgccaggagcaggaggggtgaggagacccagggaatatataataggtacagagttccagtttgggaagattctggagatagatggtggtgatggttgtaaaacaatgagaatatacttattgctactaaactgttcacttataaatggttaaaatgatacattttatgttatgtatattttattaaaattaaaaaaaagttcacacactgaggctaacttgacagcatgtttctaggtgccaggccacgtttcaggttccagacagaatgctgggaggagggagaggagagtagggattttctcacttgtgtattatattgcagaagagaacaagctatgtcaaattcttgtaacaaacattaattgatcattgttaatcaatacttgttaattacctaattgattgattaattgatgagccttcagtagagcatgttcctagtgctgtggaaatatagagggaagggacaacttcaactctcttccatgttgttgtttacagctgtaatccttaatcttaagtttacattgtaatcacctgtaataagaagtactgatgcctgggtctaacccccaggtattctaactaaattgatttgaggcaagagccctgggcatatggattataggtgcgtatatatatatatgtatattaaaagctcccctgctgattctcatatgaagccaccattgaggagcattgtgttataggagcaggtttccctgccgctgactcctcaactacttggtttgaagatttaagagcagtactaattagagacatttaaaggaactgtttgccttttatacctaattaccatgcaacacaatgataattatgcctgtcattgagtgtgtcagataaacttctttgtaagttttgattgttttcaacatttcattgttaaaccctgctctttgatgctcatgggaataaaatcatctacacaaacttaaggaagagagagagagaaatgttttgttgtgagcatgaaataacagccaacagaattaaattacaactgtatttaattatatgggcaataagtaaaagaattgagagaagaaagtcatgcttattttatgacatccatgggatgacctcatttttgtcacgctagtttctcaaattataaacttgtgcatttattaggtttttttttttttggttcatcactcaaaaacaattatctggggatggggaagaaaatagagatgcgtatcctgtttattaaatgtgccttgtttattagggtgactgacgttttccaactccactcttgtccctgtacccataatttttaaattgggagaaagaatttgaatgtcctttgggtttcttaattttgtcaagtttctaatatgtgcaaaatacagttctaggtattaagtaataagaaaaacacagtcatacccttgaagatcagtgtctctttggggaaattataatttatgggattaatattctaagagataggcatgcaaaggaaagcgggcacattctttacttggtagggtagaagagaaaatctctagctgggtttttaaggaggaatagattataggagacaaagaggcctggcactgtgtggtttggtgggtctggggtaccctaagtatggggaacctagacaggaaaggagcattaccattttgaagtggcctccttcaataagtaaaggtaggtcttaaatatacagtttttgtttgtttgttaatttatttttgagatggagttttgctctgtctgttgcctaggctggagtgccgtagtgtgatctcagctcactgcaacctctgccttgtgggctcaagcgattctcctgcctctgcctcctgagtaactgggattacgggcgcccaccaccacaccctgctaatttttgtatttttagtagagatggggttgcaccatgttggccaggctggtctagaactcctgacctcaggtgatctgcccaccttggcctcccaaagtgctgggattacaggtgtgagccatcgcgcctggccagcatagagtttttagatttgttctaactcagcgtttaaggtgttggtaacttgcctacttattgtggtgatagctaaccctcatgcagtatattttatgtaccaggcacagttcttagtgctttattttgttaactaatttaattctcatagaaatctgtgacctgtagactctgtttattattgttttacagctgaggaaacttaggggttcagtgacttgcctaaggttccgcagttagtaagtggcagaagttggaatcaaatcctggcattccagctctactagattttgtgaccttcacaaatatgccttaccatatgttttctaattgcatgtagatataattaagctatgaaatgaaatacaagtaaagttgctgcctcttatgctcacaaaaaatccttgatagatagggatgaaggaaggtcaaggtcactggccccagctttgcactgagccttattcaaagaaggttgcaagatacatgctttgacctggaaaaaacaaaaaacaaaaaacaaaaaacaacagtgagaacacggacctctaatatatgagcccagagaagaaagattgagagcctaatacaactgtaggtgaactttgccaagttaaacttcctgaagcaacttagaggatgaaaatttattgcttcaagaaatgttgactgtgtaagttgggggtataaagtgattacaaaaggattactgctgccacctcaaatgggcatgaattcaacatccagccccattggaggaactttgaactgagcagagggtctcgtcagtgcctccttgttctatggttttcataacttttctcattccactctttcccccagaaagacttctaccatttccagctactatgactaccatttattaagttactggcacgttatttaagttaatgtgcataatattcctatgaagtaggcataattactatgcctattcatagatgagagatctgagattcagaaagcctaagttacttgtccaatataatgaagcaaggaaggtgctggcagcatgtatgctaaaattgaagctaggtagtgccagacctgatatttcaacctaagattttctgattccaaagtcatacatattttttaaaatgaatttttaattgaagtacacaaaaagtaaagtgaacatacccatgtgaccaccaaaatgatcagaaaataaacattactagcaccttggaagcccctcatgccctctttcaatttctacccattatcttcccttttaaagggagctactatttgcactacttttatcagacatagtactttttacctgttgttgaaatttatttaatggaagtacggagtgtgtactctaaagactctggcttcttttgttcctagagtgagattcatttatgttattgtatgtaacagaggttcactaattgtcattgctatatagtatttcctgtatgactatatacaatttaatcattctatgatttataggcatttggttaattctggtatttagcatttatgaataatgctgccatgaacatttttgtacatgtcttgtatatgaattatgatgggtataaacctaggagtgaagttactgggtagtacattatatccaagtttaatatagatggccaaataactttccaaaatgattaaacaaatatatactcccaccaacacatatgtgtattaaatgacttcatgcattcaacagcattcagtcagtctttttcattttggccattctgctggacattttgtggtgtctcagtgtccttttagttttcttttccttgataattaacaatggtgagcccttttcgatgtgtatattttctgttgaggtctgtttatctcccatagctctgtagtacaactgttgtcataaatcaggaatctatgaatgtgtaggtcaatttttgaattttcttttctgtcccagaattctttttttatttttattattaatattatcctttaagttctgggatacacgtgcagaaggtgcaggtttgttacataggtatacacgtgccatgctggttttgctgcacccatcaacccctcatctacattaggtatttctcctaatactatcccttctccagcccccaaccccctgacaggccccagtgtatgatgttcccctccctgagtccatgtgctctcattgttcatctcccacttatgagtgagaacatgtggtgttttgttttctgttcctgtgttagtttgctgagaatgatggtttccagcttcatccatgtccctccaagggacatgaactcatccttttttatggctgcatagtattccgtggtgtatatgtgccacattttctttatccagtttatcactgatgggcatttggattggttccaagtctttgctattgctaacagtgctgcaataaacatacgtgtgtgtgtatctttatagtagaatgatttataatcctgtgggtatataccaagtaatgggtgtgctgggtcaaatggtatttctggttctagatccttgaggaatcgccacactgtcttccacaatggttgaattaatttacactcccaccaacagtgtagaagtgttcctgtttctccacatcctctccagcatctgttgtttcctgactttttaatgatcaccattctacctggcatgagatggcatctcattgtggttttgatttgcatttttctaatgaccagtgatgttgagctttttttcatgtctgttggctgcataaatgtcttcttttcagaagtgtctattcatattcttcacccactttttgatggagttattttttttctcgtagatttgtttcagttatttggggattctggatattagccctttgtcaaatagaaagattgcaaactttttctcccattctgtaggttgcctgttcattctgatgacattttcttttgctgtgcagaagctctttagtttaattagatcccatttgtcaattttggcttttgttaccattgcttttggtgttttagtcatgaagtctttgcccatgcctatgtcctgaatggggtattgcctcttctagggtttttatggttttaggtcttatatttaagtctttaatgcatcttgagttactttttgtataagttttaaggaaggggtccagtttcagttttctgcatatggctagccagttttcccaacaccatttattaagtagggaatcctttcttgattgcttgtttgtgtcaaagatcagattgcttgtttgtcaaagatcagatggttgtagatgtgtggcactatttctgaggcctctgttctgttccattggtctacatatctgttttggtaccagtaccatgctgttttggttactatagccatgtccaatagtttgaagtcaggtagcatgatgcctccagttttgttctttttgcttaggattgtcttggctatcccggctcttttttggtttcatatgaaatttaaagtaggtttttctaattctgtgatggaaatcaatggtagcttgatggggatagcattgaatctataaattactttgggcagtatggccattttcacaatactgattcttcctatccataagcatggaatgtttttccatttgtttgtgttctctcttatttccttgcagagtggtttgtagttctccatgaagaggtccttcacatcccttgtaagttgtattccttggtattttattctctttgtagcaattgtgaatgggagttcactcatgatttggctctctgtctgttttttttctttttattattattcttattatactttaagttttagggtacatgtgcacaacgtgcaggttagttacatatgtatacatgtgccaggctggtgtgctgcacccattaactcgtcatttagcattaggtatatctcctaaagctatccctccccactccctctaccccacaacagtccccagagtgtgatgttccccttcctgtgtccatgtgttctcattgttcaattcccacctatgagtgagaatacgcggtgtttggttttttgttcttgcgatagtttactgagaatgatgatttccagtttcatccatgtccctacaaaggacatgaactcatcattttttatggctgcatagtattccatggtgtatatgtgccacattttctttttttttgtgtgtgttgacatttttattatttctgaagatgtagcaataataaaataagacaaaaagattaaataagacaaaatctttctcttcagaaagaactcattctagggatggggccagaacatacagaaacgacattttaaatgctttatgctacaggataaaaatttagatggcaaaacaataagacagatatgtaattagaaatagaagtatttgaattgtcactttaaggtaaaaacctgtatttttccttggtgctctactgaaacattgtgcaattgctagcttctttttttttttttttttttttttttttattattttttttaatcttttttttttctttttttattattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttcgttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccacgtctttgctattgtgaatagtgccgcaataaacatacatgtgcatgtgtctttatagcagcatgatttatagtcctttgggtatatacccagtaatgggatggctgggtcaaatggtatttctagttctagatccctaaggaatcaccacactgacttccacaggggttgaactagtttacagtcccaccaacagtgtcaaagtgttcctatttctccacatcctctccagcacctgttgtttcctgactttttaatgattgccattctaactgatgtgagatggtatctcattgtggttttgatttgcatttctctgatggccagtgatggtgagcattttttcatgtgttttttggctgcataaatgtcttcttttgagaagtgtctgttcatgtccttcacccactgtttgatggggttgtttgtttttttcttgtaaatttgtttgagttcattgtagattctggaaattagccctttgtcagatgagtaggttgcaaaaattttctcccattttgtaggttgcctgttcactctgatggtagtttcttttgctatgcagaagctctttagtttaatgagatcccatttatcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagttctgtttgtctgttattggtgtataggaatgcttgtgatttttgcacattgatttaggatcctgagatttgatgaagttgcttatcagcttaaggtgattttgggctgagacgatggggtttgcgaaatatacaatcatgtcatctgcaaacagagacaatttgacttcctcttttcctatttgaataccctttattttttttctcttgcctgattgccctggccagaacttccaatactatgttgaataggagtggtgagaggacagccttgacttgtaccagattttaaagggaatgcttccagattttgcccattcagtatgatattagctgtgggtttgtcataaatagctcttattattctgagatacgctcgtagttcattgagagtttttagcacataggggtgttgaattttgttgaagtccttttctgcatctattgagataatcatgtggtttttgtcattggttctgtttatgtgatggattacattttttgatttgcatatgttgaaccagccttgcatcccaaggatgaagccgactttatcctagtggataagctttttgatgtgctgctggattcggtttcccagtattttattgaggatttttgcatcaatgttcattggggatattggcctgaaattttctttttttgttgtgtctctgccaggttttggtatcaggatgatgctggcctcataaaatgagttagggaggagtccctctttttctattgtttggaatagtttcagaaggaatggtatcagctcctctttgtatatctggtagaatttcgctgtgaatctgtctggttttgggctttttttgattggtaggctattaattactgcctcaatttctgaacttgttattggtctgttgaggcatttgacttgttcctggtctaatcttgggagggtttatgtgtccaggtatttatccatttcttctagattttctagtttatttgagtagaggtgtttatagtattctctgatggtagtttgtatttatgtgggatcagtgttgatatcccctttatcgtttgttattgtgtctgttggactcttctctcttttcttctttattagtctggctaggggtctatctattttgttaatcttttccaaaaaccagcttctggattcattgattttttttgaagggtttttcatgtctctttctccttcagttctgttctgatcttagttatttcttgtcttctgctagcttttgagtttgtttgctcttgcttctctagatcttttaattgtgatgttagggtgtcaattttagatctttcccactttctcctgtgggcattgagtggtataaatttccctctaaacactgctttagctgtgtcccagaaattctggtacattgtgtctttgttctcattggtttcaaagaacttatttatttctgccttaattttgttatttacccagtagtcattcaggagcaggttgttcagtttccatatagttgtgcagttttgagtgagtttcttaatcttgagttctaatttcattgcactgtggtctgagagtttgttttttatgatttccattcttttgcatttgctgaggagtgttttatttccaattatgtggtcgattttagaataagtgtggtgtggcgctgagaagaatgtatattctgttgatttggggtggagagttctgtagggatctgttaggtctgcttggtccagagctgaatcaagtcctgaatatccttgttatttttctgtcttgttgatctgtctaatattgacagtggggcgttgaagtctcccgctactattgtgtgggaggctaagtctctttgtaggtttctaataacttgctttattgatctgcgtgctcctttattgggtgcatatgtatttaggataattagctcttcttgttgcattgattcctttaccattatgtaatgctcttctttgtcttttttgatctttgtaggtttaaagtctgttttatcagagactatgattgcaacttttgctttttgttgctttccatttgcttggtaaatattccaccatccctttttttgagcctgtgtttgtgtttgcatgtgagatggatctcctgaacacagcaccccgaggggtcttgactctatccagtttgccaagtctgtgtcttttaagtggggcatttagcccatttacatttaaggttaatattattatgtgtaaatttgatccagtcatgatgctagctggttattttgcccattagttgatgtggtttcttcatagtgttgatggtctttacaatttggtatgtttttgcagtggctggtactggtttctcctttccatatttagtgcttccttcaggagctcttgtaaggcaggcctggtggtgacaaaatctctcagcatttgcttgtttgtaaaggattttatttctcctttgcttataaagcttagtttggctggatatgaaagtctgggttgaaaattcttttctttaagaatgttgaatattggcccccactctctactggcttgtacggtttctacacagagatccactgttagtctgatgggcttctctttgtgagtaacccgacctttctctctggctgcccttaacattttttctccatttcaaccttggtgaatctgatgattatgtttcttggggttgctcttcttgaggactatctttgtggtgttctctatatttcctgaatttgattgttgccctgtcttgctaggttggggaagttctcctggataatatcctgcagagtgttttccaacttggttccattctccccatcactttcaggtataccactcaaatgtaagtttggtcttttcacatattaggctttgttcattccttttcattcttttttctcttactttgtattcactctttatttcattaagttgatcttcaatctctgatatcctttctttcgcttgattgattcaactatcaatacttgtatatgcttctcaaagttctcttgctgtgtttttaagcttcatcaggtcatttatgttcttctctaaactggttattctagttagcaattcctctaaccctttttcaacattcttagtttccttgcattgggttagaacatgctcccttatctcagaggattttgttattaccctccttctgaagcctacttctgtcaattcatcaaactcattttctgtccaggtttgtccccctggctggtgaggagctgtggtcctttggaggggaggcattctggtttttggaattttcagcctttttgtactggtttttcctcatcttcatggatttatctactttggtctttgatgttggtgaccttcagatggggtttctgtgtgggcatccattttgttgatgttgatgctattcctttctgtttgttagttttccttctaataggcccctctgctgcaggtctgctggagtttgctggaagtccactccagatcctgtttgcatgggtatcaccagcagagtctacagaacagcaaagattgctgcctgttcttcttctggaagcttcatcccagaggggtacctgacagatgccagctggagctctcctgtatgaggtgtctgtcgacccctgctgggaggtgtctcccagtcagtacgcatggcagttcagggacccacttgaggaggcagtctgtcccttagcagagctcgagctctgtgctgggagatacgctgctctcttcagagccagcaggcaggatcatttaagtctgctgaagctgcacttactgctgccctttcccccaggtgctctgttccagggagatgggagttttatctattaaccccttcctggggctgctgcctttctctcagagatgctctgcccagagagggggaatctagagaggcagtcaggccgcagcatctttgcagagctgtggtgggctccacctagtttgaacttccctgcagctttgttttcactatgaggggaaaaccgcctactgaagccttaataatggcagacaccccttcccccactaagctcgagtgttccaggttgacttcagactgctgtactggcagtgagaatttcaagctagtggatcttagcttgctggtctctgtgggggtgggatccgctgagctagactgcttggctccctggcttcagcccccttttcaggggagtgaacgattctgtctttctggcattccaggcaccacgggggtatgaaaaaaaaaaattcctgcagctagctcagtgtctgtccaaatggccgcccagttttgtgcttgaaacccagggccctggtgtcataggcacccaagggaatctcctggtctgcaggttgtgaagaccatgggaaaagcgtactatctgggcctgagtacaccattcctcatggtgcagtccctcatggcttcccttggctaggggagggagttcctcgaccccttgtccttctgggtgaggcgatgcctcaccctgctcagcttgccctccgtgggctgcacccactctctaaccagtcccagtgagatgagctgggtacctcagctggaaatgtagagatcactcaccttctgcattgatctcgctggaagctgcagactggagctgttcctatttggccatcttgccagccactccccaaaagtctttttatccattgttgtgccagtagtatatattctcttaattattttcattcatcataatttttgatatccattactttaagtgttgtaatttttattcttcaatgttgtgaagctagtcttgggcctttttatgactataagaatttaatatcagcttctcaattttcataaatttttaaatttagagcattgattgggatttcattgaacctgatcaacctgaatataattaacataattaaaaatatagtcttctaatctatgaccatggtatattcctccatttagttaggttttctctcattcttttaataatattttgtattcttctgtgtagacatcttacttatctttgttagatataatccttcatagttgatactgttttgaattatttaaaattttttaatgttaattgtttaatactagaatatagaaatacaattaaatttgtatattgactttatatcaagtgagattgttgaaatcacctgttgatattggtggtttacctgtactttcttttgaatttttcacatacataatcatatcttttggaaagaatacagtttacttttttcttttcctatgtttacatattttatttttgttctttttgtttcttttctttctccctttattaaatttgctcagacttctgattcaggattaaagtgtcccatttctgatgtctgtaggaaagctttcaatgtttcacgatataatatgatgtgtttttgtttttgtttgttttatagatgtattttatcagattaaggagattttcctctatacttaatttgccaaaagtatttcttaattcaaaaattattacaggtgtttaattttaccaaatactctttctgcatcccattatatttgctacatttttctcctttattcttttcatgttgataattatgttaatgttcaatctaatctagaatatttattttttatactttgttttgttttttacttttgtccctctattcattagggatattatattttatttttcttttttgtagtataactccttatcaggctattctggcactataaaatgaatcgggaaaaattcgtctttcctgttttctggaaaatattacataaatttaatattaattttcctttaaatatctataaggcttaataataaggtcatctgggtttagacttttttgggtgggatagtttttatatttgatttagtttctttattgctaatcagattttctatttcctcttggctcaggtttggtagtttatttttctagaaatttttttcatttcatcacaattttccatacttgatgtttttgaaactattttaaatgatgtcattttaaaaattttattttgaattttttgatgctggactacatagtatgaacaactattttggcaagaatgcagtttaatttttaactataaagttgttcatactactcatttctttttttataactgtaatatccatagtgatgtcttcttcttatttctagtaatagtaattatacctcctccctctcttactcaagtcctgtcttgttgtgaattatcattttattatttttttcaaagaaattattttgggctgtgttgattctcttcattatatttcttttttcctgttttattattttctgctgtcattgtgttattttcttccttccttttttgagttcaacttactttttctagtcttttgagatggacgcttaggacgctcatttataatatttattttattatataatttgacatcataaattttcttctatgcatcattttaactgcatcttacaagttttatgtcatattttattatttatttcaaaatatgatttggcttttcttataacttaatttttgaccaatgggttgtttagaaatgtattgttcaattctcaaacatttgaggattttatgatttttctgttattaatttctagctttattctattaatactatatttaaagaatatactctgtattacttcagtcttatgaaatgtgttgaaatgatttgtggtttgccatgtggtcagtttttatgattgtttaatgtgcactagaaatgaatgtgtatctgcatgttctcactcataggtgggacttgaacattgagaacacatggacacaggaaggggaacatcacactccggggactgctgtggggtggggggaggggggagggatagctaggagatatacctaatgctaaatgatgagttaattagggtgcagcacaccaacatggcacatgtatacatatgtaacaaacctgcacattgtgcacatgtaccctaaaacttaaagtacaataataataataaaaaaagtaatgaatgtgtattctgaatttattgaagagatatttaaaatatcagtgagttcaagagattcaataaagttcaataatcaaatattcagatctatttactaatttttgttggcttattctattaattagagagatgtgttaaaatctcccagaatcaatgtgggacacttgtctattttttcttttaattttgccaattttgctccatatattttgatactgtcatattaagtggatacatatttggaatatttagatattcttgatgatataaatatgaaatattcctctgtatttctagaaatatgttttttattaaggtctactttcctgtatcagagaaaaatttatttttaattgatgtttacatagtatatctttttccacttttttattttcagcctttccatacattatctttaaggcatgtatcttattagcaatatacacttggtatttcctcttaaattttatttcatttgtctgacaagcttgtcttttaattggggtatttggtatatttacctccaatgtaaataaaaaatatttgggcttaaatctaatatctaatattattcaatttctctttttgtttgccatgttttgaggattaatgaagtatatattttaattctattttatccttgttagctttcattcattcatttatttatttatttaattttatttttttgagatggagtttcactcttgttgcccaggctggagtgcaatggtgcgatctcagctcactgcaacctccgactcccgggttcaagcaattctcctgcctcagcctcccgagtagctgggattacaggtggctgctaccatgcctggctaatttttgtgtttttagtagagatggggttggccaagctggtctcaaactcctgacctcaggtgatccatttgccttcagcctcctaaagtgctgggattacaagcatgagctactgcgcccggcctatccttgttagctttctagttaaacattctttgactgatcttgtaggcctcactataaattatggcatgcatccttaacttactaaacttttaacatagattagtacttttatcaattgctggaccttaaattgtgttaactccatttattgttccctcccctgcagttttggctgttttctacatttatttcttacatattttacaccgcacaaggtattattattgctttttaataaatacaagctttctttaatcacccatagatttatattttccattgctctttcttccttctaacatctgccagtttccatctgagatcatatttcttctgtctggagctcttcacggttacaagtctgttgccaatggaaaaacattttgaaaatatcttctttttgccttcatttttgaaggtgattttcactgggtaaagatattgaaataggctctttgaagcgcttttaagatatgctactgtgttctggcttctgttatttctgttgaagagtaagttagtcatttgaaagtaatgccttttttttctagctgctttttagagttttctcattgtatttggtttttcagcaatttgactatggtaggcctagatatggttttctttgtatttattttatgcagagtttataatgcatcttgtctgtgcttgacattttttaattgatttaagctaactcttttttcttttctttttttttttgtttgtttttgggacagagtctcactctgctgccaggctggagtgcaagtggcacaatctcggctcactgcaacctctgcctcccgggttcaagcaattctcctgcctcagcctccaaagtagctgggactacaggcgcctgccaccacgaccagctattttttgtatttttagtagagatggagtttcaccatattggccaggatggtctctatctcttgactttgtaatctgcccacctcagcctcccagagtactgagattacaggcgtgaggcactgcactctgcctgatttaagctaactcttaaatatgattccttcatatattgtttcagctcaattatttctctttcttcagggtcccagattatacgtatgttcaacttctctattatgcctcatatatctcttatgttttgatttttagttttttgttttgctttgttttgcatcctagattctctccaatcttctataaatatattctagctgcctataattagtttctaattattatcagctgcattttatcggattgcaaactgatcttttgcgtgtcaagcttcagatattgtgtttttcagttttagaatttccatttgatttctttaaatattcacgttttctactgacatctccatttgtcctgaaagcatattgcttacagttaaagttgtacctgatagctgcaatatattgatctactatggttctgtttctattgtctttttttctctctgtccttagtcatttgggcttttctcttagtatgcctggtaacttctgatgtcatgacaaatatttcctatttaaaaaactgtggagaaaatttgagtgtctagattttatgaacttccaatggagaatgcttacttttacttctggcaggcagttaagctagtggctgatagttgtaaccaaaatagggttttgttggtttggtagctggttttcagtgtttttgagagctagcctattttgctttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgccttgtaggaaatgctgaggagactgtcagcctcatgttctcttgtagatcatgactctaagttgttgctatgttgatagatcttcaatacttccaatagattatctatctatctaatcagcttttatagttgttttgtgggagcaggaagagttatgctggtaatagctggtctgtcatagttgtagaaagagttgcaaagtttatattcttttttttgagatggagtcttgctctgccactcaggctggagtgcagtggcgcgagctcggctcactacaacttccgccttctgggttcacgccattctcctgcctcagcctccacagctgggactacaggcacccaccaccatgcccggctaatttttttgtattagtagagacggggtttcactgtgttagccaggatggtctcgatctcctgacctcgtgatctgcccgcctcggcctcccaaagtgctgggattacaggcgtgagccaccgcgcctggccgaaacttaccagatttttaaaataagttgttttaaatttataatctacttttgagaaaaattcatagagataatttcactaattagagactattacaatatgtctatacaccaagttataaaagtttggaaactttttgaggccatgggtcatgtttaattaatttttatgtcctaagtaagtgcttaatgacattttaaaagcagaatagatatgaatataagtactctaggaattcacaggagaaagaaaggatggtgtaaactgcagcatccatttaaaatcatccaatttaaaatcatgaggggtttcttggtgaatgtataaggtttggaaaggttgaggggtaaaaagtaagttaagtcacaaaagaaaacatgttccatctcttaaggcaaagatataggggatgataaggataccagcttatctataataaaaaatttgttttagggagtaagtactagatggatagattggagccatgttgtagaaaatagtaaatactgggttgtaggatattgattttttttttctatggacaaaagagtctttttgagtacttccatggaatgttggatgttgaatgaatgaagttaaaccaaaaagaaatgaagaaccaaaagaaagaagttaaaccaaaaaagaaagaaataaagaggacattgaagctccagaaatactggtttaaagagatttgtttacagcaagacttctttgaagtgtgcattttaaatttccaaagttgcttaaacttagcacacttttgcttataaagaaacagtgttcttggaacatactttggaaaattagtatatgtgggcattgaggaaacactgactggaatattatactaacatataaagtctgcgaaagctggagcttcttgatattgttcacagttctaccagttgtactaagagaattacctagcaaagatatgttctcaatatatattaagtgagttggctttagtggataaaaatgaattggatgaacatgaaatccatttttaaatttttttttagcaagaataatctgatgatataatacagttggattttagggaaaatcggctagaagcttaagtccaagaaaataaaattttaaagttgtccagacctaagatttgttcttggactgtggtgccatccttgaaaatgggaaataaaatggataacagtgatactttttaaaacaaattgatacgatttagtaatagattagatggaacttctcaaggcactcaaataatttgaatagctttgagtcactgtagggaagaagaaatttctttgtacaagacttcattctgttttcttcatgtagcctaaagatatgatggatagagtcatgaaagaattatttaatttcatgaagtcttaccttttgtttgaaaactttttgtgtagaaaaagatcaccagcttccaaacagtaattgggagagagtttgaatgaaagatacagaaaaaagtacttaaaaaatcatgctgagttttatgatcgagagtaaatatattgtgcagatctgacttagcccatagagcatcttttcttgcagcacaataattttatgatatctacatatgaataattttcattaaaacattttaaatttatgttaatgaagattgggtagctatcttgagctacatcttttccaaaataaagcagagcattataggattatcagcaagtagaacttggatttgaggaaagaatggactgtgagattggaaatgtcagttctgtctagtccacccatatctagagtaaaacctagtcaaacctagactatcactgtcaccatctatgtctgatcaaacttaccaagccccaaaggctttctcccttagaagctttctccctcagaagagacaatgggatggaatggaagcagcgcagacttcagattcacctacttagtttcaaatcccatgaaaaattagttgcttcttacctcttagtctacttcttcctaaaataggaatagtaattatctcataatatgataatgaggattaaataaaatataaaataactacaactgtaggcactatgcatacatgaatacatcagtgagtgaagactgtattgtagtcccttaaatacaactcctttgtatccatgagatttgctttccatctaaaaaatcatgtgtccattagtagtgcatctatggatcttgagaaatgctacatttgtggtgatggcaattaggaatgataatattggtgtcatgatgactatcagaataatattcaaaaacattttcttaggtttttcatgtaagctatggtagttataagggtgaaatgtttggtggggttagaaaaaggttgttcttgctagaaagttataagtttgtagataatattattgagaatcagaataaagtgaatctaaatagtaaaacatgattttcattaattgtaactaacatctcttttccattataccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcaggtgggtttcacagatttttccagatatataataaatattttgcctgttatgattttctgcaaacatttataaaaacataaaactggttgctctatttgtagaaaacataacatattgaatcatgaaatagcaaaattgttgatctaatcatgatgatggtaatgtttaattgatggtaatatttaatatgtgctgaataatttctatatatcaggcatcctattgagcagttgatagagagatcacattttatcttctcaccaaccctgtaaggcaagttctattttctccatgttactaacatggactatgtctcagagagggtaacgccacatagatcataagcagtggaggtaaaatgcacacttaggcaatttgacttaagaatctgcacttctaatcacaataccatgtgctcaaaaagtgtttttattcaaatactgctgctgaagttaacattttaagaaatgcaccaggagaaaagaaaacaattattattgtggttctggaagatgttttggttttataccaatgatttaaaaagataatttaggtacttttgaccaacacacaaatcaaatgacatatcttacaattaaaaccggtgtttttagaattatttaaatggtttccttcatctgtggtaatttgaacatgcttacaagttgggaagattataatggttagataggcaaatgatttatttttgtaatgtatagatcttataatgactactcaatttttttctcttttgtatatagaagcaaaaaattatctaaacagggattaaagttatagaacgttttgtcacattctggcacaactttttgagttttagggaaaaaagttaaaactggcttacccagaaggagtgatgaatggaggaatgctttctatttgttgatgttgttgacatgttgttgacaacaatgatggttgtcattccttcattggcattgtagttcctgataatctaagtattgcttttattcttgttcctttggggccttaagtgtgaggcagaagttgtctatctaaacaaattaataaacatgtattattctatttatagtatataaaagattgttttatatacgttgattatttgaacatgccaattttatgattattatttgccgtatatatctttgtaggcacctttaaaattatacagtcattcccaaggaatcattctacttaattaatgagttatagtcttaatttagccagccttcaagtttttagggacaacttttccctcttgcaacttttctcttagccattttaacttctgctttagcaacactagagtattgcagcaagagaagataggtcattaagtcaacaaatatttatgaaacctcctaggagaggatgagaaactgatgtaagcctatctcgttccttcccaagtagttctgatgaaaggctcagggagagaagaggttgaacagaagtcagtatcaaaacagctattgagatcagagttatggcacacatggaaatgaaaattggatggtttcttatttgaattaattgtagtgtcacccaaggactgaattgcctggtttaattatctggttgagcaaattaatttgataattaaaaatattccctttatgaaacatagcatgaatagcaaatagtaaaagcatatttagctttaacttttgatattccatataattcttcagcattgctcaggcacaatgagccataaccaatttcaagataaaaacttgaaatgcattaagattcatgatatcaactggacactaccactaagtggctttgatagaatagaatttagctaatgagaaattttaaattgcatgtctaacctctaggatttggagccagaactgagtgttttttttccttgctagtataaattctatcaggctaaggatatcttctcttttgtcctctctatggctctggcacttggaacagttcccagcacaacataggtactcggatcagttttgctgaatgaagggatggacagagatgatacagagctacttagcagtgaattaggaaaaggaaagactaattctttaaggaaaggagatattaccccatcacttttttttcctctaagaacttagatcttttttgcttatgcttttagttggttaaggttttgtttgtatttgttcaaagcaaaagaagagtaaagctgccaaggcaaaaaaagaaaaatagtgaaggggatgcaaacttctgcctctcccttcctccagtctttgcccaggtaataagtgccaaacactcttcttagtgattttcatttgtaactaatatgtattacatttaaataaattagaggttagataacaattgaggcaccatgaagtaacttgcccaaggtcacataggcaaaaatgagttgaatcaggacacagccaggcagtctgattccagggctgatctacttactggttatgacgggttgtcattccatcattgtgaacaatttctctgtgtttttatgacatacagtgattgttgagctcctcataaaagagaaatagtttcatgtattacatttctcataggttataatgaattttaaacaaaacacttgccatccactgcttcaggaaaataacattgtaaaaataataatattaataatagctaacacacagcatttactatgcactagccattgttctaaattccttacctagattaacttatttcattcttgccactgtaaaataataataataattattattatcctcatcgttgatgaggaacttcagacagatagcgtaagtttctcaaggcaacccagctaatagtaagtggcagaggtgatttcagtctacacttttaactggtgtattataatgagaatcataaaatatcttacctgtatactttgtgtgctttatgattgttttattttactaatttatagtatctacacggatttcgattatttgtgtgtgtgttttttaaaattctgcttgatagagggtcgactagaggtgttccaaggggagaaattgctgtcctccatccctatgtggaccacatttggggagcttgccattttatacaattgtacaaggactgcctctgtgaaaggtaataaaagaggaaatgctccatctttgaattgttgtggcatgttaaagataatctagtccagtcacatttgcaccctgatccacagtctgtttcccattttaccctatatgttcttataatagaaatgctatgcctattaagggatttatactgaagcacttacctatataatttaagctaaaaagaacttttctggatacctgtgtataaaatgtaaaatggcttttaactattcacaacggtaaagacatggaatcaatccaaatgaccatcagtgatagactgggtaaagaaaatgtggtatgtatacattatggaatgctacacagccataaaaaggaacaagattatgtcctttgcagggacatagatggagctggaagccattatcctcagcaaactaacacaggaacagaaaagcaaacactgcatgttcttacttataagtgggcgttggacaatgagaacacatggacacagggaggggaacaacacacactggagcccaatggggaggggtgggggagggagagcatcaggataaatagctgatgtatgcggggctaaatacctaggtgttaagttgatagttgcagcaaagcaccacagcacacgtttatctatgaaacaaacctgcatgtcttgcatgtgtatcctggaaattaaaattaaattaaattaaaaataaaaataaaaataaaaaggtttgttctgccaaaaacaatggctttaagctgactgattccatatttgctttaattgccactttactttttactacatagacacatgcctttggctcatctagaatgtttgctttctagctagtctcaacgaggttctgaccatattataagccagagaaattaattaaaccaatgaaaatgtatctatatcaaaaggaatatgaattagagtaattagagtattcatgaatgacttttgggattactttacttgcttttctttagatttgttttattgactttatggcaatcttgggtttccttctgaattacatagatatgatgtttttcagtgtttgggactagtttatatgtgttagccttgctgaggtatttgataaaaatgcagattttgggtctctactcccaacctgaatcagagtctctggcaatggagcccagggatcttgtatttctaacaagaatatcaagatgattccaatgtaaagtttggtaatccagagctttgggttttgatcaattttagaggctttgttactcgtttttaaaaaattgtacaaccacaatttcatctagattttttagagccaccacttctggcccactttctttttaaattttatacttgcccttaagtctttactgtaaaaaaaaattatctcaaaaactttctttcatagtctctttcaaataatttgtaggcattttacacaaaagtaactgtagagattcttaaataatatgtagcttctttagcaacagtgtcagaacaacataaaaagacacataaaaacacacacatacacacagatagctttaactttcaattatctgtttgtgacttcactctccagattagctacaaattgactgcctttctcttgtattacagcagaaatctagagcacatcctgatgatctagtgcataattgggaattgcaaactaatttgaatatcatcctaactgtaacataattagaaaggaaattttttgctagtcatttccaaataatagtgtatttcaaagccaaaatgatttataaaattgctcactatttatttttctgtctccttcatttgtatgtttaaataatacattttccaagaagtaccattttataagaacatataacaaatccatcgatttatattttggaatgttttcacaatgttgtactaagtgttttattgttttcttgaattttctaaagctattaccaatgttaaaacatgggcactagatcgagaggtattccagaatataatgaggaggacagcccaagctagagatgaacaatacagaaacttcctcagaaggtaagaataatacattgggagacagtgaagacagtggagtcgccatattgtgaatatattggttttatcagaataattattcaactatagctacttccatttaagcattttccacatgactaaaccaaaggaacattgcttgcagtaaatgccagtacataccaaaaactgtatttaatttctattatccttgtatactcatttatttctcctgctagtttttgcccttgtattgatagagtgatagtgcacagcatagaaaaatgtgcaaaaaacctaaattattaattgggttgctcagttggctttgaaaggcatttgaaatttgaaagtggttagccaaaagacaagctttctaaaagtactttgcttagaatggtattaaaattaattaaatttactatgcttatttgctttacctgagactttcttatttgcatagtcacgccatcttccaaattactattatttgtagcaaattgacttgctaaaaatgttactatacttgtcatgatgacagggacttggaacacactcattttgtgaactattctgtacctcaacaccttggatgaatcaatttataaggaaataaatgtctgtgtaagtgaaaaaaactagtctcacattaaaactttatttggaagtataagttatttatttaaacaatttctgtatctttaatgggagttttgcaagtttctgaagctgcaatacattctataatgaaatgttatctatgatatgtaataataatattaataataatatatcacattatttccaaaaataaattataagttcttatggtaattttttctagcatgagaatccttcaaagctaatgattttagggccatatagtgcttagcttatagtgtaggctcaataaacattgaatgagatttctcatctagaatcttactgatttgtcctcccagagacaataatgtctcctggcagagagctgcaataatgacaagcaggttctctatctatatgccagccaatgcattagctatcatattgtggggcccacttgaatctaggtgatctcaaaatccaccaactgagcaacataggttagcatttaaagctgataagccacacttacgtaagggccaaaaagaggtacctaaaaaaaccagtgtgcctgggttgtatttgaatgtctgagataaaacgtgaactaggcatagcagttaattaccttggagtctagtatgttcttagtggaaaaagctcggataatctactagtgaatattcattctttccttccctccttttgttgtttccttcattcaactaatacttattagcaggcactaaatattgttgatttagtggttaacaagataaacctgattcttgccttcagagaggggagacagagaaaatattttttcttatatctcttttgccaccaacctccaaaggtgctaggtttataacagttaattttcactaatgttatagatgcctgtttggaccagaagtaaaactttcatgatagcctgtgttaataacaagttctgatgactcttttaccatttcatctatagtgagatatattaggggaatacatttctctttgtttcataatatacagtattttttttatttacattttttattatgaagtatgtgatattctatgtgatatatagtacatatgtaagttataagacatcataacaaaatgaacacccgtgaagctactgcccaacctagggaagagaaagcagttgttgaagttcttatgtatttccccatgttctttccagcctcttcctcctcttctccttgagagtatctgcgttctgaagtttagtgatcattcccttggtgttgtttataattttgcctgtagcttgatttagttatttttgaagttcatccatgcctctggctatcattaattttaaaagacagtacagtatgactaataatcagagatcatttcaatgtcaattcccatgttccctcccaaccccggattcagtccttacttaattataaggatttagacaaaaatctgattctccactggaagcagagctcctcgcacaaactaataaaacagatattgagaagtagagaggaacaaacttccaaatgcgattcactgtgaaaaccaacaacaaatgtaaatttatttttaccaaatagacaaaatgtgatttttttccccctgtctggtatcttactattttcatttgtttgcctgtggcacatgtctgtgattatatatctataatttccagtgtatatgaaattcagttattgatgtgttttcagttatttggacatttactttggaagaatcaaagtgcattatattttttaaaatgtatgtaaagattttagaatctgcatatgtgtatatttatagtttaattcaggaaggtaattgaaggtttctttttaattttgaagtgtatccttgctgaagaatttacctgaagataaattaaccaagatcattgactgcttggaagtggtaagaaattttgaagtaaaaaataaatttcattagaagatattagaatgtacttatattattaacaccataaataaataaaaagatgtcagagcaccagtctacagagaccaagagcctttttctatggtgaaaaatcttaagccaactcatgctgtgttaaggggtggagaaaggtttaaactcttcagatgtataaaaggaaattggatttgcatgtgtaaagtgaaatttgatttacatattttaatctttttagtatatcttataaaacaaacctgccttactcaagaagcatttgattttctacaattaacatcacaatcccctacagagttttcatagtataaaggagtcactgatgtataattaagaaatggagcagagaaagggtatgttggtccttttggtggcaagcctctgagtcaggctgtgaaacactttctacttgaacactctaggccacaaaaaacacattttaaaaactgtatttaagaagcactttatctattttaacatctagggggaaacggcatattggaatgtgttcaaaaactcattttaggcatcacccagatggttggttctagtccaagacgagtcaagtcttttcatgaataatgcttttacgacatgtaccttggattctaacgatatgcattttgtgaaaacgtcttcagatttcagagaattaaaattcaaagcaaatacgttctttaactttttggggggtcaatttcattgaaacccagatggctttatggaatttaaaggaggtaaggaatagtaaaggagtcacatatagaatttaagcttttataaagctgttctcagtgggaggaaaaaaaacccccaaaaccctgcaaggctgattgttgacagattcatgcctctgtcaatcacaatatacaatgtaactaatatctgtcaagcagggagtagggaccattttatccttaagtgtaagtgacaccagcagtgtttccatttacaattcatgcaacccatccagcagtttatcaaggacagaccatgatgacacagtgcctggccgtgtggccccagggggttcagatatgaagtcattttcaagaagattgcttagcctgcatctctggagagtctcccattgtaacataacccagtcacagatgttacaaattaataattcatcctaatttctaagggtgtttttttttttacttaaagctggagaggccctagttttttttgttaaccaaggaaatctgtttttaatataatactaatagagtagattcaccagaggggatttctatgttgacagcaaatatgaaaatttagtatcattaaaaataaatggtaaattagacgtatttatagcagccacaggcaattgctacagaatatatagatgggggctcaaatccagtaataattaacacacaattcaaatttgaaaaactcatcttttcaaacaccctggaaaggatttgctgtatctcagcatttgcagacagcagcacagtttataaaggactctttattcatacctggcaaacaaatgtgtctctgtgatgtgtgaaaattctcaaatgtgaaagtgattaacgagagtaatgggatctatttagcgctaagaaatgcatgtgatttaccagcatagcttggactaatgacccatcaacttggtcctgacaacagccaatcactactgcatcatttttgacagtgtccagagttctaggaccagctgtcccacaaactgtccccataatctttgaaaaaaacaggctaaatctgtcatgcagtttaggagttgatttgggagttttgcatgtagcagggggtaaggaagggagaatcagaatttcccatcaccaagtaattgatctgatgtatttgttgaaacttagacggttgaactcctagaacaaatggccctgattgtgcaatgttccaatggcatttcttgctttagcttaaatcactcagaacatttatagaggcagccattgcctttaagcctcttcttgtgttctgataagaaaacgagggtgggaataacaccaacatactagagttcattaagagttaactaatgagaactgtaaagcatgatatagattcagaacggagtgtacagattaacgacaatgaaaataataatatgacttacgtacctggcagttatgcagtatggaaggtaagagtggaagtagtttctgcccccacacatggtgatgaatccactaagcatgagatttgactgtgacatcctcctgaactacaaacattgtgattcatcataaagtcacctgttagtcacagtgctttggtatttgatccagtggccttttgcactgtgactctaacctgccatctttcacaaagctgaggtgtttgaggctgggatgagggtgtagtgtggagcacctttgcccttagtcagattgcctgtggtgccgatgagaaggcatattcccaggcaccaccccacacttactgaatcggaaactcaagttggggcccccagatccacacctaacactctaatggtgggatttttatgcttattaaagtctaagaagcactggtttagttatgaatgtttagagtttgcaaccgtctgcctctttctttgggaattttccattttaatcacttttttcaagtctagtctttcttgtagtccttaccaacactcgcataaaccaggatttttttttttcctgtcatcctaacggttaaatccagagccataagaaagttgaaataattgtagatttcgctacagtttatgaaccattgagctaaaggtggggcagccaggtgttgtacaaagttcactagtccaaagtctggagattagggcttgtggttctgcctctgtcactctaccagctgtcaatgaattgtggtaggctttagcatatcatctcttcatctacaaaataatggagtggtgggccatatctctatgagctctttcaacatttaaatcatagaattctatatgattggctcacccaaatagaaataacttctgttgtttttcattttgtagtatctggttctttgaaaataaccaatcaggtgctacatgcccgaatggctgactgggcccacctgatccaggtgtgcttgccttaaaacttctgaggtgttctaaactcttgtacttggaaaacaaagattaactagtaacaacataaataactaactgtaaacaattttttaaccgacacacttggtacatagtcacataatgcacagaggtgtgtgtgtgtgtgtgtgtgtgtgtgtgtgtgtgtgtgtactatacatctggttgtatatcatcagtacttccaatacttctttttaatgaggatttcatttgctttttgcaagatacttataaagaagatttgtagctgcaaattaaaggctctaaggaagtcattgccttccttcattttctttgtcctctgtcactttggaatttccttctggttttatatattgtatttacaggtactcaggctctagcattttgctagattatcacagaatgaacattttgtttacagtaaaaatgggctacaactcattaccaggttatgaaaccaatttagaggaacatttaaaaaatcagaatagtaagtataagtattattttgaaaaatgtttcaattttgtataaatatgtgtacctgctcttgtgtgtgtattgggagtacatgcagaatgtatttcttactgttggtcagaattaaaacatgcttgaaaaccattgctctgcaggatagggtctatggcttcttggtcctctaagggacacctttgcaatgtaaccacaaggacaataaccacactatttgcatttctctttttggtctcagtgaccaccctggcttgactggttgcactccccagttggcaaacactgggcagtctagcatcacagtcagtacttaccactatatatttttggtctgacctatttccacagccttttctgatctatgaagttactgtcaacacactgggaggtattatttatcttcctcccatggttttgggtgacaaagaatcatccgtggagaaaaataccactaggaaggttgtcccttaaaaaataacaaaggtcttcctcagtatcccctttcaagcttttccccctttgaagttattcggttgttaggaattaaagccacacctctgcacacatcaaaggcttcataataactgaagaacagcctaacagcacttcagaaattctctgtgtttcttctgctccatgtgggtaatgaggactgaaattgtgatgggaacaggagagcttgaagagcagactgtctgaaataggaacttcgaacacaatccccgcagctatagcaaagaacattgaatgttagctatgtggtgaagacagctggactgtgtgggggatcaggatcatcctataagggtcatagtcatctccactgcaaaatcacactgcatatagtcaaggtttgtgataaagctaaaattgggaagggatgaagggtttgagtaagcaaactatgaggcaaagacacgccaaatatcattgcttaaataaaacagaagtttgtcactcgttaacataactgtccaggaaagatagtcccaattggctccacacagtcatttgggaatccaagctgatgtctactctgccattttcaacatgtggttttccaggtttgtgtgggccatgccattataattggggaaaaagtataaagacacatgcatgaaagcatgcatgggcttggtgtggaattgtcacagatcacttccactcagattattttagataaaagttcatcacatggccatagctaacagcaggaaggctggcaagtgtaacttacctggacaatcatatattcctctggaagactttcgtgaccagcttacagcctctttcgtaagattaacagtcaccgggtacctggtgtgcactaaacattccatcaggtactttagatacaccgtcttaactagtcctcaaacaacattaggtgtagtagtaaatataatcttaattttacagaaaatgaaacagaggtccagaagatgtaggaaacagctgagcaaatcattatcatcctccttcttagcatggcaacaattaattgtgcatttactatattttagatgctcctactatttcaggcaacattgcctttcattggcttattgtggtaggcagaatggtcccctgccccacccccccttccagatatccagattctaatccctggaatgtatgaatatgttatattacatggcaaaagggactttaatggtatgcttaaagtttgggactttaaaatagattatcattaattggctaggtgaatgaactattgaatatagttgcatgagcatagaattatttctggttggggtcagagagatgcagcagaagtgaaatccagagagactctgagggtaagaaatgaacatgccatcactggttctgagatggagggggctctctgcagggatgggagagacctcatgagcagttcccactgtcagtcagtaaggaaatgggatcttatcctgcaggtgaatccttccagcaacctgaatgaccttgaaaatgaattttcccctgagcttccagaatgacataagccctattgataccttgagctccatcctgagagaccctaactgagaaacctaattgagcaacactgtgcctaggctttctgactcacggaaactgtaaataataaaaggatgtggctctaagccaccaagtttttggttgttacagcagcaatagagaactaatgcgctttcctaaatctttgaagatatgggttgttactttaattttatgggttgaggaaagtaaatttcttgtaaactgggatttgaatatagacctgtctggcttcaaagaactttttaactccaaaaatattatgcttccttccatgagatattgacatatcttataaaatgtacatagtgttatgaaaataaaacgcatgtttgttagtattaggagtaacatttattccagaaaagtaaataggttttaagaataaatgatcaagaaagtattgaaaaacaacagataaaaaagtagtttagtttggaatttattttcaagtctaaaagaaaaacaagagagagcaattatgtggttagttatgcctttttaaaaattaaagaagccacttttgtttgtataaataattaagagatccatcttagttctgtgactttaagacaagatcaaattaaagcaaagtagaggtggacagtttaatctatcctttgttttctgagatatttagtcgctcttttggtctgacaggtggatagattacttttccctcctcaagaattttctaatcacataaatatttacaagagaaacagatgttaataaataaaaagaaatatgcaataatttaagatttcatgaggatagatctaaattaaataatagaatttacacataaaaatttccaatgtcaatgttttatgatgacaaatctttggatattgcattatgacagcactacctactgtgaatgtagaatcttccaagaggttgcttttcaaggaattagaaattaagggtaattttcctaatatccattggggatattatataatcacttgttctttttctagagcccagactcaatttttagaatgttgctgatcaccaaacagtttatatttagattatgcaggtgaaagctggtgattgttgcctggctctcatttctctttatatctttggaccccatgcctgaaattcagtattccaggtgaatttactctgtgaaagaagaaaacataagtgcagataataaagcaaaagtctccttacttttctacagtttatgactgcaatgtaagaaaagcttacagtttcaataggcaaaaacaacaaccaaacaaatgctaaaacaggtgtgtaatactcatttcaaagacaaaaggagttctgctttctttatgtcttcaattatgtgtctccacttgatcttacattatctttttatttatttatttattttttattattattatactttaagttttagggtacatgtgcacaatgtgcaggtcagttacatatgtatacatgtgccatgctggtgcgctgcacccactaattcgtcatctagcattaggtatatctcccaatgctctccctcccccctccccccaccccacaatggtccccagagtgtgatgttccccttcctgtgtccatgtgttctcattgttcaattcccatctatgagtgagaatatgcggtgtttagttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttctaagtctttgctattgtgaatagtgccacaataaacatacgtgtgcatgtgtctttatagcagcatgatttatagtcctttgggtatatacacagtaataggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcttgactttttaatgattgccattctaactggtgtgaaatggtatctcattgtggttttgatttgcatttctctgatggccagtgatgatgagcattttttcatgtgtcttttggctgcataaatgtcttcttttgagaagtgtctgttcatatccgttgcccactttttgatggggttgtttttttttcttgtaaatttgtttgagttcattgtagattctggaaattagccctgtgtcagatgagtaggttgcaaaaattttctcccattttgtaggttgcctgttcaccctgatggtagtttcttttgctatgcagaagctctttagttgaattagatcccatttgtcaattttggcttttgttgccattgcttttggtgttttagacatgaagtccttgcccatgcctatgtcccgaatggtaatgcctaggttttcttctagggtttttatggttttaggtctaacgtttaagtctttaatccatcttgaattgatttttgtataaggtgtaaggaagggattaaggaagggatccagtttcagctttctacatatggctagccagttttcccagcaccatttagtaaatagggaatcctttccccattgcttgtttttctcaggtttctcaaagatcagatggttgtagatatgtgacgttatttctgagggctctattctgttccattgatctatatctctgttttggtaccagcaccatgctgttttggttactatagccttgtagtatagtttgaagtcaggtagtgtgatgcctccagctttgttcttttggctcaggattgacttggtgatgcgggctcttttttggttccatatgaagtttaaagtagttttttccaaatctgtgaagaaagtcattggtagcttgatggggatggcattgaatctgcaaattaccttgggcagtatggccattttcacgatattgattcttcctacccatgagcatggaatgttccatttgtttgtatcctcttttatttccttgagcagtggtttgtagttctccttgaaggtttgtagttctccttgaagaggtccttcacatgccttgtaagttggattcctaggtattttattctctttgaagcaattgtgaatgggagttcactcataatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatatcgtctgcaaacagggacaatttgacttcctcttttcctaattgaataccctttatttccttctcctgcctaattgccctggccagaacttccaacactatgttgaataggagtggtgagagagggcatccgtgtcttgtgccagttttcaaagggaatgcttccagtttttgcccattcagtatgatattggctgtgggtttgtcatagatagctcttattattttgagatacgtcccatcaatacctaatttattgagagtttttagcgtgaagcgttgttgaattttgtcaaaggccttttctgcatctattgagataatcatgtggtttttgtctttggttctgtttatatgctggattacatctattgatttgtgtatattgaaccagccttgcatcccagggatgaagcccagttgatcatgtggataagctttttgatgtgctgctggattcggtttgccagtattttattgaggatttttgcatcaatgttcttcaaggatattggtctaaaattctcttttttggttgtgtctctgcccggctttggtatcaggatgatgctggcctcataaaatgagttagggaggattccctctttttctatggactggaatagtttcagaaggaatggtaccagttcctccttgtacctctggtagaattcggctgtgaatccatctggtcctggactcttttttgttggtaagctgttgattattgccacaatttcagctcctgttattggtctattcagagattcaacttcttcctggtttagtcttgggagagtgtatgtattgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattaatcttgctagtggtctatcaattttgttgatcctttcaaaaaaccagctcctggattcgttaatttttggaagggttttttgtatctctatttccttcagttctgctctgattttagttattttttgccttctgctagcctttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgctgtgtctttgttcttgttggtttcaaagaacatctttatttctgccttcatttcgttatgtacccagtagtcattcaggagcaggttgttcagtttccatgtagttggcggttttgagtgagattcttaatcctgagttctagtttgattgcactgtggtctgagagatagtttgttataatttctgttcttttacatttgctgaggagagctttacttccaagtatgtggtcaattttggagtaggtgtggcgtggtgctgaaaaaaatgtatattctgttgatttggggtggagagttctgtagatgtctattaggtcagcttggtgcagagctgagttcaattcctgggtattcttgttgactttctgtctcgttgatctgtctaatgttgacggtggggtgttaaagtctcccattattaatgtgtgggagtctaagtctctttgcaggtcattcaggacttgctttatgaatctgggtgctcctgtattgggtgcatatatatttaggatagttagctcttcttgctgaattgatccctttaccattaaataatggccttctttgtctcttttgatctttgtcggtttaaagtctgttttatcagagactaggattgcaacccctgcctttttttgttttccatttgcttggtagatcttcctccatccttttattttgagcctatgtgtgtctctgcctgtgagatgggtttcctgaatacagcacactaatgggtcttgactctttatccaatttgccagtctgtgtcttttaattggagcatttagtccatttacgtttaaagttaacattgttatgtgtgaatttgatcctgtcattatgatgttagctggttattttgctcgttagttgatacagtttcttcctagtctcgatggtctttacattttggcatgattttgcagtggctggtaccggttgttcctttccatgtttagtgcttccttcaggagctcttttagggcaggcctggtggtgatgaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtgtcttggtgttgctcttctcgaggagtatctttgtggcgttctctgtatttcctgaatctgaatgttggcctgccttgctagattggggaagttctcctggataatatcctgcagagtgttttccaacttggttccgttctccccatcactttcaggtacaccaatcagacgtagatttggtcttttcacatagtcccatatttcttggaggctttgctcgtttctttttatcttttttctctaaacttcccttctcgcttcatttcattcatttcatcttccattgctgataccctttcttccagctgatcgcatcggctcctgaggcttctgcattcttcacgtagttctcgagccttggttttcagctccatcagctcctttaagcacttttctgtattggttatcctagttatacattcttcttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttttgtatttttagtagagacggggtttcaccgtgttagccgggatggtctcgatctcctgacctcgtgatctgcccgcctcggcctcccaaagtgctgggattacaggcgtgagccaccgcgcccggcctatacattcttctaaatttttttcaaagttttcaacttctttgcctttggtttaaatgtcctcccgtagctcagagtaatttgatcgtctgaagccttcttctcgcagctcgtcaaagtcattctccgtccagctttgttctgttgctagtgaggaactgcgttcctttggaggaggagaggcgctctgctttttagagtttctagtttttctgctctgttttttccccatctttgtggttttatgtacttttggtctttgatgatggtgatgtacagatgggtttttgctgtggatgtcctttctgtttgttagttttccttctaacagacaggaccctcagctgcaggtctgttggagtaccctgccgtgtgaggtgtcagtgtgcccctgctggggggtgcctcccagttaggctgctcgggggtcagggtcagggacccacttgaggaggcagtctgcccgttctcagatctccagctgcgtgctgggagaaccactgctctcttcaaagctgtcagacagggacatttaaatctgcagaggttactgctgtctttttgtttgtctgtgccctgcccccagaggtggagcctacagaggcaggcaggcctccttgagctgtggcgggctccacccagtttgagcttcctggctgctttgtttacctaagcaagcctgggcaatggcgggcgcccctccccgagcctcgctgctgccttgcagtttgatctcagactgctgtgctagcaatcagcaagactccgtgggcgtaggaccctccgagccaggtgcggggatataatctcgtggtgcgccgtttttttaaggccgtcccaaaagcgcgatattcgggtgagagtgacccgattttccaggtgctgtccatcacccctttctttgactaggaaagggaactccctgaccccttgtgcttgctgagtgaggcaatgcctcgccctgcttcggctcgcgcacggtgcgcgcacccactgacctgtgcccactgtctggcactccctagtgagatgaacccggtacctcagatggaaatacagaaatcacccgtcttctgcgccgctcacgctgggagctgtatactggagctgttcctattaggccatcttggctccacccgctcttacattttctttctctctcatcccaacaggaatactatgacaaaggagattacatcattagagagggcgaggaaggaagtacctttttcattttggcaaaaggaaaggtaactattaattaaaacttactaaataaaaaagattattttaaatcagtttgccataaactcaactatgctttgcattgcaacataggtcctccactttggacagataaaggagcttctaccagtagagtcccatgcaattctgtttgaacactggctttggagtggaggccacaggaccccctaagaaataataacttcttagtgatgttatgtaggtcacttgattttttggggagagacctagcttaattgtatatgagatggctggattatttataaggtcccttctggctatgactatgtgattctcaatcatccccagattccaagatcagtactagaatattttcttatccaatagatatgacaagtagcaggtggagaatgaattcagcaattgaagacagtcatgattaggtatcaggcttatagaaccaatatggctcagaatttcaattgatacaaaacagctcaagtgaatttagatgctgatgcaaaatttatactaacatgtacaataagtctttttctttacctagatattgaatggataacatgttgccagttgttccaatgttgactcaacagtattactcagagatgaaaagcatttgtgaaatattgaagggaagggccaattcttgagcacctgtgtgtataaactgtcagatttttacatatgttatatggaagggtttaccatcagggagtcaggcactgccatttgtaaactggattgtggttgaactttgaatttggccccaagtgaaggaaaaacatgaacaaaatagtttcaaacctctgaaactcttcaacactaggaactacttcttgtcattttttcccaacctagaccccatactttgaaataattcttggtgataaaaaattgcattttttatttttaaaattttaattcattgtgacatacataaatgccaaacagaatttctattcagcctgaatcagcacttgttaccatgttgaattggaataactctagccacaaacagggctttttctgtttggccctgctgggtggggggttcttaagcctttctgggcaacagattgctttgagatgcccatgaaagttgtagacccttcttcaatcaacattttgcattcagttttaggaggtgcacaggattcggccagtcaatctattgataccagactcagaactactgatactcaaccttatttttgattaatttgtcaactatattaggctttttaaaatagaaaaagttcccacaagaccattattatttgctttgtggatctctcagaaggaatcactggattcacatttaaaatttaactttaggaggtggagtttagatggtgaattttcctcttacagtgggtagttatttgataatattagaccataggacttcccacatccatcaaaatgggctgaatgtaggtaattgtcctaattaccataaaattaaaacaaagtattgtctttttccttgtccaagtttatataggtctagagggtttggttgaatgaatgtgtgttcagattctcctttttcttcagtctctttctgtttgtattgcttaacattgtttaggtaaaagtaacacagagcacagaaggccatgatcaaccacagctgataaaaacactgcagaaaggagaatactttggagaaaaagctcttatcaggtgaattcatgaattatatgccatactttggataaaatgcttcgactattttttatataaaatcatttagagttgttaaattgagctaccaagttaatggcaacaaatatcctaatattaaatattttgaagtgatttcttaaatttttatgcgggaaatgagtatgctaatttgcagaggaaataattggaaaatcttaagtttgctagtgaaaatgaaattggtgttctattaaactttttagtttcaaaaaagggtctgagaaaaggttaaaaatggaaaaattacacttgtatacagatctttatattcccaacatttgaaatattgcctactttagagttttcacctttttaaaaattacgaaataattttatatattttgtgtgcttttaaatcatcaggtcaaaagtatttttcttaagaatttttatcagctcgttttgcaagttttaaaaacaactcaaaatagtatatttgcaatttttaccacaaccttcagtcttgaggtatgagtttatttactgttgatctaatttatggaagaaatatttttaaaagttaattaaatggctcgagggacactttgcatttcctggaactcataaaacctcaagtctgatcaaatgcattttcctaaatataaataactttataaaatattaagttaaagttagagcaacacactttattggaattatctatgttttcaagttaatacttggaattatttaagaaatcagttaaaatttacatatgattaaatgcatttgtttcaactgtatgcttttggaaaaggaatagtattcctgttcatttatcttcttaacctttgcctatgaaaccccaattctgctgatttgtagatcaggtttacataagtacagagcaaagaaaaagtgttcagatattacctgaagacaaatttgagtctttaaaaatcacaaatctcttagtttttaaagaaaaccaaaaaaataaagttttagctattatgtagcaatttaaaagtgggatttaaagataagctgaattcttctttaccactttatagccggtaatgaacttgtttcaatattaggaaaattaatattctttgtgtttatttgtaacagaatataaatacattcatgcaatataataatgtaatatcattatccagggcttcagtgtctttgttcttaacgcttacagattttctcatactttcaagcaaaacaacggaagcttgaaagtgcacagcactttataaatgcagtatagagtcaaaatagctcttgaaagaaaatatgttattcagttttgctgggcctgaaataatttatgctatatgttgtggctagccaattatagtgttttccaataaaaaaagcatgggaatttatgtttaagatagacactcaactcctaaaggtgtttgaaagcattaagctaaaatcaatgagaaggaaagttggagacaaatatttttatatttttgtgccttttaatgctatcacattttagggccactgaccgtgattcagtaatccttatattctgtatatttccatgacttgacattaaatagtccctggagttctttcagaattttatgtgcaaaaataaatctatggcacttacacagttactatggaagaaacataagtgtatttgcatacatctaatacttgtaaaatgtttgcagagaatattctcagtcaaaatcatgatactgacatgcaaaaggaataccatatgcctttcctttctctaagctcacagatcaaatggttggcctacaatcaagatcatgtctgtgtctatgtctatgtctatgcttatgtctatttctagatctgtctggctctacatccaccatctctatctctatctctacctctacatatacaagcacaaattttcctgctgctgtctcaaaggtccatgaaactgaagtgttttcactgatatcttctaacaaggaccctgtaaacttgggagggacagtgagttatgtcagaaggtctcagaatgtgagctaggtagataggggtctttgaaatagtagagatgggctgccagtgtttttcctgtcccattactaagagaaggcaaaggaaatacactttgtgcgataacatttttgatgaagttgcctagaagagtcccaaagcatactccagggtatgcttagtactcccaagtcatcttaaatgaatctcagagcactgggtgccttgtggatgtaccttttgtgtgtgtgtcttttagtttataactaatagagggaggaagctaatataagtaaaggtctgtaaagaagtactttacctgatacccactggcattcattaggtaattaaatttgctaccattggatcatatataattgcaagatgtcaattataagatgcactgctatattatatacacctaagaaaaagaaaatgctgctaattacactacaatttatcaattttaagacatgctctaatttcagagattttaatggaaaaatatacactttacactttgaaatgaaagtattttagtatttaattaattgggtgatatggcactgaaactacttttttattttattaatgattggttgatcttatgctaattacttgactgtttttccaatacatttctctgataagttaatttcagttttgccttcttgttagtgaatagttctcctttgatcagaggagagctattttattttgactttcacaaagctcagaatgagattccataaacatttgtagtcacttattcttctctgttcccagtgcaattatcttcttctcctctgaattctttgtgtacataacctctactggggcacatttcaaatctttttttggggggatataaattatgatgtttaaaagcagcagtttttgggaggtgtaagtgatggtggtgttttcatacaaagttagtacattccctaataaaagtggatgtttaatttctaattatagtgaaaattgactttcctatttttgtttgcagtgatgatgtcaggtcagctaacattattgctgaagaaaatgatgttgcatgcctggttatagatcgagagtgagtatactgatgttggaggaggcaggccactgccacctttgaagacttggccttctgttacttcaaggccgatctgttttctcattcatcaccacttggaaatactggccgatctcagctgcaagtacattctattaaaattcatgggaaggaacagggccttctgatctgaatcggtctgtggcaggggcagatgctggaaggctaaatattttgtgtacagagtttatacataaatatcagcaataggctgatttaaattctgcatcttctagggaagtaagttgattcgttcgcttatggatttcttccatacaatatagtgaacaattacataatttatttctaaaatgcctttagtggtcaatttttgaacaaaaccttctctcaaagcataaaatatatattagctacatatttttccagagtggctttaattgaacatttgttgtaatttgtaagtgatgtgtgtcaatattaatctctaaatgtcttaggttattcttcaaaataagtctcattttatatgcatcactcatttgaaataatgtttgaatctgcccccctgggtttctcattaatcaactcaatatttctggttatctacttgacaaaatgaaggaaattcagtgataccaaaggcaggccattgtcagaaaagtcatagtgtagtcaaagaaatagagcatacgcatatgaaatattaacaaagattataaaatgacaacagatatcacaaggtagtatatagttgactgttaaatacaacatttattgaaaatagagtctagagatatagagctggaaaaaactttagagcatttaaaaatatatttttattatagaaaattttaaacatatcaaaaaatagaatggtatcatgaacccataatgcaagttaaacaatgatcaatttatgccttatctatacccctttaccacttcctgctatctccacactatttttaagcaaattcccaacataaaattattttatctatacattttagttgcatttctaaaagctaagtattacatgtaatgcatgaccacaataaggctaacatgcctgaaatgttaacaataattcttaatatcacttagagttattttaattctctcctctacagatacaaaatgagtcccaggtaggttacataatttccccagcagtgctccctgtgttggagccgtccctgtccaggctttctaactcatttccccatgcttcccaccatgccagttggctcccaagcatgtgttcaaaaagaggagcaatcactatgcagtaaagtggtcaaggttttattttaatttttaggtgtggaaaagggatttaaagtattaacaggacttttctaggcaaagaggaaatgtcaaagtcaccctaggtgaaataaaaccctcaagcaaaaacataggactagaaaagtgtgaagtgtgttcagataaaggtaatctttggatgccaactctcaaatggaaaatatattggtacagtattgtatcaataatgcattgttttctatatatgttccttaaaatatgtgcaagcactgagtggcattagctgtgtggtaaaatattataaatggatgcaaaatgctaggactacaaataggatagaaaggaggagctcatttcttttttcttcattgtaatcacatacaccacatatttatacaatgtctcatgtattcataatccataaagaggatgcaataattttatatggcttacaagttacttgccagtttataattttaaaatgtttagttcatgtgtgtataatttagagtctgcaatatacaaagtattgcattaggcacaatgagacataaaaattacgtgaatattttctgtggataagacaaactgattatcagatataactaggtttacttacatcttggatttactgagacagttcagattacaccagcatatttaatattgacacatcatttcactcagaaatatattccagcttggatgataaattatatgatcatcctagctatgacttatagactagaataagatcccacaataatgctctcatagcagcctttatacccttgtcatatcattataataccttgattgttttatttaacatctgtctctccatgcttctgtaagcttcataaatacagaaacatgtaacttgttcactgtggttgcagtgccagcctttgacatagtccttggcatatgggaagtgctcaccagatggtggctgaatacagggcaccatccttgcaatgaaatatagtgactgaaagccaatgactttttatttcttctttcttaattcatgattttaacaaaggcttagattgcttacagtgcaagaaggagagttaaactttgagttatatttcctatttttaaatgtgataaaatatgaaataacccttttgtatggcaagagctctaaacaaatgggaaatgctatttgtcacatctctatcactgactgttgggacaaatttcaaaaaaaaagttcattagttattgctcaggctatagcatctgaattaatgtaggctatttgaatatcacagcaacaattttgtagctgtttaaacttgactttaggattagttagtggagaatttctagagacctatagcacccatctcacctctatttagaaaataagatttgtttacagtaatactgcagttagtttaatagccagcaaaataatggtgaagtatagaataaataaaagtaaaacaaagtaagagtgtttcctttttaacagaaaatttcaactattggagattagaaaattcatagccatcctgttttatgtctcactactcttcagtcgacaaaggtcagtccatagaacaggctagaaaagagtagagaatagatctggaggggaaaggaaaaataccctgcacagtaggtaatatgtgcttaataaagtaaatatagattggttgtcaagtaaatgggtagaggcagtaagttgagacagcacaatattgaggtggctctggcttattaattttaggtattttgaggtaaactcactcttttcattctactgtgtactaggtacttaaaatgttacaaagatgattaaagcatggtctttacttttaagaaggatactattttgtagtagggaaaagaagtaccctaataattaccagtcaagatggattgttggagttagaagcagggaagcattggaagtaatcaagaaagttgacctttcactggtgaggaaaaggattattttttctcaagggcataggactatgttagaattcccagtgatcatggacaggagacagagtgattagatcaggcctatgagaaacctgtgatccaggaagggtgagaaaggtaatgagatgttggctgatcctcagagaactactaaagtaaggtaaaatgatttggatttaattatgaaggaatgtgaaatggagagagttatcttgagacaagagataaattttattcttgatttaaaatatatatagcttaactttattaagcaaagttaaaagaatctgtaacccctgtaacctgttgattcagtaaacacatcatgtaaggctgttcccttcccactatcttctctaaaaaattgttgttaaaccttgtggaggaataggaacacttttacaccgttggtgggactgtaaactagttcagccattgtggaagacagtgtggcgattcctcagggatctagaactagaaataccatttgacccagccatcccattactgggtatatacccaaaggaatataaatcatactgctataaagactcatgcacatgtatgtttattgcggcactactcacaatagcaaagacttggaaccaacccaaatgtccaacaatgatagactggattaagaaaatgtggcacatatacaccacggaatactgtgcagccataaaaaatgatgagttcatgtcctttgtagggacatggatgaagctggaaaccatcattctcagcaaactatcgcaaggacaaaaaaccaaacgctgcatgttctcactcataggtgggaactgaacaatgagaacacttggacacaggaaggggaacatgacacaccggggcctgtcatggggtggggggaggggggagggatagcattaggagatatacttaatgtaaatgacgagttaatgggtgcagcacaccagcatggcacatgtatacatatgtaactaacctgcacattgtgcacatgtaccctagaacttaaagtataataaaaaaaaaatatatatatatatataaccttaaatacaaggcagaaaactataaaaaagtttcctgttctcattaatagcccctttgcttttataaaatcaaaggatcaattatatatagcttttaataacccttgtacatattacatcaacttcaatatttcataaattatttaaaaaatgatttataaagtcaggaataaccagcttgtgttttatgagcttagaagaatgtcaagttgccttggtaactatcagcacggagcattttactttattctatctatttagaacattcaaccaaactgtcggtacatttgaagagctgcaaaaataccttgaaggatatgtggcaaacctgaaccgtgatgatgaaaaaagacatgcgaagtaagtggaggaatgttttcctgagccggagctgacttctggcagccaataaataaagaaggggacagagggtgtgacttgctgtgtggtaacttttaatgtgccttcactagaaaattctggagagttcttttgaattgttcttccacaaagacaacaccacttccactagaatggatattatctattagaaatagtctgctcctttattttggatgatgagtaggaatgttagggagaggtgttctaatccagggccttacaaaagggatattttatgttgcctggtgacttagctcaaaaagacattaatatttgattagaggtaaagagcagggttatagttagaattttttcaaaatgtaaggaatctattgcccagggatatgtggaggagggggttgggtaggtctctaaatgtagtaatagtgattaattttttgtgtgtactagaaaactctacttttgttaaatgaaaattatttgaaagttgtttgctgaaacatttttttagagtgaatgcttaagcacatgttcactagatagtgctatcaaagccatatagtcaaaattcttagaaaacttaaatttgaattaaattagaatattcaatcagtacttcatatgtttttgcaatttttacgctgaaggccttttgtggtaataatttatgaatatgtaacccagaccggtaaaccttaattaaaagagaaaaaaatggatattacttagacataaagtaagaaatgtacttttcatatttcacaaagcagttattttggttcagccatgcaaagcttcaagatctgataaaactagcaaaacgtgggaaagattgtcaatgtggcattctcctgtacatgcagcaaaggaagtggcttccttgtttcattcccattcattgactgcttttcatggttgttttttaacagcttttttgaggtatatatatttttagttaaaaaaaatttccacactgagaagaaacctaagaggtacattttaagtaccacaaactatacccattttacctctcattgattcaacttggcattcgtctatttcctggtatatgcatatgtgtgagttttatgtttgtatattctattgttttctcgctgcgtgggactgaatctgatccataaaagttgggatagcctttgtggcaactataaatcatagttacagcagaaattagactgtcgtaggagtgaaatttatgtatggcatgacaccttcttaattatgggtgtgtgtgtgtaaagtttcacttctcttgtacaggcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgtaaggggtttacgtttcaagcatctgagagaagccttttgactttttttttgttttatattccagcatatcttggaggaatatatgaattgttactgctatcttaaatgttgctttgaactgaaattgagaaagtaaacttttcactctgtatattgtatagtagcaggtctgtgctagtaagtaacttgtaataatcaactgctagttcaagcttacatcacgtcttttgtgaattttcttctcgatgattatcaatatactaagtaagcacgtccaaaaggaaacataaaataatgtattttctaacagcaaatgcgtgtctatatacattcatgacacatttagtctctatacactaaagaaaagaagaatgtgtcaagtgaaaatgccatagaggtgaaatattcaatgttatagttgtgttctttaaacaactccagtaccatgtctgtatttcaccttcattattttgtttttgggttgctcaaaatttcgtattgtgagaaaagaaaagaagatgaatgaaagggaatatttgaagagaagccttctgtagtgttgatcaggatatctgggaacttacagcctgattttagttgtgccttccacatcaccctctttctgagctatcagcttccaaggagtagcaaaagtggtactgtcaaacaagtattctaaggaaaatgtggaatagagatctgtggccttactgggtacagatggctctgaggccttggcaattaccgagtccttctttgcccatcagatttttaaggattcaccataccttatcttctgggaactctgctgacctgttggtctgctggctggctttgggcatgagcagatttgaaatgctgtcaggggagtctggacagtacacttcagacccagtccttgcttcatctctgatgggggcagggacagatgttccttaggataaataatgtgtgtaatgtctcttataccttatggagagataaagataatacctgtctgcagtggtatttttcgtcaaagtttgtggcaaaaggattcaattaacaaagctgagatctgttttctaataataattgaagcagtaaatccaccattgatttaaaagtcatgggcagcactaatggcaaacatgagcaaaatatggagtgcagccatttctgcacaatgtagttacttatctagcatagtctgcttatggagttttaaatctatcaaaaaattattttaaaatgtttatttcctttttaggaaatacttgatcgtgcatctagagtagtactgtttaatagaactgtgctgagggaaatgtcttatatctgtgctatttaatagggtagccactaactagatatgactgttgagcctttgaaaagtggctagtataactcaggaactgaatttttaattttatttaatttaaatttacataacctcatgtgatttgcagttaccatattggatggtacagatatagagcttaggctgggtgcggtggctcatgcttataatcccagcactttgggaagccaaggtggaaggattgcttgggctcaggagtttgaaattagcctgagcaacatagtgaggccccacctttataaaaaatacaaaaattagctgggtgtggtggtttatacctgtagtcccagctactcaggaagctgagatgggaggatagcttgagcccaggaggtcaaggctgcaatgagccctgattgcaccactgcattctgggcgacagagtgagaccctgtcttaaaataataataataataataataaatcttgctttgaaagcaaagtgaataataaaaaaaggcaattctagtcaaagtttttaatgtcacccaattaaaaatagaatagctatctaaatattaagtctaacagaattttattttgctttaatacaaaaattttagagccacatcccagatagatgaactattctagaaatagtgatgaaagggaagtgtgtacacttgaatgaaagttctcaaagggataagtggctaagggcttccatactaattaaacatgaaacagttttaactctcattgattagtgtgttttatatagatataagttaattttgaggtatctttccatttcttacataggttaaagtaaaaaatgagaatgttgcttttgctatgaagtgtataaggaagaagcacatagttgacaccaagcagcaggagcatgtctactcagagaagaggatcctagaggagctgtgctctccattcattgtgaagtaagtgaccacttggcttccaaggagttaggattttcaggctctttatttatgtatttacttaaattatttttatttttatttttaatttttgtgggtacatagtaggcatatatatttatggggtacatgaaatgttttgatacaggcatgcaatgcataattacagcatggaaaatggggtatccatccccttgagcatttatcctttgtgttacaaacaatctacttatactattttagttattttacaatgtccaattaaattgttactatgatgcccctgttgtgctatcaattgctagatcttattctttctttctattttattttgtacccattaaccatctccccttcctgcatgtctccccactacctttcccaggctctggtaaccactcctctattctctatctccatgaattcaattgctttgatttctagatcccacaaataagtgagaacgtgtgatgtttgtctttctctgtctggcttatttcacataacataacgacctccagttccatccatgttgttacaaatgacagaatctcattttttttgtatggttgagtagtactcggctcttgttttaaactttccatgcaagatgacagaaagaagaggtggaggaggccccactctggattctccaacccagtcacagcaacagtactaaaaatgttagaagtttgagatctggggtcagatgttttccagttgttttgattctttttttttttttttttttgtcttttgagacggaatctagctgtgtcacccaggcttcagtgcagtggcgtgatctttgctcactgcaagctccgcctctggggttcacgccattctcctgcctcagcctccagagtagctggaactacaggcacccaccaccatgcctggctaattttttttttttttctatttttagtagagacggggtttcaccgtgttagccaggacggtctcgatctcctgacctcgtgatctgccaacctcggcctcccaaagtgctgggattacaggcgtgagccactgcgcccagcctgtttttattcttgagtaaacatcacaaaaatgtgtgtgcgtatatatatatgtgtgtttgagtatgtgtgtatatgtatatatgaatataaaattattgaggaatagtttgaactggttattttattcagacttaatgcagaattggggactagggaagcaaggatttgtgtgaaactcctcagagagcatcctgatcttgaatttctgcagaaggcagcatttgggcacatgtgggaagccaagggggaatgtaccctggtcctagtagtagctaggtaccaaaacatccatcttctaatagttattctttctgtagctgtcacaagagtttgcagaagaaatattaattattatagaccacagctttctatccttgtgaattcatgggtaggggtgtaagccatcttatgctttcatatatgttataatgccccagagtgtagttttagtgatttctgggtaatgtaaaatatccctgcaatgactagaatttatgctttttgatcaaatgctttaaaagactctttctccctatccatctttccagacccacttttttccccaagatcaacaaagaagtttgaacccaggcagtgctggcaatagagagtcatccaattatctttatattacgttcccagaatggatgcacttttaaaattaatattttgttaacaagctatgatgagcagcttcagggcatggattagattgcattcattgtcttattttcaactctttccaaagtgcctggcatgtagtcaggcaataatatgaagaataaatattaatgacaacatttattgagaaattaacatacaccaggtgctgttctaagctatatctatatgtatagataatcaacacatttatctcactggtcaattagaataaaatggatatttttttttcaatgaatatatatcaataatatacataataatatgtaatctgtatagagtaaaatgaatatatatgttcattgagaaacaatgagaagacagaagttgcatagctaataaatgtctgatctggattcaagccttggcagcttggttcagagcccaccctttgaaccactttacctgattgcttcttctatctgtgtatgatacggctgttctactgtctgctttggtctggatgtggtgctagggagaaaagggggtctcttgatgattaaggccccaaaactgcttttacacaaggttgaaatgtgatgccctgcctacgtcccgcttcggaactgaggcccccattcccccagcttcaaggagtgtggttgtcagctgaggactagctcagtccctctctgggcattggtttttgtttttatttggtgaagagaaccaccttgctcaagatcatactctctctttggggacatgcatccaacaactgcagagcctcttgaagctgaggcttttgtcgaaactaaaacatagcccaattctacttcctcccttccccacaggtgttgtttccaattgcactccccactaatctgattgcttgcaaatttcagtctcagagtctatttccaggggaatccaacatcaattaaccaactaggggatataagacattgacatgaataactactatgcaaggcaaatcttaaaggtgacatattcagaggtctctaaggttttggaaaaaggagaggacatatttggtaggtgggataatgagatgttttgttaaaaagatggccttggaggttggccctgaagaatggataacatttttacggtaaaactgagattaagaagttcagtctgtggttagagaaaggccaatctaagtgagatccacaggagcagaagcaaggcagtggggaaatcaaagaggatttggcgagaagcccagtgtagttgtggggtatttatatggagatgagtatcattgttcctaatgttatgatgatagttctaagcaactttaaaaaggtttttaaactagatttccaataataaccatgtttttatctgtcttcacagattatatcgtactttcaaggacaataagtatgtatacatgcttctggaggcctgcttaggtggggagctctggagtatattaagggacaggtaatgaaaaagtttgtatactcacatctggcctaagggctatatttataatcattaaaaaaggcatagaggaaatcattaggaaattattataacaaaatatcccttgataaaataaagtagtaatagtgatattgtcttggctaatgctacaatagtgccgtaacaccacgtaaggtagttgttgtcatctctgttttaggaagtaaagaatcccagactagagaggaggtgaactatcccaggttacatgactagtataaagcagagtcagggtaaaaacccaggtgtttctgattccaaatctcctagcagaagcagtgtgataaacaaaggtgggggtggggagtgggtaagccctcactgaaaagcagagcaagatgcctgcgaagattcagttttacacaagggggtgatttttgcacaattaaaatcatagatatttactaagcaccacctatgtaaaaggcttcatagtgcacggtgggggtcaggaggagacgctctagacagtgtgtacttttctaaccaaaagagtaaaaagtagaaactttacctctaatgagtttagagtttccttgggagattaggtatacagttttaaaacatttcattgtttagtgagaaaactaagtgatgacaaagaagttggaaatttgtagttaaatgccaaatagtgtcgtagatggtgagctccgaggaggggagagagagagaatgtgatgatagaggaaggattcgaattaaactctaaacatgacccaaatttggaaaggcagagaggcagggaaactgctttaagacaaagcagggaagttggggtagtattatgtctctctgtggatggtgaacagaagaatttgggtagaagttaagggcaacagaagacatgagaacgtgggttggcgttagattgtgggagttgatgcaaggccacatatttacagtcagacctgtgccagtgtttttcaaagttggccacacattgcattcacgtggaaagcttttacaaagtaaaaatgctgggccctaatgccagaggttatgattcatttaatctgggatggggtccagtaaacgattttttaaatgcttctcaggcaattttaatgtgcatttatggttcagaatcactgacttaggcaaggaaagaacattgagcatctgagtagaagatgaatgtgttgtatcatgaacatttcattggacagatttgaatggggagaacctggaagggtgaggagacttttgtgatacctgcaaatgcattagcgtcttctatctttgcttcaataggcaaatttgttgagaaaatctaaatcattttagaaaagggagttactgctacctgttaggcactgtgcttaatcctgaaaatgcttttaagtgagtatcaaaccttttttactgatatggattctgagcctcagaacagttaaacaactttctcaaggatatagtgagtgaaagaaacaggagtcaaacccagtttctgtcactccaaagccatgtttctctgtgagatcatgtggcaaatcaccactgcattaaaaaaaaaaaatccagtctgtaaaactacacacagtgctgacagaggggactttaataaaagatcaaggggccccaaacagaaaagacttatgattccatttttacgggggttactctgacgtgctatgcaaacaggaaatgaaaataatcacttgagtcatttttaagtcaagcaataagttgcaaaagtctggttcaagctctccactatagtagcattttctccagagtttgtgatgggtgtctaaagaaaatctttgtttttggatttttctcttttacatgtccatgtgtgattaccaaaaacagttgttgatattttaattttagtgaagtagttcttgtttgtatcacatatctccctgaattgctttatgatctgcaaacagcttaattcatgggtagtataaaatacattttattgttgataccctgcaaaatatttatattgcataaacctgccaatccaataattgatttgacacgtagaacagcaccaaagatgtgtatccaaagtattaagagggaaaatgatttcgttgcagaggcagctttgatgaacccacctccaaattctgcgttgcttgtgtgacagaagcatttgattacctgcatcgactaggtattatctacagagacttgaaaccagaaaacttaattctagatgctgagggttaccttaaattggtaagacaacttttctcacttacagtctcatatgagatatttcccctggcaaaagttgtgttctagttgcaattttctttttaattttagtgcagctgttattctctctttggcagtatggcctttgacatttcccgacaatactgggagcaatgttatgagtacattatttttgacctaaggatttaatgtttaaccatatttgtgactcctactgaaggttcacataatagaatgcctttaaaattggattttatcagtatttttgtttaatttttaataattttaactatttttaaattgattcttgctatacatagggagtggctataaggaataataaaagaagataatatgatttctaccccaagatatccactgtgtatatataaagagaagataaacatagagactttagtagttttcttgaaatattttgaggtgatgatactggggccccagggtttaacatcacaatcctagagtacaggtttcttgaggacacagactttcctggctgtccatctttgtaatctgctggtccctaatatgactcctttgcatgctacactaaagaaaaaattactattagtcacataaactgctttcagtgagaagctataatagactggacagtcacaactgaggagaaagcaaggcgccttgggcctcgggaaggaaccccattagaatggggaacccaagcttttacctgagtccatttttacttcaaggacgttaaaccatttctgaacttaacatttacaaagatattaaaagtttctcacttcagaatttttataaaaggaaataaaaatagctcgcatttaatgggcagttactatatttaaagctactatgctaaaccttttacaattaacctatttaacaatctgtaagataggttagataggtttcatcacccacatgttatagttgtataattcagccacatgaattaaatttattatgtgtaaatgctaagatatttttctctgtggtaaaagagtaaaataaaagccctttcatgtgaaatctggctaacttccaagaaacacttttaatcattcaagctttattttatccatgaaagatagctttgagaactggtgaggtactaacacaggaccccaatcacttctgttcttcacaattccttcattggttatgcctcctacatctctttacagaaactctttggaatattgtaaaagtagaaccaacatgagggatgcagacaattcagtagctccatctcttttttctcataactgatttttcttaaaaagctatttttaaaaaaaaatagctatatatttcacatgtataggcatagagatgcttttttttaaaaaaaacatatttcacatgtgtaggcatagaggtcaataaataactgctgttatccattctgctaattcatttgccaatcagctaaacaaagagtaagaactatagccttcagtgattaaaaagtgaatattaaatatttcaatttctagctatgaattaaactatgtaccttgaaatcctcttactacaaaatgtctactggatgaaacatgagaagcagtattaaatatatggctgagtttataagacaacatgagaattcctctggggtttgaaatcaaacttgagcagcagtatctggtggaaatcacacattgaagctgccatcttacatgcacctagcaatcctaggtggtctagaggtttgattttagtagctgtgccctctgggaacaggagaccaagcgttggacttatgtagtgtgggtaggtgaatcagagaacattgcatgaaaccaggaatcacatacattaaactgctggagaaataggaaacaagaaaaaaatatcaaatttgtaatgacagattacatgcaaagaaacatgcttttctcattattggctcttggtagaggaatagaaacctatccctaagaattcttggccacaggttggtcttagtggaggttgggtgcccagtcttcaaggatggaaaaatctaagcaagaatttaaatgaaatgaatctatgttggtggcatgcccaagttcccaagaatcaatgtatattctttctggaagaatatactctcaactcaggacacaaagaactactggatctaaagttctagggaacataagccagcattaaaaaacatgaatgtatgaggaaaaaagctaccataggcattcatttccagaaacaaaaagagcagaagcagacacataagtgcctcatttattggagtaatcagatacagactataaaataaatacatctaatatgttttaaaactaagagagggttaaaaaatgagcaaggatcagaaactcaaaaaagatctaacagatatggaaggaaactaacaaagcatctaataagaaattaagagtataatgattgaaattatatatgcaatgaaagctgtcattaatggcggagtagcttgcattggactaccctcttgataagattaatcataattgaaggcattgaaaagaaacaaagagtagatattcaagctctgtaaaaagaaaaccgtgctgggtgagatccacattaaaacagctgtaatacagctgttcacttcaggacattcttcagtgtataaggaatggggaataaacctctagttaaaattgtacctcatggtaaggtagtgagcattttttatcaggttgtgaacaggacaaaaatatctcctcttatcacttgtatttaacattgtaatagaggtcttagcaaattagactaagaaagataaatgaaacccctaaatattataaaggaagaagttacctatttttatttgcaatgtgaatttttatttagaaaagtctgaagactctaccaaagaggtacttgaaacaagaggtaagtatgattataggtacaaagtaatacacaaatataaattctgcatttatatactagcaataaaaatttataagtgaaacaaaataatcttcataacactaacaattataaaataattttgagtaaatttcatatgtaaaaagtatgagacctttacattaaaacccacaaaatatcactgaaaaaaaacctaaatggcaagatatactatattcatggattagataattcaatatttgataagctactctctaagattcaatattactgcattaaaaatttgagcagccatttttttagaaatggagatgtttattctaaaatttacatagaaatgcaaaatgattagaagggtcgataaacactttgaaaaagaacaaaattaaagaatgtgtactatcaatatcaagacaataaagctacagtaatcaaggcagtatgatatgggtataggaaaagacaaataactcagtctaatagaataaagtccagaaataaacatgtacagtcagcaaaagaatcttttcaaaaaacattgctgaaacaactggatatccatatgtggaaaaaaattaacctaaatcccaccacaaaccatatacaaaaattaattctagatgaatcctagacctgtaaatcacctagacgtaaacatagggtaatattttcacaatttgaggtgggccaatatttcttagaatacaaatatttgcaatatatatttacattacaaaaggcttgtatctagaatatgtaaagaactcctacaaatcactaataaaaagacaaatcaattttttaaaatggtcagcatcttaaaaaaccacttcatggtggctggcaagatggccaaataggaacagctctggtctgcagctcacagcgagatcaatgcagaaggcaggtgatttctgcatttctaactgagatacccagcttatctcattaggactggttagacagtgggtgagctgaagcagggtggaatgtcacctcacctgggaaccacaaggggttggggaactccctcccctagccaagggaagccatgagggactgtgctgtgaggaatggtgaattccggccccagatactaagcttttcccatggtccttgcaacccacagaccaggagattccctcgggtgcctacatcatcagggccctgggtttcaaacacaaaactgggtggccgtttgggcagacactgagctagctgcagaagtttttttctcataccccagtggcacttggaatgcaagtgagacagaaccattcattcccctggaaagggggctgaagccagggagccaagtggtctagctcagtggatcccacccccatggggacaagcaagctaagattcactggtttgaaattctccctgccagcacagcagtctgaagtcgacctgggatgctcgagcttggtggggggaggggcatcaactattaccgaggcttgagtaggcagttttacccttacagtgtaaacaaagccgcggggaagttggtggaggctgctgcagctcagcaaaaccaccgtagccagactgcctctctagattcctccattttggacagggcatctgtgaaagaaaggcagcagtcccactcaggggctcatagataaaactactctatccctgggagagagcacctgggggaaggcgtggctgtgggtgcagcttcagcaggcttaaacattcctgcctgccagctctgaagagaggaggggatctcccagaacagagctcgagctctgctaagggacagactgcctcctcaagtgggtccctgacccttgttcctcctgccggggagacacctcccagcaggtatcaacagatatctcatacaggagagctccagctggcatctggcaggtgcccctctgggatgaagcttccagaggaaggaaaaggcagcaatctttgctgttctgcagcctcacctggtaatacaaaggcatacggggtctggagtgaacctccagcagacctgcaacagaggggcctgactgttagaaggaaaactaacaaacagaaaggaatagcatcaacatcaacaaaaaggacttccacccaaaaaccccatctgaaggtcaccaacatctaataccaaaggtagataaatccatgtaagtgaggaaaaaacagcacaaaaaggctgaaaattcccaaaacgaggaaaaataaaatcctttacagagaagcaaatgccgaaagattttgtcactacgaggactgccttacaagaacttctgaaggaagcactaaatatgggaaggaaaaactggtaccagccactgcaaaaacattgcaaattgtaaagaacatcgacactatgaagaaaccgcatcaactaatgggcaaaataagcagctatcatcataatgacaggatcaaattcacacataataatattaaccttaagtgtaaacaagctaaatgccccaattaaaagacacagagtggcaaattggatagagtcaagatgcatcggtgtgctgttttcaggagaaccgtctcatgtgcaaagacacacataggctcaaaatgcagggatggaggaatatttaccaagcaaatggaaagcaaaagaattcaggggttgcaatcctagtctctgataaaacaaactttaaaccaacaaagataaaaaaagacaaagaagggcattacatagtggtaaagggatcaatgcaaccagaagagctaactatcctgaatatgtatgcacccaatacaggagaacccagattcataaagcaagttcttacagacctacaaagagacttagattcctacacaataatagtgggagacattaacactccactgtcaacattagacagatcaatggacagaaaattaacaggaattttaaatattcctggaatatttaatattcaggaattgctgtcagctctggaccaagcagacctagtagctgtctacagaactctccactgcaagtcaacagaatatttattcttctcagcaccacatcacacttattctaaaatcgaccacataattggaaataaaacactcctcagcaaatgcaaaagaacggaaatcctaagtctctcagacaacagggcaatcaaattagaactcaggattaagaaactcactcaaaactgcacaactacatggcaactgaacaacctgctcctgaatgactactgggtaaataacaaaattaaggcagaaataaataagctgtttgaaaccaatgagaacaaagacacaacataccagaatttctgggacacagctaaagagggaaatttatagcactaaatgcccacaggagaaagtgggaaagatctaaaatcaacaccctaacatcacaattaaaagaactagagaagcaagagcaaacaaattcaaaagctagtagaaaacaagaaataactaagatcagaacagaactgaagaagatagagacatgaaaaacccttcaaaaaatcaatgaatctaggagctggtttcttgaaaagatttacaaaatagaccactagccagactaataaagaagaaaagagagaagaatccaatagacacagtaaaaaatgataaaggggatatcacccctgatcccacagaaatacaaactaccatcagagaatgctataaacacttctacgcaaataaactagaaaatctagcagtggataaattattggacacatacaccctcccaaggctaaaccgggaagaagtcgaatccctgaatagatgaataacaagttctgaaattgaggcagtaattaatagcctaccaacaaaaaaaagcccaagaccagatggattcacagccgaattctaacagaggtacaaagaggagctggtaccactccttctgaaactattccaaacaatagaaaaagaggaactcctccctaactcattttatgaggccagcatcatcctgataccaaagtctagcagagacacaacaaaaacagaaaatttcaggctaatatccctgatgaacatcgatgtgaaaatcttcaataaggtactggcaaaccgaatccagcagcacataaaaaagtttatccaccacgatcaagtcagcttcatccctgggatgcaaggctggctcaacatatgcaaataaataaatgtaattcattagataaagagaatgaatgacaaaaaccacatgattatctcaatagatgcagaaaaggcctttgataaaattcaacacccctttatgctaaaaactctcaataaactaggcattaatggaacgtatctcaaaataataacagctatttatgacaaacccacagcctatatcatactgaatggacaaaagctggaagcattccctttgaaaaccagcagaagacaaggatgccttctgtcaccactcctattcaacatagtattggaagttctggccagggcaatcagccaagagaaagaaataaagcatattcaaataggaagaaaggaagtcaaattgtctctgtttgcagatgacatgattgtatatttagaaaaccccatcatctcagcccaaaatctcctaaagctgataagcaacttcagcaaagtctcaggatacaaaatctatgtgtcaaaattagaagcattcttatacaccagtaatacacagagagctgaatcatgagtgaactccttttcacaattgctacaaagagaataaaaaacctaggaatacaacttacaagggatgtgaaggacctcttcaaggaggactacaaaccactgctcaaggaaataagagaggacacaaacgaatagaaaaacattccatgctcatggataggaagaatcatttatagattcaatgctatccccatcaagctaccactgactttcttcacagaattagaaaaaattactttaaagttcatatggaaccaaaaaagagcctgtatagccaagacatttctaatcaaaaagaacaaagctggaggcatcatgctacctgacttcaaactattctgcaagactgcagtaaccaaaacagcatggtactggtcccaaaacagatatatagaccaatggaaatgaacagaggcctcagaaataatgccacacgtctacaaccatctgatctttgacaaacctgacaaaaacaagcaatggggaaaggattccctaatcaataaatggtgtcgggaaaaactggctagtcatatgcagaaaactgaaactggaccccttccttacatcttatacaaaaattaactcaagataaagacttaaatgtaaggcctaaaaccataaaaaccctagaaggaaacctaggcggtaccattcagggcataggcatgggcaaagactttgtgactaaaacaccaaaagcaatggcaaccaaagccaaaattgacaaatgggatctaatttaactaaggagcttctgcacagcaaaacaaactgtcatcagagtgaacaggcaacctacagaatgggagaaaatttttgcaatctacccatctgacaaagggctaatatccagaatctacaagaaacttaaaaaaatttacaagaaaaaaaaaccatcaaaaagtgggcaaaggagaggaacagacgcttctcaaaagaagacatttatgtgtgcaaaaaacatatgaaagaaagctcatcatcactggtcattagggaaatgcaaatcaaaaccacaatgagataccagctcacgccagttagaagggcaatcattaagaagtctggaaataacagatgatggagagaatatggagaaatagggatgcttttacactgttgatgggagtgtaaattagttcaaccattgtggaagacagtatggcgattcctcaaggatctagaaccagaaatactatttgacccagcaatcccattactgggtatatacccaaagtattataaatcgttctactataaagacacatgcacatgtatgtttattgcagcagtattcacaatagcaagggttggaaccaattcaaatgcccatcagtgatagactagataaagaaaatgtggcacatatacaccatggaatactatgcagccataaaaatggatgagttcatgtcttttgcagggacatggatgaagctggaaaccgtcattctcagcaaattaacacaggaacagaaaaccaaacactgcatgttctccctctaagtgggagtagaacgatgagagcacatggacccagggaggggaacatcacacaccggggcctgttggcggctggggggtctgggagagggatagcattaggagaaatacctaatgtagatgacaggttgatgggtgcagcaaactaccatggcacgtgtatacctatgtaacaaacttgcacattctgcacatgtatcccagaacttaaagtgtatctattaaaaaaaacacttcacaaaagaaaatatagaaatcgtcagtaagtcacgtcagtaggcatcaaggaaatgcagattaaaaccacagatttaccatttcatacctacttaaaaagatttataataccaagttttagtgaggctgttcccctacatttctagtagaaaaagaaatttgtaaaccatttcaaagaatagctagtcagtttttcattgagtcaaacgtatacctattccgtgacaagaaattccacttttttggtatttacccaggtaaactgaaatcatgtcttcaaatatcttggccacaaattttataacaactttattcctaatagcccccaaattcgaaacagccaaaatacccatcatcaactgaatgtataaacatatagtagtctactcagcaatggaatgctgctcaccaataaaaaggaacaacatgaatgcattttttaaactgacaatcaaaggaagccacacacagaagagtatcttctgcatgattccttgtatcaaagttctggaacaggtggcagacataaatacaatggtcgtctctgagaaaaacatttgactggaaaggagcttgagggaattttttgaaataacgggaatgcctctatcttgacagtatagtggttgcagctacatcagtataatatgcactaaaattcaatgaactgtacaccaaaaatatatggattttatttcttataaatcaatttaaaaaattgtagcataaaggttaaatagcatatgattgacccaacaaagaaaaaaatctgtgaactgaaagatacatttaagtaatttacatagaatagagacataaaaacatggaacataagaaagagaaatgaaaagagttggagaatagagtggagtcgtagacaaaaatcatatagagaatgtgggaaaagcaatatttaagaaatagaaactaaaaaatttccagaaattaaaaatgacaccaatcatcaggtaaagggacccccacaattctaaactgggataaacaaagttcccattttacataacaaaccactccaaaatataatggcttaaaacaacaataatcatttatgatctcaggtttctgtgggtcaggaatttggaagtgattttgcttgaggtctctcgggaagttacagtcagatggtgtcgggggctgcagtcacctggaggctcagagacccattagactagaggaaccgaatccaaggtgactccctcatgtgctgcaagctgatgctggctgttagttgggtgccttaattcttctccaggtgggcctcttcctgggactgattgaataactcatggcagctggcttccctctgggtgggtcatccaaaagacaatgaaaaagctacaaagcttttggaagacctgctcttgaaagtcacacactagcacttgcagtgtattctgttggctacacagggcctgctctaattcattgtgggatgagacgcttcagaatagcaaaaggatatcacagatgtttgctattgtagtagtgaaagtacaaaacaaaaacaaacataaagtcttaagagttatcccaaggagaaaagatagtttatatataaaggaataaaaattaagctttcagctgacacctcaacagcaacaatagaagctagaatgcagtagaatttaaagttctgaaaaaaagtaaatgaaaaactccatgtccagggaaactgtctttcagaaagggtgaaagaaagacattttcagacaaagataaagggtgtttacttctacatacaaaggatatgcttaagagagaagaaaaatgatccctgatgaaggatctgatatgccacaaggagtggtgaccacaaagaaatggtaaacatgttaccatgttaaaaaattatggcataaagtaataattattccaatagataatattaaaatgtaaaaaaggtgaaataactgaacaacagtagcatgcaaactgagagtgggtataatgggaattaaaatagaaggatcaaattctttttttgagaaaatgttattttaaaagaaggccgcaaaggaaacagaaaatccaaaaataatcaaagagaaagcataaattaaggaaacagaaaagagatccagtatatgtaaatggacttaactcttcaggcaaaaaactattgtcaaatacatttaaaaaataaaaattggccaggtgcaatggctcaagcctgtaatcccagcagtttgggaggctgaggcgagcggatcatgaggtcaggagatcgagaccatcctgtctaacatggtgaaaccccatctctactaaaaatacaaaaaattagccaggcatggtggcaggcacctgtagtcccagctccttgggaggctgaggcaggagaatggcgtgaacctgggaggcagagcttacagtgagccgagatcgtgccactgcactccagcctgggcaacagagcaagactctgtctcaaaacaaacaaacaaacaaacaaaaatcacctatgtgatgtttacaggagatatgcttaaaatatgaggatgcacaaaggttagaattaaaagggtggaattcctagagataaatggggttaccacatgatcatgaaaggccaatttcaccaaagtgatatgaaaatcctaatattctatttacctaataaaattcttcaaaaataaaaataataggaatttggcagataaggacatatgagcaattgcagaaattttaatatatgttcctcaggaactggtagaacatttagatccaaaatcactaaagctttagaagatgtataaaacacaaataatacacttcatctaatgggcttgtagaatattgttcccaataggtggagaatacacattaacaaaatttgatcatatactgggacattaagcaagtttcatcaagtagcaaaaatgggaactgattgggctggcagcccagccagagctgttttagctgaggcttctgagcggactgcagtgggatggagtctggaaagggtggcctagggtggggtgcgccctgtggcagtacaacaggacttccatctgggtgatggacactgtgggcagtccagttttggacacaatgtcttataagaatgactttggtctcattctgcaaattcctataagtggcattttcatcctccttcatcaattcttggcaatatctatgaggggtcagatacctaagggaggcaagtaagggaaagtttgctggtctgtttgttttttcagcagaggaaaaccagggaaagcccaggaaaaaaaaggcctaaataagaggagaaaagtctgggtttggaagtgtgtctttggagtctgtaatggtgtgtcctttcttaataattatagatgatgagtttgtggtgagggattaagacctcattctactcttattccttagtcatgattgagattgtcagcctgattttttccaaaatgaatctcacctgggttcgagctgtttttatcagaaatcacactgagtggagattaaagaactaaaggatcatggaaactctcacatcattatatctttcctgcccatcccagagtttcctatatcttactgcacttttcaggccaagaagagctgatgaaggttaagaacctttcttctggttgtagtgaatgaatcaataacaatattaagattatgacaatacttaaagaatttaaaagaaagcccactttgttctcaacctatgcagcatttatataatagctagccttttttgcaattcttcaggagaaaacttggttttactctaacaaataataatccaataaatctcagctgctgctcatcaataaatgtcctatatgaatgtattaactcatgtgagtaatgcacctcagctaaaattcagagcctgcccacatgcttttgcacaggatgtgttaacagagcaacttaatcttacttatattgagtataagaaaatataatacaagacatattaaacgttgatattattgcctgtcatctatctgcctgtctatactgatagccctataatggcaaactatgctagggtgtttactgttgaacttagcatgttgcttagcatataagaatgaatgaaaccaaaagttatttgaaaagatcaataaaatcaatgtctctatccagattaactaagaaaaaaaaagagtgaaagagtgaagatataaattactaatatcagaaatgaaagagggcacatgaattccatatatttcatggatatggattctacatattccatggatattaagttaataataaaagaatactgtgaactgtgaagagctctgtgtctacaaatttgataatctagatgaaatggactaattccttgaaagacacaatctgtcaaaagtcacacaagaggaataggcaatctgaataggcctatatctattaaagaagttaaatcaataattaataaccttctagagcacaaagaaccaggcttagatgggtttattggtgaattccagtcaacatttacataagaaattatactgattctctaccatgtctttcagaagataaagcagaaggaatactccataactgattttatgaggccattattactctaataccaaaagcagacatagacattccaggaaaaaaaataaaaaactacagaccaatatctcccatgaatatagatgcagaagctcccagcaaaatattggcaaacagaatccaacaatgtatacaaaggattatataccacaaccaagtaaaatttattccaggtattcaagactggttcaatatttgaaaatcaatgaatataatccattacaccagcaggctgaaaaaaaagcattatattatcatatcaataaatgcagaaaagccatttgacaaagtcaaatactcatccatgataaaaactctcagtaaactaggaacagaggagaactttctcgacatgataaagaatatctacaaaaagcctacagctcacatcatacttaatggtgagaaaccagaaacttttccactaagatcaggaataaggcaaagatgtcttctcttaccactccttttcaatatcacactggaagtcctagttaatgcagcaagacaaggaaatacagggcatatggatttggaagaaagaaataaaagtctttgctcacaaatgatatgattatctatgtagaaaatcttaaagaatcaacaacaacaacaaatttcatggaactaaaaagcacttacagcaaggttgcaggatacaaggctaacatgcaaaaatcaatcactttcctatatactagcaatgaacaagtagaatttgaagttaaaaacactataccatttgcattagtactcacaaaaatgaaataggtttaaatataacaaaatatatgtaagatctatgaggaaaactacaaaattttgatgaaagaaatgaaaaaaaactaaaatggagagtattccatgttcatcgattgaaagactcagtattgttcaaagaaaaacttcagctgaattaaatgtaaaggaatttaactgatcaatgagtgattcatgaattgggcagccccagaatcacagcagattcagggagactcccggggtgcctcatggtcagaacaaatgtacagacaaaaaaagggaagtgacgtacagaaatcggaaggtgtagaaacagctggattggttacaggtcttccttatttgaacacagtttgaacattcagcagcgtatgagtagttgaagtatggcttctgggattgactaagactcagctgttgttacaagtgcatactcctaagttaggttttcaatcttgtctacctactaggttaggttgcagttcatccacaaggactcaaatatagaaatatggagtccttctcaggccatatttagttctctttaacagtatccgtaagatatcagttcttcccaacttgatctataaattcaattcaatttgtttgggaggctgaggtgggcggatcacaaggtcaggagatcaagaccatcctggctaacacagtgaaacgccgtctctactaaaaatacaaaaaattagccgggcatggtggcgggtgcctgtagccccagctactcgggaggctgaggcaggagaatggtgtgaacccgggaggtggagcttgcagtgagccgagatctcaccactgcactccagcctgggcaacagagcaagactccgcctaaaaaaaaaaaaaaattcaattcagtttcaatcaaaatctcagcaggttattttgtgtacagtgagaaactcattctaaaatttatatatggaggcaagagacccagaatagccaatgtaacattgaaggaaaacaaagttggaggactgacacttcccaatgtcaagacatactataaagctaccatactgaagacagtgtggaattgacaaaaggaaagacaaatagatcaatggaacaaaatatagagcccagaaatagatccatgtaaacatagtcaattgatgtttgacaaataagcaaagcaatacatggagcaaagatagtcttttcagcaaatactgctggaacaatgcgacatccagacgctaaaaagtaaatctagatacagaccatgtacccttcatgaaaattaactcaaaatggatcaaagacctaaatgtataatgcaaaacaataaaactcctagaagataacataggaggaaatctagaggactatgaatatggcaatgactttttagatacaacaccaaaggcaagatccatgagagaaataattgataaactggacttcattaaaattaaaagcttcttgactgggcccagtggcacatatctgtaatcctagcactttgagaagccaagttaggtggatcacttgagctcaggagtttgagagcagcctgaccaacatggtgaaacctcatctctacaaaaaacacaaaaaaattagctgggcgtggtggctcacacctgcagtcccagctacttgggagcctgaggtgggaggattgcctgagaccaggaggttgcggctgcattgagcagagatcatgccactgcactccagcctgggtgacagagtgagaccctgtctcaaaacaaacaaacaaacaaacaaaccaaacgaaaacttctgctctgtgaaagactgttaagagaattagaagacaagccactgactgggagaaaatatttgtaaaaaacatacttgataaaggattattataaaaatatataaaatgctttaaaccataagaaaacaaacaacttgattaaataatgggcaaaagacctgaagagacacctcaccacagaagatatacagatctcaaataagcatatgaaagatgttcaaaatcatgagtctttcgggaattgcaaatcaaagcaatgagataccactacacacctattagagtggctaaattctagaacaatggcaacaccaaacgctgataggaatgcaaatggttcagccactttgacaggcagtttggaagtttcttgcataacgactcatacctttaccatatgatccaacaatcacgtttcttgatattcatggaaagcagttgaaaacttctgtttacacaaaaaactatacacagaagtttatagcagctttagtcataactgccaaaacttggaagcagccacagtatccgtcagtaggtgaatgggtaaacagtgctaaatccagacaatggagtatttttcagtgctaaaaagaaatgagttatcaagccgcgaaaagatgcgaaaaaacaaaatgcatattattaagtgaaaaaagccaatccacaaagcttacatacttcattattccaactaaatgacattttgtaaaaggcaaaactattggagacagcaaaaagattagtggttggtggggtttggggcaggggagtagaaatgaataggcaggacacagaggatttttagggcagtgaaaatactctgtatgatactgcagcggtggatacctgtccatatacatgtgtccaaatccataaaatatgcatcactaagagtgaatctttatgtaacaggtggactttgggtgttcatgatgtatcaatataggttccttgattgtaacaagtgcttctctctggcgagggatgttgataatggggaaagctatttatatatgggagcaggaattatataggaaatctctgtgtcattcctttcagtttcactgattgctctaaaaaagtgaagtcttaaaaattttactaaatcgccactttaccagattaaatgagaaaaacattatataactaccttaatagacgctgagagaattttaacgtatttctacattcagtgcttagtttgctaagatattttatcttagtgtattaataagaaaaaaattttattaacctaatgaatgataccttagaaaatttagggcaaacactgtacataattatgagacattggaagtataccactaactctcaaaagtcagtggtataagtacttctatttggtattttacaggaggtcccaatgcagaaaactatgaataaaattaaaagatggattgaaaagtgaacaataaaaccttccaggtgatatgattaaatctatggaaatcccaaatgtaacaagaggccaggcacagtgcccgtaatcccagcgctttgggacacccgaggagggaggattgcttgagttcaggagttcaagatcagcctgggcaacatggtgaaaccccgtctctacaaaaaatataaaaattagctgggtgtggttgttcacgcttgtagttttgcctacttgggaggctgagatgggaggattgctttagcccaggaggttgaggctgcagtgagccaagatcatgccactgcactccagcctgggtgactgagtgagaccctgtctcaaaaaaaaaaaaaaaaaaaaaaaaagtaacaacagggtaaatagataacctacagatgggagaaaatttttgcaaactaggcatctgacacaagtctaacatccaggatctataagaaacttaaacaaattgacaagaagaaaagcaatcccatttaaaaattggcaagggacatgaacagacacgtctcaaagaagacatacatgtggccaacaagcatatgaaaaaaatgctcaacatcactaatcatgggagaagtgcaaataaaaaccacagtgagatactatctcacaccagtcataatggctaacattacaaaatcaaaaaataacatactggcagggttgcagagaaaagagaacacttacactgctgaggggattgtaaattagttcagctattgtggaaagcagtgtggcaatttcttaaagaacttaaaattaccatgcaacccaacagtctcattattgggtatatacccaaaggtatataaatcattctaccataaagacacatgcacacatatgttcattacagcactattcccaagagcaaaaacatggaatcaacctaaatccccaacaacagtaaagaaaatgttgtacatatataacatggaatactacacaaacataaaaagtaatgaaatcatgtacttcgcagcaacatggttggagctggagggcattattctaagagaactaacacaggaacagaaaaccaaatactgcatgttctcacttataagtgggagctaaatattgagtatatatggacacaaagaagggaataataggcaccaggacctacttgagggtggaggatagcaggagggagaggatcaaaaaactacctatcaggtactatgcttattacctggatgatgagataatctgtacaccaaacccctgtgactcacaatttacttatataacaaacctgcacatgtatacatggacctaaaataaaagttaaaaaaaagattcaaatagagagtttagtatagttgtggatgtaagattaataatacaataacttagtgtatttttaaataccagaaacatagttgatacataggcataaaaatgccatttacaaaaagcacggaaatatgtatctagagctaactctaacaaaagtgtataaaagctttattgagaaacgtaaaaatttatggaaagatgtttaaaagacctaaattaataggtaatatggctttttatctcttctggttacagagctagacagtatatctcagacttctttctggttagttgtgaccttgtggcatagttctagatagtgaaatgtgagcaaaagtgatgtttaccactatcagacctgaactgtaaaaattgtttgcagctgatctttatgcactctttctggcttgttaatgaacatagccaattggaagttgacacagccctaagatggaagaaacctgcatttctgaatcactcctcagctacaaattaaatacacttccaatggaaattccagcagaactttttgtgaagcttggcaaactgattctaaaacttatgtagagtaaccaagggccaaaaatagacaacacatttctgaagataaacaaggagaacagtgtgggaataaattgctccctcagatatgagaactaattataatgctataactcaaactattagtggaggaaaggcaagttaagaccacagtgattttatactcacaggtggcaaaaaatataaagtttatattactaaatgatggtgaagatgtagagcggtcagaactcttatacaaaggggtggcaatatcatacaatccctttggaaaattttggcaatatctagtaaagttggagaaaccgtgtctttgacccagcatttttactcttgtatacatttctactgcgtaacctagaaaatgatgttaatagaagcatttttgcaataatacacgattggaaataacacacatctttcaacagcaaaatggacaaaaattcatgctatgttaatccaatggtgttataatacagcagtgaaaatagtggactatatagagtatagattaaattgacaaatataatttttcagtaaaaaagacatttgcccaagatcaaatatgttaagatttatctaaaatttaaaaaaactataaagtatttaaggatactagatttgtggataaattagaaatcaatgcaagcaaacggtgaacacaaaagtcagggtagtgggacctctgggcagtgagcaagagggcactgtgggaggaagacagaaggcttctgtgttggttctgtttagttattaaactgttggtaggtgcaggggtgtttttattctcatgctttataacttgtttatgtgtcacattattttgtatgtatcaattattttttaaattgaaaattaaaaataatcaccaactcaaaccatatttgtattgccagaccattattagccagaccattattagctgtacttgacagttaagtttctctcaccaatgtgcttaacacatgctgttgcttctcacttaaacaccttctacttcctcatcaatttatataagaagattccctttgaacctggttcaaattttactatagacaagtatccatgaccttcctaaacctcattatgtcttactaaaactgacgttaatgattatctcttcattcaattcttttttttttttcaccaaacacaggttgaacatctgtgttgcaaatgctataggggtacaaaatgtataggatacattgccttttcgaaggagctagatttattcacaactagacaccactggcaccagggttgtaattctggaatataaaaagtgttacagaacctcacaggagaagggaattggttctgtaaattcaagtaagacttcaaataagtggtggcatatgagatgagcctcaaaaaatatttcctgtttgtcctggggtatgcaagtcttcccttcatctcgcccaccttctactaaatactcttaggtatttcagctgaatctgtacaccaaacataaagagtgggtcattacttggaaagactcattcatcccatatcttagcctctttcactttcacttccactcaatcaaaaccatccattgttgcctcttttagtggatggacgttagtagcagaaagacattaaatcaactttggttgttggtggacaggttaaacagattccattttacccttgtctagacttgggtaaaggaagtacactaaaaatgccacataaatatttttttggaatggcatgtcaccgtgaatcatctggtttaattagactggccattttgtgtccatttttatgtgaccaagagaaccaatatctgacaaatttactgacccagagagaaatttctgggaaagagttcatacttactggataccagctccagcaagccacaatgcaaatttttctatttctgaatgatacaatcatcagtgcagatttagaatcattttaaaaccttctagtttattaaaatctttggagatgatgttttcagcatgatgtacgccatcgttaataatgagaatttaatagagacaagggcaaacctgtgtacaacttcctcaggtactcgtcttgaaacctcagttttgctagtagaatttgaaaaaaaagggggggtgctcttcttgaaacctcagttttgttagtagaatttgaaaaaaaaggggagggtgtctattttcttgtctcctagattgatccctttaaaacatgtcaggccatgccataccccttctgttaatcttactgtgatttcttagaaaagaaaaaaatctgaagttatttctgtggtttacaaacccacaatgctctcacttcttgcctctcttcccctcatccatttttgcccagccacgctggccttcttgccagttcttgatcctgccatgcataattccatctcaggccttttcactggctcttccttttggtggcacgactgccgctcggatgcttacagagctctcttacttacctcactgagatttctactcaaatctgctcaaatgctaccgcctcagtgagtctttttggtatatagtggtactcaataaatattcattgagttatttattaactttctgttgtctagaagagctggggtgaaaaaagactgagactttctggtagtatccatggtggtacaagacagacatagcgtgatttttatagaaaatatacaaaacttgatgtagaagatttggggccttctatattaggcacttgtcttaaataggtctgagtgtccagtttccgctgacgaaatggattagaccaaagttgatatgatcaaaggagataaagaaagcgatacatttacatcagtcttgaaattttaatataagtattgccatctctttaggccaatatgcaaatattacaaaagctaaaccagcaattcaaatggaaatataccactttcagagctagagaaattctcctaaatagctggtaagcttccagtgatccttatgaggagaacttaaatgcaattaataaagaaatgcgtcaaaagtctgttataaaccaacaaaacaatattttcatatttgtgtgcatacaaatgcagttataaacattactttcttgccttttaaatttcagtctttataaaattagctaggattttcatattggttctttctctgaggaatacgttgatgtgctagtctcagctgattacaaattttaattttgtaatattcccaaccacacagtagatataatcactgtgagtcattctgtgtggatgaaaaaatcagcaaaagcccacttcaaattagattgtttaaattccttttttccaataggaaaatccttgctgttgtgtgataaatactaaaagcaatcagtaaaatggtaaatttctaaggggtttatttaaggtaaattaagattttaaataccaatatttgaataaataaataggggctggattttatagttcaatgactcatactttttttagatgagggcttattttgttatgtgaaccttgtttatttattttttagccaagattgttgctgtattattgagaaaggctatgtgaaatgtgaaatgctgaagcccagaaacaatttgtgactgtttgtttgaggaaggtggaggatagttttattagaataatatctgtatatattggagatgaaaagtatttgctaaatacccctgtgaaagaaaaccaactgtgtgttttgcagggaaggattttgatcatatacactgcttcgattcaatgaggggcccttctgtagctccagctttttttctgtctattctgtgcacggagttctttgaatagggcctcagagaagaggaaaggtctattttgcgaaaacggaggacggtagcactgattcattaccctgggagagttcctaatcctcagtcagggccaagctcagatgtcacctgctaataacatcttccccaaccatcatctccctaatgttcttgacatatatgatttttgccctatgaatttatactttcttcaattatatcatgtattacatgatataatattaatcatgtataacatgatataatattaatcatgtataacatgatataatattaatcatgtttgtgtacattttgctaatgcactgaagtctgagagttaactttgtatctataggcctagcagaaagcctgaccttgactgggtgctgaatgtatgttttccgaataagtaagttaacgtagatactgcccaccactcaccttcctgagagacaagaagtgtatagagcccagacaaagttggcatgatattaccctgactttgctttcgactgccaaaatgtgtagggtgcagacattgtgtatgatggtttttaaagactgtccagagtattaagccccccttctcagcattagtccatttcccaaactctcaattttgtttttatttttacattcatgacggagctttacttgctcaggtgtccatcatttcttccttgtctcttcttcccaaataataccacttttgaattaaacatctgtttagtcctgcttgccctgagcttcaaagttgttgttatggatcccctttgctaagccattcctccatatcctctaggggtcgtgggcagagaggtatgtgcatggaactttccgcagtgcaactagatacacacctgaccctgcaaaggaatacacgaggtggtctctctgtctctttgtctgtctgtccgtctgtctgtctgtctctctctctctctctttgtgtgtgtgtgtgtgtgtgtgcatggtataaaaagaagggtggggtgtagaaagcagatttcagaggtaagagggaggcttaaagaggagcatgagttttatggtttctgcacaatttctttgctattctttaccaggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaagtatgtaccttcaagttttatgcagccacctcttcagagaaatgcaaaaataacctaactagtgataaagtgtatatactttaagagcgtaacattttgaaaatgttttcgattaagtatgatacctttttctcatgacattgtttcacatacagtgaacttgctggtttataacataaagaaaagattcaggaaggcaaaggaaaggaatatagaattgctgtggtttacctaacgtggcaagacctattactgtagataacaaattaagtatgaaggctttaataattcagcataataataagagaaggaatgaaagttctgggctgtgttattatttcctcttttttgtgtaatggagaaaacagcaatctgagttcagttaaatccattgatcaattaaactgaaattatccatcttcccaacatatcattaaccagaaatgctagaacaaagcaccatttctggatttaaattttaatcctcttgtcagctgctttctagaggtgctaatgaacagagacaagacactgcaggggttttagcagtgaaaattgaattgtcattcccaaagagattaaaggactgtgttagtgaatccaggatctcaaatatttaaatgcacatacacacattacacacctacgcaaacacacatacacaggctatatgtgatattacctcacatttgtaaagtactttacattttacaaagcacttacatgtgtattatgtagtttagttctgacaagcttgtgtggaagataagttaggaatttttattatgattattttatgatttacatttttattatgattattttatgatttacattttatagattagaaaaccaggtgagagagctacctgtccaagatcagtaacataatactagatcttctgactaaatgtgacgcaccttccttctatatgtgtttatgatacaatgcatgggcatacacacacagaattcaaatcaattttctttctggttttctagctccatttctggttaactgatttgatcatccttataaccctttataaccaaatattctcagtcttaatttcagagaggatttgcatttggaatggtttaagaaatactagaacgagtctattggtgaagatacaagtcttaacacatactttatgaaaagagtttcatagaatcttcttgaactttctacgctacaaatttcagtgttagactatctgtggctacattttacaccttgcattgagcaaacaaatatgaaagaccattttatattgtctgtaattattttcaaatattcattgcttaagattctgaaggaaggaagagaaaatattcagtcattcagagaaaagttgtttaagggcttgggcacaacgaattctatttcaaaaatttgtttctctgggaaatttgtcagctgcatttgtaagagatacatgctggcttctataggtaatcagatatgtatgtcagttttcaccagctggaataacatattagaaggagtaggtcataaagaagttgagaaattgttttgttttgtttgttgagacacggtgtcactctgtcacccaggctgcaatgaagtggtgtgatcactggtcactgcagcctccaccttctgggcccaagcaatcctcttgcttcagcctccagagtagatgggactacaggcacatgccaccatgcccagctaatttttaaaatttttttgcagaaatgggatcttactgtgttacccaggctgggctcaagctcctgggctcaagcagtccactcatctcagcttccaaaagtgctgagattacaagtgtgagccatcacactaggccaagaaactgtttttgtaacaattgttttgtttgacctgtaaatgattttctgggtagggcatgagaaaggttaactttaaatgccctgaactccagagcataggagggaaatgaaaattaaaaaaaaaaaaaaaaccaatagtgttaatatataaataagttgaatatatcataacaatgtttttggtttcctgcctcattttctttacaagtgaaatatagtttagtaaaaagttggtacactgactgtctcgtttattatctagagtgggaaagctcagtaacacaaggtctccagtgtgactaatatatagcaaaagtagttcatggaaagtcatctttaattttcaaaaattaaatggcataatagaataaatatgaaagtgtttttattatttatttatttttgagatggagtcttgctgtgttgcccaggctggagtgcagtgaggcagtctcagctcactgcaacctctgcctcccgagttcaagcgattctcctgcctcagcttcctgagtagctgggattataggtgcccaccactatgcccagctgatttttgtatttttagtagagacagggttttgtcatgttggccaggctggtctcgaacttctaacctcaggtaatcttcccgcctcattctctcaaagtgctaggattacaggcgtgagccaccatgcccggcctcgaaagtgtttttgaaagcaaagtatatgagttaaaatgttatccaaattcagtggccaattctcagtctttgtttactgatcttagcagtactttttaaaaaatactctcgggtgggtgttgtgactcgtgcctgtaatcccagcactttgggaggctgaggcgggcggatcacgaggtcaagaaattgagaccatcctggccaacatggtgaaactccgtctccactaaaaatacaaaaattagctgggcatggtggcgtgcacctgtagtcccagctacctgggaggctgaggcaggagaatcacttgaacccaggaggtggaggttgcagtgagccgagattgcaccactgcactccagcctgatgacagagtgagactccctctaaaataaatagataaataaataaataaatactctcttcacttggcttctagaattttcttccctgttcttttcccacattggtggctccttctcagtctccattgctagattcttttcatcttcctacctctcaacattggaccaattcagttcttgacctctattctctctttttacccactcactctcttgatgataccatcaattctcatagccataaatactgtctgatgactccgcaagtcacactttgagccttaacccctttcctaaatgcctatgtcataaatctaccttcctgcttagcatttccatttggatgtttaaaacataactcttgattcccttccccataacccgctctgcacaccaccccaactccgtctttctcctcttaggaaataactgcaacaaggccaaaacactttagcatcattcttgaattctttgtttctcccacatgccttattcaccccattagcaaactttgatggctttactatgtgtcttagtcagcttgggctgctatagcaaaatactataaactgggtggcttaagcagcaaacatttatttttcacagctgcaggttggaagtcccagatcaggttaccagggtggttgtgttatggtgagcatcctaatctgagttactgctgacttctccttgtatcctcacatggccaaaagccaggcaactagctccctagcttttccttagaatggcaccagtcccattcatgagggcttcacccttctgatttaattacctcccacaggcctcacctccaaataccatcacactgggattagggtttcaacaaatgaatttggtggaacacagacattcagcctattgcacagtctaagtagatgtagaatccagccatatctcactactttcaacattactatgctaggcaaggttactggggctccttgcccctgactttctcactaccatcatcatagtttatcctctacacattaggaaaaccttactctggctgctctaatttagatcatcctgctcagaatgtatccccaggtccttctgatagcccacttcatctatgcgatattgtcctcatctatgtactcccctcttgcttcctcactccaccagccacactgcccacttcactatgcaggacctcccaggcccactcctgactcatggcctttgtgcttcctgtcttagaactgtctgccataggtagtggtgcggtgcattcacttccttccctctctttattcatacgtctgcacaattgtcagcctatgagaggcttttcttatttactgtatctcaaaaaatcacaccttctctgtccctttctttattttattattagtgattatcgacacatgaccaattacctgtatgtgcatgtgtgtgtgtattgtgtgctaagcgatattaaattagtgagatgatattctaggatatatctaaatttgttgtaaaacaactgagacagagagaggaagaaatgaaagaagggagggaaggaaagaaggaagaaagaaaattcattccaaatgtgatctcagaccctgttattaatgtgtcctgttctggattttctctatctagcccacccttttctggggttgaccaaatgatgacctacaatttgattctcaaaggaattgaaaaaatggattttcccaggaagataacacgacgacctgaggatttgattcggaggctttgcaggtgagaatgacagtcagtaaccccttgtcttgaagaaagtctaaaggcttcggtttctgtttctacacattttaaaattaggtgcatatttactttttgtgctgtttttatataggcaaattatatttgaaggaagtcattttctgttttgcagtgtagggggttttagttgacctcacattacagaatcacagtacctacttatgaagtagtttaaaaaaagatctaaatttttcagacaacctttgggtatcatctttatctgttagagagcaaaataaaccataaaccttaggctaaaaaaggagtaatttactatttcagcaatgaaaaagaatgaagtcatatcattttcagcaacatggaaggaactgaaggtcattatcttaagtgaaataagccagacacaaaaagacaaatattcaatgttcttgtttctatgtaagagctaaaaaatttgaacacatggagatagaaaacggaaatgtagatatcagggactcggaagggagaggggaggctgaagggaagtgggttaaataggtaattatacagtaagataaaaggaataaattcaatgttcaaagaggacaattgaatacttaacaaaaatgtattatactcaggcaacggacatccttaataccctgagttgatcactaggcattatatacgcgtaacgaattttctcatgtgccacataaattttcacaatataaaataggagtaatttatttataataatcttgttattttgaaagaaaattagtcgtgataatgaagtgttattatatgacctctttccatcttcattttttaaaaagtgctcctctgttcttattttaaattaccccaacttctacttaccattaaaaataatttatcagagaataggagacttctggattttttttgtttaaaattcattttgctgtttttttcctatttgaacttttaaaaaagcattacaatttagtataatttagaactaaaaacgtagctatgggttgccagtatgcttctaagatttcagcttagatgtaaatgattctctaaagcttgccccggttttctcagcacagttggcaagatagtgcctgcttgttctttaaagtatttattcataccttatacacacatatatatatatacactccgaagtctaatttaactgtggctcctccagggaggaggtcgtgtcttttcacctccctaaactcagatgtctggtctacagtagcaacttcatgcatgttttttaatgaatgaatgaattaattaattaacaaatagatgttaagttttaatttaaaattttctgaattataattattataaatataattattataaattgccttttacaaattattgttttaggcaaaatccaacagaaaggctgggaaatctgaagaatggaataaatgacattaagaaacacaggtacataattatttctttgcccagaaaaatatagaaatttagagaacaatgtggtacttgcaaaagcttctctcaggaggccacaaaggtccctttccagactttcaaatttttctttatagtgctttgctttttatctgtgttttagtagatgtagttataataatcaatctcaaagtgatttgtctcatgctggaaattcgtatcaagaatgactgaagttacaaaagaagttacaaaatcacatcttcaagtcatagcaaattaactttttatccacttctgtctttattattctttaggtttttttgtttgtttgtttgtttgtttgtttttcttatgacagagtctcaccctgttgcccaggctggagtgcaatgccacgatcttggctcattgcaatctccacctcctgggttcaaatgagtctcctgcctcagcctccggaggagctgggattacaggcacctgccaccacacccagctgatttttgtatttttagtagagacagggtttcaccatgttggccaggctggtctcaaactcctgacctcatgatccacctgcctcagcctcccaaagtgctgggattataggcacaagccaccatgcctgatcctagtatgtatttttgttgatctatactagctgtacatatttattatactttgaaatatcaacttggaatctgtgaaggaattacattctaatttgggcatttaacttgtaagtaaaagaagataacattgttgttgccagtattcaagaggatggttcacctaaatcaactgtgaaaaagtattctatttcaggtttaattaatatatatttattttaaatataattttcctttgaatatcctcaaattcttaaccctcatattatattttactttttgggtaatggacattgatttcactggtttccacagaacctcaaaccatgctttatccttttgcagtaatctgacatgtactttttcagttctgtgaatttttaaagctggcctttagagccattgataaccttcataagacggcctgttgtggggtggggggagcggggagggatagcattaggagatatgcctaatgtaaatgatgagttaatgggtgcagcacaccaacatggcacatgtatagatacgtaacacacctgcacgttgtgcacatgtaccctagaacttaaagtataataataaaaaaaagacatcctctctgatgtattaaatattcaaatgtggcggttcaaaccttcaggttttggcttgttaaatcagtgcttggataactactgccatctttaagatgttttcattttgctcatgattcacagataaaaaaattacttttaagaatatgtagatagtgcaaaatacatttgagacttttattattgaaatcctttgactacacagatatgttcacttttagaaatgaaaacacctcattcctttatagatcttttcactgaagaaataggggcacatcaacatggtatgaacataaagggagaagggctgttgctgaatagaaatgctattcatgtttcttaacagtagcagtacagcttcaaaacaaaaacaaaaaatcaacctgccaattttactgtatgtgttaatgaacttactcgacataaagccatgtattcaatactgtaaattcatattgagctctgccttaaggatgtttttagtaagaaagggagggaggaaacataggaaggaaagaaagataaagacacatgtagattttatagaatcaaaatgcttgtactattctaatgttctgtgctatcctttggattgccttcagctgtaaagctcattatttgtcttagattctaatttattttcttccagcgctccatgctgttatcacaatttcttttctcatcatgaaatgacacagaaacacactattcatattgaggaaacaagtgctctgtcaattaaagccattcttccaatatacattcttcctttctctcattatggaaggttcttcatgttatgctttggcatagctgggaaatagaagtgatatatctgttaacaggctccagcttagcttttacttctttacctgaggctcatttaaatgtagctgtcaaattgtcattagatgcacatgcaaattgctgctaaaggattttctcacctcagcatagcaataaagaattttgaatttccttccctgtagggattaatttgtctattccttcttaataggcaacattgtctttgctatatgtaatatagactctgagtgcagagtatagagttgattaataagatataccaaatttacggtgtcttcggttgtgtagatgctcagaagcattttttcattctattttcatagtgctttttaagctataaagctgaaggtggggaacatcagaaaacttgatctttctctccaaatgggagtgtttaaaaaccttccacaagtctttaagctgcgtagcttctctactcagtatattcttagagttaaaaacaaacaaacaaacaaaaaagcttctttctaaagtttggcatcagattttctcagtctcttctaaagtaaaactttttttttcttagagaaccagtcactttaattttgttttttttttcttttttctatttgtctctctttctttttttttattatattttaagttttagggtacatgtgcacaacgtgcatgttagttacatatgtatacatgtgccatgttggtgtgctgcactcagtaactcgtcatttaacattaggtatatcaccaaatgccatacctcccccctccccccaccccacaacaggccccggtgtgtgatgttcccattcctgggtccatgtgttctcattgttcaattcccatctatgagtgagaacatgaagtatttggttttttgtccttgcaatagtttgctgagaatgatggtttccagcttcatccacgtccctacaaaggacatgaactcatcattttttatggctgcatagtgttccatggtatatatgtgccacattttcttaatccagtctatcattgttggacatttgggttggttccatgtctttgctattgtgaatagtgccccaataaacgtacgtgtgcatgtgtttttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggctttgatttgcatttctctgatggccagtgatgatgagcattttttcatatgtcttttggctgcataaatgtcttcttttgagaagtgtctgttcatatccttcgcccacttgttgatgggcttgtttgttttttcttgtaaatttgtttgagttcattgtagattctggatattagccctttgtcagatgagtagattgcagaaatgttctcccattctgtaggttgcctgttcactctgatggtagtttcttttgctgtgcagaagctctttagtttaattagatctcatttgtcaattttggcttttgttgccattgcttttggtgttttagacatgaagtccttgcccacgcctatgtcctgaatggtattgcctagaatttttcttctagggtttttatggttctaggtctaacgtttaagtctttaatccatcttgaattaatttttgtataaggtgtaaggaagggatccagtttcagctttctacatatggctagccagttttcccagcaccatttattaaatagagaatcgtttccccatttcttgtttttgtcaggtttgtcaaagatcagatggttgtagatgtgcggcattatttctgagggctctgttctgttccattggtctgcatctctgttttggtaccagtaacatgctgtttttgttactgtagccttgtagtatagtttgaagtcaggtagcgtgatgcctccacctttgttcttttggcttaggattgacttggcaatccgggctcttttttggttccatatgaactttaaagtagttttttccaattttgtgaagaaagtcattggtagcttgatggagatggcattgaatctataaattaccttgggcagtatggccattttcacgatattgattcttcctaccaatgagcatggaatgttcttccatttgtttgtatcctcttttatttcatcgagcagtggtttgtagttctccttgaagaggttcttcacatgccttgtaagttggattcctgggtattttattctctttgaagcaattgtgaatgggagttcactcatgatttggctctctttttgtctgttattggtgtttaagaatgcttgtgatttttgcacattgattttgtatcctgagactttgctgaagttgcctatgagcttaaggagattttgggctgagacagtggggtttcctagatacacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcagagggaatgcttccagtttttgcccattcagtatgatattggctgtgggtttgtcatagatagctcttattattttgagatacgtcccatcaatacctcatttattgagagtttttagcatgaagcgttgttgaattttgtcaaaggccttttctgcatctattgagataatcaagtggtttttgtccttggttctgtttatatgctggattatgtttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttgttgttgtgtctctgccaggctttggtattttaaaacaatacagttgtatctatctgtccattctatattaaataatctttctcagaaatagctacagagctctgctatcttgtgtctaagagctaatttaaaactaggcaccagtcatgtctcccaacacctatctcaaaagaaggctgatatacttgtaaggtacaatgacatctttcctgacaggaagaggaaacatttgtttcaggttcaggcataccttgttttatcccactttgctttacttactgcaccttgcagatattttattttttaccaattgaaggtttgtgataaccctgcatcaagcaagtctatcagggccatttttccaacaacatttgctcactttgtgtgtctgtgttacattttggtaattcttacaatattttacacttttcattatttttatatctattatagtgatctgtgatcattgatctttgatgttagtattgtaattttgatggcaccacaaaccgcagccatataagatgccaaacttcatcgatatatgttgtgtgttctgatgactttatcgatggcccattttcccatctctccctctactcagacctccctatttcctgagacacaacagtattgaaatcaggccaattaataaccctacaatggcctctaagtattgaagtaaaagaaacagtctcaagtctctcactttaaataaaaagctagaaattattaagcttagtgaagaaggcatatcaaaagctgagatagactgaaagctaggcctcctgtgccaattagtcaagttttgaatccaaaggaaagtttcttgaaggaaattaaaggtgttactccagtgaacacacatgtattattcagggttctatagaggtatagaactaatggaatagatatataaaagggagtttattaactcacacgatcacaaggtcccacaataggctgcaggctgaggagcaaggagagcagtctgagttccaaaactgaagaacttcgagtccgatgttcgagggcaagaagcatccagtacaggagaaagatgtagactgggaggctaggccagtctctcttttcacatttttctgcctgcttatattctagccgcactggcagctaattaggttgtgcccactgagattacgggtgggtctgcctttcccagcccactaacacaaatgttaatctcttttggcaacaccttcacaaacacacccaagatcagtacttcaatccaatcaacttgcctctcattattaaccatcacaatgcacatggtaagaaagcaaaactggcttattgctgatatggaacaaattttagtagtctttacagagatcaaaccagacacaacatttctttaacccaaagtctaatccagagcaaaattctaaccctagtcaactctatgaaggctgagagaggtgaggtagctgaagaagaaaagtcagaagctgtcagaaattggttcatgaagtttaagaaaaaaagccatctccataacttaaaagggcaaggtgaagaagcaagtgctgatatagaagctccagcaagttatccagaagattcagctaagatcactgatgaaagtgtctacataaacaacagattttcagtgaagaataaattgccttacattgaaagaagatactgtctaggattttcctagctagagaggagaagctaatatctagcttcaaagctccgaagaacagattaactctcttattaggaatacagctggtgacttgaagtcaatgctcatttgccattctaaaaatcctaaggcccttaagaatgatgctaaatctactctgccggtgctttataaattgaacaaagcctgaatgacaccatatctgtttacagaatggtttactgaatattttaagcctactcttgagacctcctgctcggaataaaatatttctttcaaatattactgttcattgacaatgcacctagtcaccaaagagctctgatggaaatgtacaaggagattaatatattttcatggctgttaacatccattctgcagcccaggaaccaaggagtatttatttttaattttaatgtttttgagggtctcattctgttacccaggctggagtgcagtggcacaaacatggctcactgcagcctaaacctcaaggaataattttgatgaatttaaagtcttgttattgagaaatacattttgtaaggctatagctgccatagtgattcctttgatggctctgggcaaagtgagttgaaaaccttctgtaaagaattcaccattctaaatgccattataaacatttgtgatttatcagaggaggttaaaatagcaacatcaataggagtctggaaaaagttgatcctaacgctcataaatggctttgggaagttgaagacttaattggagaaagtaaatgcagatgtgttagaaatatcaatagaactagaatttgaattgaagcctgaacatacaactgaatgttgcaatctaatgatgaaacttgaacagatgaggagttgcttcttatggatgagcaaagaaagtggtttcttgaaatctaatctacttctggcaaagatgctgtgaatattgttgaaatgacaacaaaggatttaaatattacataaacttacttagttgataatgtagtagcagggtttgaaagaattgacctcaatttatttatttatttgattatttatttattttagagtctcactgtcacccaggctggagtgcagtggtgtgattagggcttactgcagccttgaattcctgggctcaagtgatcttcctgccttagcctcctgagtagctggaactatgggtgcatgccaccatgtctggataattttttaacattttttttgtagagatgggtgtcttgccatgttacccaaactcctggcctcaagagatcctcccacattagcctcccaaagtgctaggattgtaggcatgagccactatgcccagcctaacctcagttttaaaagaagttctactctgcataaaatgctatcaaacagtatcacatactatagagaacttttatgaaatgaaaagttaatcaatacagcaaactttatcattgtcttattttaagaaattaccacagcctctccaaccttcagcgacccctgcccttgtcagtcagcagccatcaacaccaaggcatgaccttccacctttttgaccatagcaaaaagactatgattcattgaaggctcagatgattgttagcatttttagcaataaagtattttaaaattatgtacatttttagacataatgcggttgtacacttaatacactgcagtttagtttaaacataacttttatatgcactgggaactccaaaatttgtgtgacttgccttattacagtggtttggatctgaaccttcaatatctccaaggtatgcctgtattttaacattgtttttgatatttctagtctttgaaattactttcaagaatagactctatgagtcttctgaaatgaagaagcagtttatgtgctgttgctgctaatatttctctggtgaatattttttacacaccactgcatgctggcgcttgcattacttaaaatgtggttagtgtcaaaaggccatgtgttaagtgaatagccatgcatgttaagtaagtactgtgataagtcagattgtaacaagtactctgtaagcaacacatgggctgtttgattcagtagagtgatggtaatgatttttattaatatttatgaggcacctcggggtagagagcattgtaaaatatgttaaaaggaattgttgccatatttggtgacaaaagaaaagaatccatagaactgtgtacctagaaatccctaaaagtggaggctcagtctatgcaaaaaagcaatgggtagaacaaagagaggacttctgtggttttacagcaagggcagaggagggatataaaacagctgggttgctgtctgactctcactttttgactggagtttcagcagcttatggcaaaatgatattttggtttagaatagcatctgaaatggaatgcactagtgtctgctctctgtttttcgttccttttctattgctaagcttagacttgtaataggaaatccagtcaagcactaaaccaaacccaagtctggggatgagaagagagtgagaaaggtggaagatcctaacttctggtatggccaacagacagagcaatgtgacagccttctgaaagtctccctgcctttaatcacagggacgcatcaccatcccattctggcccctgtggtctttctttatctctaaagcagccagaagtatcttttgaaaagtagctggtgtcatttacttagagctttctgattctttcactacacgtagaaatcttgattccttactgtgcctgcaaagctgtacgtgatctagcctctggctctttctcagacatcattttttttttctagtttcctctgcattcactacacttcagctcattccttccatctggaagggctttgccacagatcctcccatggttcccccttctcttcattctggctctttcaaatatcactttttcaaatacttccctagctataagcagcccttcccaacctgttcctattcccgacatcatctaccactttattctcttttatcttccttgtacttactactgtctgaaattaatttaataatttatattgtttacttgacttttttctgtcacctcccagcaaaacaaaaacatcttaaaaccttccacaagtctttaagctgtgtagcttctctactcagtatattcttagaattaaaaaacaaacaaacaaacaaacaaatttcttctaaagtttggcatcagattttcttagtcccttctaaagtaaaacttttttttttcttagagaactagtcactttaattttgtatttaaaaacaatacagttgtatgtatctgtccattctatattaaataatctttcccaaaaatagctacagagctctggtatcttgtatgtaagagctaatttaaaactaggcaccagtcatgtctcccaacacctaccttaaaagaaggctgatatacttgtagggtacaactaaatctttcctgacaggaagaggaaacatttgtttcagttacaggcataccttatttgatcgcactttgctttacttactgcaccttgcagatattttatcttttacaaattgaaggtttgtgataaccctgcatcaagcaagtctatcagggccattttttgatgcctgagaccaagctgactttccataaatatcggttggctggctgagctgacctcagtgtgccagtagaaaagatcagtggctatagaacagcatgatttcatgttcttattataagatcctgagagacagagtagattgtttctattcaagagaaatgaggcctcctgactcctggtgttatatttctagaccatcaagcttgaaatatatacttgaaatatatgaagatcagatcagcccttttagatgagtgatgcataagcaatgatgaaagaacttcctcttaatcccatattttcacagattactgtaaaatactttttctgcttaagtgtgtttctttgcagagtcattcaatcactcaacaaaaatttattgagcccctgtcccatatcaagcactactccaagtgctggggcacagagaaaaggaaatagataaaaatctctgccctcatggagcttgctttctagtggggagatagaaagtaaacatgataactaagtcaagtagtatgttagatagctatagatgctaagggggtaagataaagtagggaaggaggataagaagcttgtgtgtgtgtgtgtgtgtgtgtgtgtgtgtgtgtgtgtgttggtgggggagagtttcaattttagattggatggccaaggaagatctcactgagatgaactttgagaaaagacatgaaggtgttgagagaataagacatggaaatctagagaaagaacaatccagccttgagtacaaaggccttaaagtgggaacaaccctagttggttaggagaatagtgagaagataaatgagttaagggagaaagaaagagaaaagtaatacagtggtaaggtaatggaaggatggtggtagaaacaatgattctataaagccttataggttacagcaaagacacggaacagactttgccttttacactgagtaagatggaaaaggtggggaagtattgaaccgaggcatgttgtgacctgacttatgctataaacgaccagtcttgctgctaagttatctccagcacaaaagtacggctggttccttgctagtagagtgaaggtattgaagactggccagatactgaatatagatagaatgtgaagctagcactgacaggatttgatcatggactcagataggatataaggcaaagaacaactacaagagctttggtttgagcaactggaagaattgagatgaggttggtggagaacattttaagcttctgttcagacatgatacatgccagatgcctattagacatctaatagtgagaagatgaataagaattgtagaccttagcctgtaagctgatggaggggtcttggttggaaatagaaatttgggaataattagcatataagtgctatttaaagccatgacagataacttgacatgctaatagtttatcatccaagtaatattcctttttgtcgtctctttctttctcccttccttccttccttccttccttccttccttccttccttccttcctttctcatttctcaggtggttaaatggttttaattgggagggactgaaagcacggagccttccatcacctttgcaaagagaggtattgtatttattatattacttttttatttttttcccagggatttgtttttgtacacagattttagatgtgtgtatgtatatgcccataacagattttgggtgtttttttttaaagcagtttttattttaatttaagtgagtttgtcttataattgtgattatagggactaaatagtactgcctagctgatggatattaacttacctgtcaagaaccaaatacatgtcagtgccacttaagtcccaaagtagtcagtgttgttcaggctgacaaatgactgtataaatttgatgtgaacaatgtatgtaacttaagattttctaatagccattttaaaaaggtgaaaaaaaaggtgaaaataattttaattatcataatacctccaaaatattatttcaatatgtaatcaatataaaatattagtgagataggttatgtttatttttccataataaattttctaaatcccaagtgaattttactgttacagcacatctcagttcagaagagcgacatttcaagtgctcagtcacttcgtgttgctaatggttttgttattggatagtgcagctctagaggcagcagaacttcagctaacatgggaggaagaatgactcaggaatgatctaggtcaacatactactaagtttatgttagtgttttttccaaaagattgcaaagatctatatttcctcttatacattggtagattgctatctgactttttttcatcaaagtgtagttgtggagaatatgatttccagtatgttgtaaatattgacattttaaaataaaacactaggccaggcatggtggctcacgcctgtaatcctagcactttaggaggccgaggcgggcggatcacgaggtcaggagatcgagaccatcctggctaacatggtgaaaccctgtctctactaaaaataaaaaaaaattagccgggcatggtggcgggcacctgtcatcccagctactcaggaggctgaggcaggagaatggcgtgaactcaggaggtggagcttgcagtgagccgagatcacgccactgcactccagcctggatgacagagcaagactccgtctcaaaaaataataataataataataataaaaacactactgttacttcattcctttaaacatgtctactataatctaaataccattgagatttaatacctatctgccacttataaagtttgggcagaaatattgtatcactccttttcatcatatcatcatattttcattctatgttccctataagatttcatcctaatgtaaaatgcttctatgcttgacaatctttcttgatcattctttaaatgccttcgaattttagatttaaaatttgtgataacaccagtatttcttctgaattctgttataattacatttttatggcatgcagtgtcaaatggcataaatatattatgaatatctaatggtaattattaaataaacattttttgagaagaaattatttcatgtatctatggatagatattatttattagaagaatgggatcagattcagcatcaattctattcctttttaaaatgattgttatgcagatacaaattctaagaattgtgttctcacatatataagtgggaatggaaggttttattacagcgatgtcactttgagctccttctgaatgatctctagctctgttcctccaccacattatgatctatcataaataatatttttaatgatttttcagctgatcattcagttaggcattacttacatttgtttgaaagcagagttagaaatcattttatttgtgaaataatttaataccagcataatttcactctctcaacagggtcactaatattttgaattgttccttttttggcattctgaatactttatatggatcaattaaccataaaaatttcaggattggtgagaaacttatataatggaagaagaacgctagcagattttgattttaaaagagttttcaattaaaaaaataaatagacatcatttctgtcacttattttttttttttgagagaaagtctcactctgttacccaggctggagtgcagtggtgtgatctcagctcactgcaaccttcacctctcaggttcaagtgattctcctgcctcagcctccaaagtagatgggatcacaggtgtgtgccaccatgccaaactaatttttgtatttttaatagagatggagtttcaccacattggccaggctggtctcgaactcctgacttcaggtgatctgcttgtcttggcctcccaaagtgctgggattacaggcgtgagccacagcgcctggcctatttctgaactttttctttaggaaaactcttcatgccaggtagttactattgaatgttatctggtgaccaaatctatttggttgtaaagagaagatctcatgaggctgagactaggactcaagaatgataattggtcatttttttcttgtatgtaacttccaagtggctgcagtatgaaatcagtgttctgaaataaaaaacattacccatatgtgatagcatgcttggtcaacattattcttccttttgttttaattatttctatattagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcgctttttaaagacatctgagtcatggatgtgtttataaatttagattgttaagacaggcaagccaccagaaaagtgataggatttcagaagtaaaagggacaacagcatccctcctatcccttccttgcactctcccaaataataagtaggatagtttcaatagcatgggacctagtacctaagaacttcactggtgaatggttgtatgtattgaccatgatcattcccttaccctccttccaaaatgaatgagaagcagagacttttctgtattttttaaatctagcagagtaaaaatactgtataagttccgggattattcaagcttctggttatattttcatatgttaatgttctatgtcaaaaggaacctctacccagtccccactcataatttcatcatccagaaaaaagccagctatatgcttccttaatgagttaagctagataagtgaagcccaatccagaaaggtgcatccttaacaaattagatttccacatttataatccttttgctgaaccaaagagtttttgtttcctggagctgtatttttaaagattatgtattgtacatagaataatcatttttaataggattgacataacctgcttaaagaatttctaagagtttttaaagatttttatttgaatttggttggtttgtactgtatgtttttccatgtatatatttttaaatttccaacctataaagatagaaaatttatgtattgggtggatattagaactatacagttataataggaatgatattctcaaagcagatcaatagttgtaatttttaaaaccctacatatatagaaataaccaagttagagtactacaggtttatttttcctgtgattgaccatgtcaatgtgttatcctcccatgtgattttttattgtttccttagagtactttaaaagatgaagaaatgagagactgaaccattgaataatcccaactccaccatttcctaactgagtgactctgggaaagtgatttagcttttttgagtactagctttctcattcatagaaaaaggcagagtaaagtaatatttacttagaggtttgtttcagggattaagttatgtagagagtcttttgcccggtatctgtgaaataaccattgctgcatagacgggagctactgttactgtctctattaaaattaaaggggccttaataaccatttagtcctgaatcttatgtatcattggtatctgtatgcagaattgtacttatcaaatccagtatctgtcttttttttcttttaaatcatgaagtaaaaatgattgaccaaaaacttcggtgtatgagatgaagggttaaccttcactaaagtgaagtgcttcgttaagttaacctaaattttaatttttatgaattaaagatacacacatacagggaaatatggaaaattaccctcatatatgcatacctatcattttcctaatcattaaatcattcccaatctctctagttaggatgtaaacttaatttttcatccttgagcttcttccaagtgggaccaacttttcataattataggttcttaatgccttctttaaatataaacacatctgaagaaaagacagtgtagtagtgaaaagtaagagatttagagaagaacaagaaaaaaaaaaaacctgggcttgaattccagctctgcccagatttgtgtaaccttgaacattaaacctcagctttactcttctggaacttggagatatacatttaaagctttgaaatcttgcgccagaatattattactagtaggtcattcgtaataaacatttgaaaataagtatatatctatatttctttgggcacaataacaaatccttgttctttattgctaggcattgtactaggagtatttatatctattaagtcattcacacaagatactaaaataattataaatacacagatagttgactttattcaaaatttttttatttattggccttaaatatgcattttttttacaaagag

SEQ ID NO: 13916 - DNA, 23645 bp, Human
tataacagtctattgcttttgatcgaatcttgatttcaaggagcagttggaggacaactgaggaagtgtgaatgtgtattagatgataaagaggaacttctattaattgtgttatgttgatgacatatactatggttatatagaaaagtatcctgaaattttagagatgcctatttaagtatttaaaggtgaaatatcctgatattggtatttaccttaaaatattttttaaaaagtaaatacggcaaaattacttaaagtgttaagtctgggtgttacagactgcatgtctgcgtcccctcaaagttcatatattgaaccctaacccccaagggaatggaattaaaaggtgggcctttggagatgactggatttagatgaggtcacaagggtagagcctgcatgatgaacagggtgggaccgtatctcaaaaaaaaaaagaggaagagaagtttctattagagcttgctctatctgctttgtgaggatagaggcagtttcgcaaaccaagaagaggaccctcactagaatctgaccatgccagcaccttgatcttgaacttcccagcctccagaactgtgagaaataaatttctgtcatttaaaccacccagtctactgcactttatatggcagtccaagcagactaagacattagataatgcatatacaggtattccttaatagaactaaagagagtaactgtatcaatattagtatgagtcctacctaaaatacctcttccttcacttgcagaaacactggattagattattccaattgcctcagtgttcttccacccttacccaatccagtccaatctccggagaaaaatatgatcacatcactagcctgcacagcattcaatcaaccacctctttaatggggaaaagtgtaaattccatagtgtagccatataaggcttttcgagatctgcccagactccttgagccactctatatatacttcactcatttaaaactcagcgacaatcctacaagtaggtgaaattattattccctctttacagataagtaaaggggaatataagtaaataacttgcccaagaccacacggttggtaagtggccctgcttgactttaaattttgacagtctgatatatccataaaccagataaatccataattttaaccacaatattattctgtgcccggtacagtgtaggtgctcaataaatgcttgctagatgagtagtgtggaagagcttagctctcctttttcacctgatcccaaaagaggagtgaatcctaaccaccctgtttctcttaagagtcaagtcaagtcagagctgatgactgttactggcattgcccgggcgtctagtattgcagtatccccgcccctgtgaggggtgcaaaaccttttctgatttcatttctttggtggtggggatcggactggggaggaatgaggggtcgcagaacacaggctgcccgctgggcccgggggctgcggggagggacggctctcgtgcgctgagtagttgactcgcccactgcagacctcagaagcctcacgacccggaccccgggagccccagccccgcgccctcagccccgcgtccaggacctgatcctggattgccaggggccctcctgggaagacggggccactccgggcccactcacctcgtcccggcactgcttctggcacatctggcaataccagcgtagcttctgcagccccttggacttgatcctgttggcgatagccttgggagtaagaaaatccgacttccccatggcgaccacggcagcgatcactttctggaccccagtactcagccagccggaaacggaaccgggctggcggcggtgggcgggacaaatcccagctgagaggcggaaggaggtggggcctgggaagactgggttgcaacggtcgcgagactcccctcgccgtagcgcgaagaaacgagactgaagaagagagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggtatggcagcttgcgggaagatcggcaggaccgcaagggatggaagagcttgggcacggggcagggaggaggagatgggcgcgggggcagatctggggtcgcagggcctagctgggcccctggcccgtcggaggcgccgggtagcgggggctgcaggaagcggctctgaggtcgggcaaggtgtgcgcagggccgggctccggcggagcaaggtcccgcccggttccctgaggtcggagggccacctgggacctcgggactgcggcctgagtccaaattgacgtctgggcggtcttgagttccctcagctaatcagcacttcctgagcttccacttccactgcaagccaggcccccagtctcagggcctgcaaggtgacgggagcctgagcaatagcccaggggaaggttaagtcgtgctttttgtccttgacgccctttgaaaccctctagtgctggacagagtgaccctttaagattcgatcgagtcagagagcgcggccgtcgagcacctcccgtgttgcagacgctttgctgggtgctgcaacagcaaaggcgaacatcctagatgcctctgagggtggttttggtgcagaagggaccgtacagatctgtctgagggcggggaagggaaggacacctagcactaccttgaaaccacttgctgaaaccgtaaccctgcaaggtcatgaaattgcccccaggtcctgggggaggagttcggtgggcttttaagtggcatttgttaactgacatgcaactaaagggtgccacgagcctcgagaattttaaacattagttccgggtagggggacctgggctgggggaagtgcatattagaaggcccgggaatgggcaggtaaaagttggtttgtgggtggtgctgttcagttttgaagcttgacggaatctggaagaattccagacacgctgctaaggggattctaggctgtgtcgtagcaattccctgctcttaacagtgtggaggatttctaaggcgctacagtgctaaactagattttcgtatcctaatttatatgaagggaccataaagcattagttgaaataaataggtttttcattaagcaaataactgatagtaatatacgagattttcagaatgatatctgatgtgaattagccacataaaatttttggtggcttggccttggaagtcagatttttttttctctaatatggaaaaagaacattcatgggaattaaaaggtcactgtagttgaattctcagttgtatagattgtcccacttgttaaccactcagcagacattagctgagtgcttccactccacccggtggtacttggaaagtgcccaaatgtgatggtgagcaaatagataaggtctcagtcagtttcctgggacagtgcctggcatgcagtggtgctctgcgaacatcagctctcctggccttaccttcttgccacgcattaatgttatctgtcagtatttttacaaccttagtttctaagttgatctttaaaaaagtggaaatagtttctgaaacaaagacaatattttacaaaaaattttagaaatatctttttttaaagcacctgtaagataatttgaagctcttttagtgaaggattgttttaaataagagctctcagttcaagacaactactgttaggagcttaaatcggaaccacaatcagcatataaaggtcctaatcctgaccttaatccctttggaatattggttttataaatcatcaatcaacagtgttccactatgaaagcatattctgtcttcttcttttcatgtattccttcactgctggtgcttaatgtctttccttcctcttctgccatttctctttccatgaattataattgccttttgaattcagaaattaaaaccactccacagaattaatttggaaggggaagaaaagacctttgtcttaacgaaccatgaagaggcatatttccatgcttctgtcttgattactggaagttttttaaagtacaatttgttattttagtttttgttttcagagaggctaccatgctaacataaaaacattaggcttacttaaattcacagtggttattttaatagttgttagggtatcggcaaaatactctaacgttttgaaaattaaaccttttttttaaagcagcatataagaaaatggaaattaaaaatttgagagaaagaatcccggattttactgtcttcaaatttgggaaaaacatttctatttcttagagttcagtagtctctaaaatggaactgttttttaataacgtgtcagtagtcataaactacagataccgataaggagatggcatttcaggagagaaaagacaaattgtcatctgagaccatgagggcagatatttactaataaatgtaaaaaatgtgaggcagcagagtgtagtactgtatgaagagagagactctgtagccagccctgaagggctgcattcagacggcagggattgaattctgattgccacttagcagctctgtgaccttgggcaggttactcagtgtctgtcccaccagttcctcatctgtcaaatatatgcaataaaagtgcacaattcagtgggttagtgtgaggattagagtatttgcaaagcatgtaggacaatgggagaaatgctgatagggatccaaatgctgtatatcagtagagaaatgaagagtttttaagtacagtttctacatcaaatgtaatgtaagaagattgcttggacttgcgaaaagaggaaaagaagatgcagtcgggctaggcgcagtggctcacgtctgtaatcccagcattttgagaggccgaggcgggcggatcacaaggtcaggagatcaagaccatactggccaacatggtgaaaccctgtctgtactaaaaatacaaaaattacccagacgtggtggtacgcacctgtagtcccagctactcgggaggctgaggcaggagaattgcttgaacccgggaggcggaggttgcagtgagctgagatcgtgccactgcatttcagcctggcgacacagtgagactccatctcaaaaacaaaaaaaaaaagatgatgcagtcatgggtgtgggttaggtaagtgtgaaggagtcagtttttgctggtggcaggtaatggacttttacacgcttaatatcagaattagagtcacttcataattttcgttgagaattagccaatattgcttgctttttaagtttttatgtatcttaatatactccttaaaaatctctcaaacaatagtttcttggaagggtgtcattcctgactccctcctccactgccttcgtcagctgttataacagcgctgtggaatcatggtagatagtggtaatccacggtccatttgattctccctccactgtgtttcttagtctcccgaggatctcaggacgtgcaatgattcagagctttatctcctcatttgcaaaacttttatatttaataaaggaagctatccctaaagagagttcaattagctcatcactgttcttactcaaattgtacctaacaattaaagtagtaacatagacgtcttcagaattaaatgaaagctaaacatgagagtgctttaaaacacatgaaattagggcaaatgcgtagcattatcacaaaagatgctacctcttcatacctctgacttggagtacttaaggaaaccaaaacattctgtgtttgtccaaatatggtattcaattcaaatttataccatatggtattctctgactagaaacttgtgtcagttgaagtgtctgcctaaaacaataatatccaagagtgacttgttataaccaataaattttgtgttcagggagaaaagtcattactacaccaaaaaaggaaggttgaccaaaaactggtattacttttcaagtgtgattatgaaaagctgttgtagtagaacagtcatggcaggtagtttgtgctctgaaataacagagcttgtcaggatttgccagcttttatcttttcctttagtagattcattcttaaaaccaaacctaatatttttcgtgctgtagtgggagaatcacctgagcccaggaagttgagactgcaggaagccatgatcacaccactgcactatagcctgggtgaggggagtgagaccctgtcttcaaaccgcaaaaaacaaagatccactctttttgttatacagttccacggatttggacaaatgcataatgacatgtatccaccattacaatatcatgccaaagagcttcactgccctaaaaatccctcctctactctccccaaaaccctgacaaccacttctctcaactattgctagatcctcggcttttctggcatgtcacatagccagaatcatacagtatttgctttttttcagatggccttctctcccttagcagtatgcacttaaggtttctccatgcctttttataacttaatagctcctttgtggttttggtgaataatagtccattgtatggatgtatcagagttagattatccattcatgtattgaaggacatctgggttgcttccaacttttggcatcatgaatgaagctgctttacatgctcttgtgtaggttttatgtggacataacatttcatctcagttgggtaagttaagactaggtttaggtttgtaaaaagctaccagaacatcttcccaagtggctgtgtactattttacattctgccagccatcaatgagagttccttttgctccacatcctcatcatcatttgctggtcagtttcttgggttttatccattcttgcaggtgtgtagtgatatcttactgttttaacttgcagttctctaatgacatgatactgagcatcatcttatgtgctttttgccatctggttggtttttgtttttgttttttgagacagagtcttgctctgtcatccaggtggaatgcaatggcacgatctctgctcaccacaacctccacctcctgggttcaagcgattcttctgcctcagcctcctgagtagctgggattacaggtgcccaccagcacgcctggctaattttttgtatttttagtagagacggggtttcaccatgttggtcaggctggtctcggaactcctgacctcgtgatccgcctgcctcggcctcccaaagtgctgggattataggcgtgagccaccgcacctggccctgccatctgttgatcttctttggtgaagtttccagatcttttgcccattttttttatttgggttgtttgttctcttattgcattttaagagttgtttgttttggatacaagtcctttatcagagatgagttttagaaatattttctcccagcctgtggattgacttttcattctcttcacagtatttttcacaggacagaagttctaaatttcaataaagcccaactcatttttttctgtcatggatcatgcttttggtgttgtgtttaaaaactcattgccaaacccaaggcacctggattgtctcctgtggtatcttgtagaagttttatggtttggcattttatatttaggcctgtgattcattttaagttaatttttattaaatttgtaaagtcattgtacagattaatatttttgcatattagtgtccagttgttccagtgccatttgtttgttgaaaagaatatccttttttccttgaattgcttttgcttttttattactgtaactttagaggaggtcttaacgtcaggtagtgtcagtcctgacaatattgtttgacttttctaggtctttggccttcctatataaccttgaaaatcagtttattgatatccacaaaatagatatcaactaaaatcaaacttgctgagattctaatggatttttaaaattgtaaaacacatggaacatgaagtttatcattttaaccatacaattgtgtgcgggcatttttaacttcatactccagtagttcagggctgctgcagaggaatgcaactagctttttatatacactaaccttatatcctgcaaccttgtcataaatgcttattggttctaggaggggctatttttattctttgggattttctacatagataatcatgtcatctatgaacaaaaacagttttattccttcccttcaaatttctatgcctcttattttcttgtcttactgcattagctaagacttccagtatgatactgaagaagagtgatgagtggggatttccttgtcttgttcgcaatcttatggggaaagctcctagcctctcccattaaatcagagattttgtgtgttgttttttttttttttagcaggttgaggaagttctctattcctagtttgctgagagactttttcatgactgggtgttagattttgttggatgctttttctgcacctattgattgtatgattttttctttaacctgttgacgtaatagattatattatttgattttttaatattgaaccagctttgcatacctggagtaaatcccacgtagtgatggtgtataattatttttaatacattgttggatttgatttgctaatacactgttgaggatttttgcctctaacctatgctcatgagagatattagtcactgtccaccaaggtcattcaattagagaaaccttagatcattcttactgctttcctttctactacgaatgtacatgtgaagaagttaaatgcttgcaaatctagtctcctattgctttgccagcatcttcatccaggttcttgaggtctctcctgaggctgtggcagcctacatccccatgtcttctgtgttcatcaaaactccaacctcattttacgcttgtcactgccatgtgagatactttgctgaaatactaaactgatttgtgggcttataaacattcatttccctattaacctacaaataagatttaaaccaatttgctttttttgatatttaaaaatattaattatttaaagtaacaaacccaactcatgtgtccagtttccccttctccatttctcactctttcctgatcatgaatgctcttaaaatgacattctgttcccgagaatcccctcctcacatctctactttgtgcacacatttcatcatgctcagttctcctgtgtagctttgcctgcaaacacaggcactttgtatggatttgaaggcagaaagatcatctaatattttttagcatgtcttcccccattaggccaggaattctctcatattcatctttcaccaacatttcatttaagcctaatcattttgacttctgcacattagcatttcaattttaaagacttgaaaaaaaatactaaatgttatgtaaatgtaattttttatgaaccttgtttacaaggtaacaatatgtcagagaccatgtcgtgtttaccagtgcctggaatttagagcatcttggtaaatgtttattgagctaaattgaaaaagttaagaatcagtttatataaactacttttacacgtgtagtcatgttcgactatatcattgactctgttactggaagaggttgctgtgaactaaggaaatttttagagtggctggccttgattcgaagtatagttgggcagcttaacaaggggaggggcttttctgtcatggaaacaagataagcaaagatatggaggtgggactagagcatgtgtgagtcaatagagcatgttgacttctgggaaggtggtggtacagacaggccaaataaaaggaggccttcaatacagggattcgcgccactactaagggatttaaatatatgtctattcatatacattctgagtcctgtatttgatagattgtttctttatggggtattctttaaataaatatatattaactgaaagtttttcttgtataatggaactatttttcaaaaaactgaaacatttttaaaacttttatcctcaggattcaagttcgaaatatggcaactttgaaagatagtaagtatgttgtttgtctcaatatgtgaattgagaaaaactaaattttgacaaatacaaatactttcaaaaatatactgctttagcccattgtgtatttgatcaaaactgaccaaatggatttccattgtatgtttgggacattggacttgttctgaaaagaccagtaagaaaggacacctgagacagctatgttctgttgtttgtagaatgatcatgatataactagaaaaaattataccagtgttggtgtaggtgggtgtatgtgtgggaaggggtaaatcatgttatatataaataatgttatggaatatgtggttaaggcaactttcaataccatttaatgttttaaatgtatattattgtcttatgttgccatttgcttgtcctaagtagtagctagttttgccttccttttattagtactatttctttttttttttttttggagatggagcctcattctatcacccaggctggagtgcagtggcgccatctcggctcactgcaagctccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcgtgatccgcccacctcagcctcccaaagtgctgggattacaggcgtgagccaccgcgcccggctattagtactagttctaatattaagactggtttagcatcgtgctgtttattgtttatctaagcgctcattattctgccttgcactttagaaaaatatgtcaataaattcacaaggaagttatactgtaattcctttgtcttaacacagtacttctatttttcagtcaccaggagactaaagtccatcaaaaacatccagaaaattaccaagtctatgaaaatggtagcggcagcaaaatatgcccgagctgagagagagctgaaaccagctcgaatatatggattgggatctttaggtaagggaagagtgtaattcacaaattaggaagaactgtttcacacaaggaagactactgatgacttacatttagagcttacagtgatgtcaagcctatctgagcacttgccatgtacttatttttcatctacatccacttgacacgtaatgataacaacccgtgtaggtagtacaggtagggactgttagaatccctgctttccagtgagaaaaactgaagcacacagaagttaagtaacttgcctaagatcacatataaaaggatgaagagcctctgtttggacctatgtggtttggtgtcgagtctgtgtatttgttagccattatacgtgaccatgttaacttttaaaatattctgaaatgttcccagttgttaagtataccatcagaagaacttggaaaccgtgcgttagatgtaagggcttaatttcatcctatgaccttgtagtgtggcattttaggactgcagcgggggcgggtgaggggcagtgcagtggagagctggccttgtggtcatggatatgactcatgatggtgttttgagaatccgaacgatgttgaagcaggaaaagcagctgagaacctccattttcaagatacttaatcaccattcttatcttttcaaaagcatgaagacatttttccttcagaaatttatgtaatccatccttaattagtcttcttaatggaaaagagatgagatatgacagtttaaaaagaatttatattgtgtttttagatgcttttatacttgtttgattatgaatttatcttggaaataaagttgtaaagagctggaaatgggaaagaagtttctattttaacttgtaattacattctttctcttaacttttttatgatcatgctgtcttatcctgagttgaggctatctaaaagaatttttaacttaaggaagatttatgcatatttgatagtaaagaagatcatgcagtgaaccccctatttatctaccaaatcctcagtatctcaactgacagctgtcctttgtttttttatgtgtgtgtgtgtgttttgttgttgttttttgtttgttttctttttgtgtttttttttgagatggagtctcattctgttgcccaggctagagtgcaatggtgcaatctcagctcactacaacctccccctcccaggctcaagcgattctcctgcctcagcctccccagtagctgggattaacaggcccccaccatcacacctggctaatttttgtattttttttttctgagtcggagtctagctctgtctcccgggatggagtgcagtggcataatctcagcttgctgcaagctctgcctcccgggttcacgccattctcctgcctcagcctcccaagtagctggggctacaggcgcccgccaccacgcctggctaatttttttgtattttttagtagagacggggtttcaccgtggtcttgatatcgtgacctcgtgatccgcccgccttggcctcccaaagtgctgggattacagacgtgagccaccgtgcccagccaatttttatatttttaatagagacgggatttcactacgttggccaggccggtctcaaactcctgacctcaggtgatccgcccacctcggcctcccaaagtgctgggattacaggcgtgagccactgtgcccggcctcagcttacagctgtcctaagaacacctgcttacactaggcagttgccagctaaatttaaatgcgtattttggaaataaccaactgctttgtaaattagagatttattgtatttagtgtattgcatataaaaaaattactgcttttgtttgtttttaagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggtaatttaaatatatattgtttattttcataaagatgtaagcacgaataaatcttctctcaaaagttttgacaaactctcaaaaccttcatcaataacaaggtatattcttcagggccttttttggtatattcacaagggggtgtttgtttcctttttcttttttccaggatatattggaacatttctgttttccttcccctgttttctacctttgcttcttcatccggatcataagttgaatgccatgtgaatatcaaaagctatcagcattaagccaaatgaggcatctgaggagctgttacagcctggaaatgttagcaatagttcattaggattagaaggagaggaataaaggggaaaagaatataaaacagacctcatttttagttcttagttctttgcaggtgctgaaggaaaggaatgatgatagtgtgtggaacaactcaggaaatcaccaccacccataccccaaaagacctgatccatggtgacaatgttttctcctgcctgtcccctgtgctctttcagcagaaatcttattaaactagctatgtgagctcttgcttttcttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggcaagacagatttagaaatcaaagcttttttatgttcatgcttttgttcatattttgaaataacagtttaaaaattattttgagatttacatttgtttttgtcaattctaggtctgtcatctcctataagacagaagaaaagcccatcttttcccttaataccgttgcaagtgctggtaagtagtttttctatgatacatattttttggcatatagaatggagagatttgtacactaaggcagacagtgtcaagatatctggtggtagctatagcaaatgatttggggctgtttcttttttagatggaatcttgctgcctcccaggctggagtgcagtggcaccatctcggctcactgcaagttccgcctcctgggttcacaccattctcctgcctcagcctccctagtacctgggactacaggcacccgccaccaagcctggctaattttttgtatttttagtagagacggggtttcaccatgttagccaggatggtctcaatctcctgacctcgtgatccacccgcctcggcctcccaaagtgctgggattacaggcatgagcccagccttttatttttttatttttttttttttgagacggagtctcactgtgtcacccaggctgaagtgcaatggcatgatctcggctcactgcaaccttcgcctcccgggttcacgccgttctcctgcctcagcctcccaagtagctgggattacaggtgcacgccaccacgcctggctaatttttgtatttttagtagagacagcgtttcaccgtgttcgccaggctggtcttgaactcctgccctcaagtgatccacctgccttggccttccaaagtgctgggattacaggcatgagccactgcacccggccgatctggggctgtttctgagaagtgccatctcttgacttccatgatacttaattcagtcattgtttgataactcctgctctattctgtcattaattgaaaagtcagtatctattgaggttcatcattagatttttttgtcctcaaggattgaagagcgtagctagaaactggctttgcaatttatgtttgggacctctaactacaataaaacagaagctctagaatagagagttgaacagtgttcacagctaatttacattgactgactcaattctcttgttttattgttggaataaagtcatcattgatcattgaagcatcctggaataatattctggaactgattttagttttctaaggcttttttcccttgtatataccatctattttctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcaccacttgaccccaatgaatgaattttgaaatgtacttctaaatttctacaacattaaaactacgattcataccaatttctagttctcccactctttcatgtgctttgaaaggttttccctctctcattttccagattgatacattcagatttcttcagtaatcaaatgactaagttggaattactgcacaggttgagtatcccttgtgtgaatgcttaggaccagaaatgtttgggatttcagaatattttcatatttataatgcagtatcttggggacaggacctgagtctgtacaccctatacacatagcctgaaggcaattttatgcaatattttaaagaattttctgcatgaaacaaagtttcaaatgcaccccatcacacaaggtcaggtgtggaattttccacttgtggcatcacgtcagtgctcaaaatgtttcagattttggagcacttcagattttggactttgggattagggatgctcaacctgtattacactaaattcgtttcaattcattattattcttttttactggaaaaagcattgagtgcttgctggctttgtaacaggcacatgctaatgctgtccagagggcttcataaccacgagatatagtgcagttatttcaaatgttgacctaatttttctaaagttacacatgtggagtagaatatcaaatggtttatttacacattatattttgctaaaaatatgctatcatctgtagtgtggaaatagatgacattattagaacagattcatttaccttatctagcattaatttctgctctgtaattataaaggagttttacactgaaaagctgtttttgatgaattactattccttctatataacttgaaagaaactcatcacttgttttaacagacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttgtaagtacacagtatggacagtgccagcaggagtgcttgtgagcacacagtgaatctcagctgagaggagtccgtggccgagagtagcatcaacaacattaacatgatattcctgtacctgtaagaaagtatatcttgataggtagttgatttgcaagtactgtgaaaaggtatcctatggaagatgtaaaaatatcttcataacattatttgagaggccaattttggtatccaaaaatttcttacttttaaattaagcaacagaagttagttaacaagttattctactctagtttcagattttttatgtagtgtttttgttttgtttgtagctgagatgattgacaaattgacattgacattcaaccgtacccgccaagctgtcatcacaaaagagttgattgaaattatctctggtgctgcagctctgtgagtaattgtagattgtcgccttcagagaattttttttcctcttgctgtgtctgcttgtttggatgcttaaaagtttttcgtttttgtcttttgaagttgaaactcattgctgaaacttgcatcctaactcttaggctataaagatgtggtaaaaatgggacctctttgctttatttttattgtttcagctggaaacactcgggcttagttttcggttttctaaaggattaggaatgggatgtggataattcagtatcatttatgaaatctttttttggaatttaaacaattgtaagccaagctttctgagttacagggctagtttcagatttggttttacataaatctataaaccattgcatgttgggaaggtccaggaattttttaatcattatgttttttaatcattatgttttctatatcagtaccaaaagatagtatagccatccctcagtatctgcagtggattggttccagtactcactctcacctcccccaggataccaaaatctgaagatcctcaagtccctgaaataaaatagcacagtactacatataaaaaatgcacatcctctcgtatacttttaatcatctctagttataatgctatgtaaattgttgttgtattggtttttgtttttattattttatcattatttttgtcttttttccaaatattttacatcggctgttggttgaatccatggatactgagggccaactatatactgctttcctcaagaaaatttcttagttgttgaaaaactttaatgtttatgaaaaaaaggttaagataatgggaattttattcaaaaagttattaagttgaatacccactatgtgcacagtacagtgctagacacagtgttaaggatgtgattctctcttttaaggcacttatattctaataggataagaaacatacaagtaattgtgattagataaaacgtgtagtaagttctttttgactcgttccttcttacctcctgctaatcagttaccatgctctttaagttttaccttctaactatctcttgaatcttcccccttctttatgcccacttaatgcagatccttgtcatttctctcctgggttcaaaaaggtaattatttgagtgccccttaagtgtcaggccctgtgctagacactgaggatacagtggtaacagtatttgccttcagagagctcagtcttcacagtaaaggcagacactaaataagaagtcacagcagaacagaggttgctaaactgtggcctggagctaagaatgggttctgcatttttaaagggatataagaaaaaggagagtgatagcgtgtgacccacagagcgcagaatacttgctgtgtggcccttcaccgaaaaaatttgcctattcttgtgacagtgttatgaggaaaataacaaaatccattctctgttatacactcattctgcagaaacactcgatgtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaaacactccttccttcagtctgagtgaggcagccttctgtagcatcctgtcttccatttagcttagctcttacagccttgtatgaggaattggctttttatttgtctgtgtgctcctcgaggctaggatgggaccatatcttattcacttttgtgtccccattgcctggtacatacctccttcgtgaatgttgaatgaatgaatgaaatgccatatgtattcagaactggaagttcagaagagggacaaataacattttattgggtgtatgaaaatgtgggtccatggttttaagagtcagggaaaagttcatcactatttaaagtgttccttaagtgttacttttcaagggcagaaactgggcagaatgccagagagacacaactagaactttttgagccaacagagacctttgtgtaagttgttagttggatccatcagccttgctatcctaagcattcttctcttattttactttctaagcacagctgtgttaggactaacccattcacagcctggtcaccaatgttctatcagcatcacagaatactgtctcatggtgtctagcttgatgaacttggttaggatactctctctgttactcagctttgtcatctgtaacatggggactaatacaaggactaaaaccttctattagccattatccttcttgccatctaccccatgttaaagccaggctgatttgttcttggatcttaagtgtgacaaagcctgcgggaaggaaccacattctgaaggtttgtgggctgtgtgagatccagagaacccaagggggtttttttgctcttgacaaacgaatgttaggtatgacctatgatgatacaacttctgcaaaattgaggaccagcctatttcttcattagaaatgcaggaaacctggccgggcgcaggggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccgtctcaaaaaaaaaaaaaaaaaaaaagaaatgcaggaaacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaaaatgaaaaaattagccaggcctggtggcatgtgcctgttgtcctagctactcaggaaattgaggcaggaggattgcttgagcccaggagttttaggctgcggtgagctatgatcgtgccactgcacaaaaccaagaatttagaaaaaggaatccacataattggaaattgagtattaagtttttgcttcctaggaaggtagtctaaatccttatacaaaaacttagctatgcagtgccaaggttggattgcttgtgaatgggtttgcatgctctgtaacctatcagttattctgaatcaagacttgaatatttaaacatacttggaaaagaaaaagatcaaaaaacaaaataaacatatttggctatttagtaatataattaagaacatgagtaaaccatagtattcgaggtccaagtattagttgccagcctaaaaactaaatatggccaggcgcagtggctcatgcctgtaatcccagcactttgggaggccgaggcgggtggatcacctgaggtcaggagttccagaccagcctggccaacatggcaaaaccccgtctctactaaaaaagtacaaaaattagctgggcgtggtggcgggcacctgtaatcccagctactcgggaggctgaggcaggagaatgacttgaacccaggaggaggttgcagtgagctgagatcacgccactgcactccagcctgggcaacagaacaagactccatctccaaaaaaaaaaaaaacctctaaatatattgtgttaatttatagaaaaattgtaatttaaattacatattcatagtcttgcctacttgcatgagcatgtttttattgcttctaacctggattgaaatctatgactttttataacagtcattgagtctgtttcaaaggaatcttgtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttcttatatataagaacaatagatatagtttttgaaatgagatgatactaaaacatttaaaaatattaatatgctactattaaaattttttagtagaagacaatttaagaggctcttttgatttggtagtgctccactgaccttaaaatgtctagcctctatggggacaacgtagagggaaagggctgcagccacagcctcagcccagttctgtgccttattacagccttaaagaacagtcaacaagaccaggcacggtggctcatgcctgcagtcctaacactttgggagactgagactcaaggtggatcactggaggtcaggaatttgagactagcctggccaacatggtgaaaccctgtttctactaaaaacaaaacaaaatacaaaaatggtgcacacttgtaatcccagctactcaggaggctgaggcaggagaatcggttaaacctgggaggcagaggttgcagtgagctgagatcgcgccactgtactccagcctgggcaacagagtaagactctgttccaaaaaaaaaaaaaaaaatgccacaggaagcatttgcttggaattctggatacaaaattgcaagcatatacttactctaaattatttaaaacatcttttctaaacactgagaaaagtacgatactcacatttagatcacaattaagattagatgcctgcgttgactccacactctgagttggccatgccaaaatttcaggcttttccctatttgtttaaaattgataacttagttttttgggttttttttaattacaaaagtaatatataaattccaaaatacataaaattataaacaatataaaacccattcttaacaagctcctcttttaaaaacaaatgaatgcatgtatttagaatggattctttaaatatttacagctatattcgtggtaatgaataaaaaggttcagtgaactgaccagagcttcaaagtcattttctaactcccctcaaagttttcaggagccacttctgaaggggttggtggctgagactaggagaaagaaacagctcacaactgaggaatcagatggaggtgtagtgtgaaccagtacaagataccttttgggaatgttagcaacgaaccacgtgcctctggaggctgtgtgtatgtgtgtgtgtgtgtgtgcacgccactatacctggctaatttaaaaaaaaattttttttttagagatggggtcttgctattttgcccagtctggtcttgaactcctgggctcaagtgatcctccttagccctgcaaagtgctggaattacaggtgtgagccaccatgcccatcctgttttgtattttgcttctaagcttggcttgacccacctccagtttctaggagagcagaacacatttgtgagggtgatttgagtgtcctagacatcatggaaggaggaaaagcaggaatttgaaatcagtcaacataagtaagaataatctgtgtctgaactggaatactagctcagcccttaacagctgtgaccttgggcaagttacttaatctttcagttttatgatctataagatggagattaaaagattgttaggattaaatgagctaatattttaaaatatcgagaatctgacagggagtaagtgctatattcttggttaaatgtctgctctatgtaaaattaatcatcagctccctgtagcctttagtggtgctcttctgtgtactggcactctgactctctgaggatacaataacaaaacgcctccttgcaggagcttacagtctggagggaacacaagcaaatgacagaatgtggtaagttacaattggtgagccacaagagggacagtgactcaatttggggacagatgaaggggactgagaaggccgtccagcttggaggaagggaggtctaaacagtcctcaaggaccagtgaccaacagtagaaattaaactactagagctaactggtggggagggaaggcatttcaggccaaggaagcagaaaaagcaaagaccaaaatc

SEQ ID NO: 13917 - DNA, 11085 bp, Human; identical to SEQ ID NO: 12795

SEQ ID NO: 13918 - DNA, 11085 bp, Human; identical to SEQ ID NO: 12795

SEQ ID NO: 13919 - DNA, 79824 bp, Human
aatccataattcttcaaagtgaacttttatctggtaaattcttacagattaaatattaatacgtattgttgtggtgttagcctataaatttcagtcattattttttgtatataattaggttgtattaaagatgtatacagcattagggtattgaaaattatcttacctgattatagatttccaacattcttttgctgacattaatataattggaggtaattcgtagaccctaaatattatataagaaggaaaacattttattctataagtactgactgaaattttgcatttattatccactgaattcagagtcaccatgtatgtattaatggtaaggcatgtactactttacaatttaatattatacaacactaatattaaaacggttaatatttaggggatgcataataaaataatcttgctttctttttgtgacaatcgtgaaaatttgagttggagccaaatgtgcgtcatttaacaattcctgaatatccaattcatttgtaactttccttatgaataacctcattgcttgctaaatgataaagattacatttataatagtaaatatgctttaaaactttactcctttgttatttttgaaagagatatttaattccaaaggtatttataaatttggtaatcaataattacaattttgtcatacagcctgactgaagtattttggctaaacgtacactgtaagatagtcagacttaagtaaaaatacaactcccactacctttgtgatgaaacataaaagaggagccagaagataggtttttgtcacctgggttctttttaaaacttaaatttagtaatattcatttttaatttttttttaaatgttctgcccgtatagattgctttttagaggtactccatatatatgtgtacatgtgtgtttgttggttttaataattctaattcactctccttataaattatagattagatgttatctcctcacaaaatgtttgttgatattaaataatagctctgaatttgaataccaatgtttagtggctagcaagattattagttcagtaggtatgcatactacttccttagggagaatgcttaacaaaacttaggtaagagatatctgtcttgaaaatgcatatttacaaattctttgtagacccacctttgaatatttgaactctcattttcaatattcattttaaagacagcatttcttgtgactgtcacctcagcttcagtgctttttttatttttattttttattttttggtgggaggtggtacctggagtgcaagtcattttgacttatttatatctctgcagtttaagaaatcatccccattattttttcgcccaatgtaaaaaagtgaattccctattggagtatgcatgaaattggatgactgaaagacaaaagcatcaaaggaagttgacattttttgctcttctttttggagtaaagtttaatagattattgagttatgtttgtatctcttaatcgtgttaagaatatatgttgcattctcattttgttgcatgggaataaacctacacagaatgaatcggtagctgtgtgaataacttgtatttctatctatcatatataatcatttggaggggaaggatttatagttaaatgattgaatgtgaattgtatatttttgagataactggagaagattcatgtaaaagaaaaaaatatgtcagttgtgggaggggtaaacttttttgtccacttcattttttattcactgtaaatttctcccttgtgtgtgatgtctggcagacagtcttaattgaagaaagtagaagtgggtaggaagaatgtttcatatttaataatttctgttgcaaataaagtatgccagtctagcccgcgaaaatggttacgaggaagactagagtatagaacaattactttttgttttttgttttctgtgtatcatattgaatatttttgctgctgttgatatatttacatgttagtaattttgatggcttttggataattccactctagagggagacgtggtgggcggtccttcctgtgacacgacccttgagtgacagttctatttgattgcctccggtactgtgaggaaaggacacgactctatggtgaggactgatggacatacattatctgagaaaagaaactaccaggtaagaccagtctttcttcttttttctctattggtcttatagctacattgaaactgttcaaatgtgttatatgtaattggaaccagcaaattggttacacctcaatttgaaaatttgggtttataattttaaattaagtactggatttgatagttgaaatagttgggaacacttttcaaaataaagcatattcataatgtatattttttagtgtcaaatcaggttttctgagatatttgtcaaaacttagattatttgatatacaagttatgacttcatgactgaattcaaaatggtaaaaacaaaagtgttgattgcttttacgtatattattcctggaagactaaacccgaagtcttgtgctatattttggataacaaagtatatatcacagaaatgtagacaaaattgagtagagtatagaagaaatagaaatgagaaacccagggtgcttagagacccaaattctattgaatttgttattagtttgctgtccttaaatgctagattcttgttttctcatttaataaggtggttaataatattcattccttattcagtgtgtaggaaggctggaagaatagtggaaatgtaacattgctatttctgagctttgaaaagaaggtgaattttaaagattgtgctattaaacagtgatttaaagaaaaccaacatatttgaatttagttttttaaaggaaatatcctttattcatttgatagtgatctgttatcacatttatttagttatccagaatacagaatactttaaagtttgagtacaaataaacttttaggcttcctgcacagatatgtgtccaacctccccacctcccacacttcctttcactcatcagttcattccctctaggttgtgaaggcagctagtatgatagcagcagctttggttaactaactgtttatctgctaaccatttattttagcccagttaatcttttcttccctcaaattggaaaagttagcagtggagcaaattgtaaattagtctttttggtgtatggtataacaaagaggctttgattataagatctgggttctggtttaggcactgttcctaattaaaaataatgtcatatttaacctttctagaatttcttctaacttggtatctaaagtttcttgccagatctttatgattttaataagccagagaaaactgagggtatgctgaatcagttttctctgtaacctttcttctgagttgtcctcatagacttgaccaacatagcctttgctaatgatctgtactcaggtgtagctcctgcttcccacccacttccaattaccttgactcataagattttaattggtcacacttcttggacttctgcatcttttggtaggttctgccaaattattttaagaattttgtgattctgaattatatggcttttcagtgctcataatccaatttgtaaagtgtgaatgtagaatttttatgtgattacacactatagttaatttgtctcatggaaccacattaatatagaattccaaaatttatacttaagaaagaaaacagaattatgttttatacatgaagagatttgcttattcttgctctttctacactaaaagtactccattgtttcagtcatattatttacaaataatccaggtttttgagcatacctggaaaatgcatttttggttatgggtttgctgcctcaaaatgttttcccttttctctcttcgtttattgatacataattgtacgtatttatggggtacatgtggtattttgttacatgtatagaatgtctatataagaatgtatgggaaattcaaaggaatgttcatcactaaagtaacatttatatttgtactggtagtctaagaatttttatattcttaatatattcatcataataccaaacaggaaattttgtttctatacatgtgcttttcagagtagggttcaaaaataaaataattttacaatccagctttaaacagctgtttccaaggtatacttcaatatgcatttagcatcactaagtaaaaacaaaagagaaaagggacatagagggataaattctaatgttccatagcagagtagggtgactataattaacaagaaggtattgtatatttcaaaatagctagaagagagaacttaaatcttccgaattgatgaaaatgattttggatttttaaaaattctactttggaggaaatttatgtatttttcatagataaagtagaatttctttgtgtctatgtttataaccattttcatttatctttgagggcttttgcttttgagggacacttaatattttatatttatttgaacattctgataataggctaatattgaagagtttaacaagaatttttgtaaaatttatccaggtctcatttccttacagacctgattaaagccttaggaattaagtttaggaaggtgcattcccttggctctatactaaagatagtgacttttaaatgggcttggtttgaagtattgatttttatggtggtatctactttgtgtgttttctttcttactataagtttaagcccagttaggtatttggagtttgaatacagtagctgaagtttatttgcagagatagactggcatattagttcagataaaacaatttattatatggctcatggttcatttttggattgtcaagctttttccaaggaaatgcaccttcagtttttgtaaccattttcttatcttcctctaatttagactaacttaccctagctatgagcatgcacatgcacaaatgtaaaccatcttaattaccaatttaactaatcaatggctttccctttttttttttttttctttttttttgagacggactcttgctctgtcacccaggctggagtgcagtggtgcgctcactgcaacctccgcctcctgggttcaagcgattctcctgcctcagtctcctgagtagctgggattacagcgtgcgccaccacacccagctaatttttgtatttttagtagagatggagtttcaccatgttggtcaggctggcctcgaactcctgacctcgtgatctgcccgccttggcctctgaaagtgctgggattacaggcgtgagccaccggtgcccgatccggctttccctttgttacataacatattcaagcttctaaacattacctttagactttccaaattctggcctccttacatccatttacctttccaatatatctcctgttactttttgtagtagattttcccatttaataatacaacactgcttttaatctccctgccatgcagtttcacacccacaggggtttacttatattggttattttcatgtaatgcctcacctttgttcacatgattcaagaattaagtatcagtttttccagacgtcaccctatggtagattcagtgttcctttccctttctttcatagcctttacatacttctagtttagtgtttaccataatacattgtagttgtgtttatttgtccttgtcttcctatagacttgtgcagtccaatgccgtaggaactagtcacaagtagctatttaaatttaaactcatttaaattaaataaatttaaactcatttaaattaaataaattttaaagttcattggtcacattaaccacatttcaaatgctcagtggctacatgctgctaatggctactgtattgaacagtgtagatacagaacatttctatcattgcagaaaatcgtattagataatactgctgtatctaataagcttcttgaaaactgggaccgtatctgtttattttggtactgccaatacctagcttggtgcttggtatgtagataggtgttcaatgcatgttgttccaataaaattaaataaaacagtgaaagaagggaaaggaagaaatggaaagtatactgggtaacataccagtgtaagtggtatgggaaggtagaggtatttgcaagatatttagatgttactttgaatggaacttttcagtatgaggtcattggtcacatcatatgctagctaattcaatgcattatctacaaactgggtctaatgcatcctattccgtacgtttctgaagaatgattcataatctaaaacattgtatttttgtggaatatagtatgtcagagaactgtaaaaatgattgtattgccattttcttccccaacattaaatatcttacttccttttaattaactttaaaaatcacagatgcctattaccaaaacgttgaagaaaaatacggaatataaaatacagtgtgaaagtttgccttgacaactttactcttaacagtttggtgtgtacctcttcagatctttactagtgactatatagtgtagatgtgattcattgtctttgtctctaacaaatgtgtatttttctgcattgtacttaatggagctatttccgtttcccattctttcctctgccctcttccccagaagtaatcaatagttttaattttgtgtttcattctttatatttttataacttattacatatatgtttttcagtatattgaggtacatcttttttatgtattgtgtggcaattttttggaaagtggtgccccatattttattattttgagtaggaaaaatcataatttccagcccacttaagaccctaaacaatttcctagatatagctaaagtactcaacacctacttgataattcaccaaggatttctgcataatacagagtatttaaaatacaaactacttaatataaacagaaacaaatgaatcactaagtatatttccatttagtatgtactgtattcagataatactttttcttttatactgcaataaaattgtaattgtaaataaacagttaagtgtatttcctttcttttattgttaagtggcacattattgaacatgtttctctctctgaagtcaggatgcatcttacagctgatggtgacttcaagtcatagttgtgacaaacagtaccagcaccaaagcatcttagaatctatgatatatagtatgttaaagatatataatgaatataaagaacacttaataaaataaaatcatagctgagtgtagtgctgtgcacctgtagtcctagctactggagaggctgaggcgggagattagcttgagccccagagtttgaggctgcagtgagctatcatcacaccaggctgcactccagcctgtgtgacagagcaagaccctcagtcagtcgattgatagatagatagatagatagatagatagatagatagatagatagatagaattttattaaattaatacttaacaattgaaaagttgtcagatctggtgcccagagaagaaaaattgagtttgtagttattattgctgcttggtgttaggtgaagatgaataagagcgacctaatgaaagaatgagtttaaaaaaaaaaaaaaaaaaaaggaaaaaagcctgaatccaatgaattggttcagtttcctcttctttgctcttgaaagccttgcaaccagatggctgtgacatgttatcactagccagagataaagtaaaggggtagaatgactttttatgtgccctttacttgcatttatacagctgcttaagatgaagttgctcttataattacatttttgattgtgaaagctctgttcatgtcatgatcacatgatcagcaacggaagtcactttgacttcatgatgtaaatttttttttttttttttttttttgagatggagtttcgctcttgttgcccaggctggagtgcagtggcgcgatcgctggagtgctcaccacaacctctgtctcctgggttgaagcgattctcctgcctcagcctcctgagtagctgggattacaggcatgtgccaccatgcccagctaattgtgtatttgttttttggtagagacagagtttctccatgttggtcaggctggtctcgaactcctgacctgaggtgatccatctgcctcgacctcccaatgtgctgggattataggtgtgatccactatgcccagcttttttttttttctttttgagacagggtctcactctgtcacccaggctggagtgcagtggcaccatctccgctcactgcaacctctgccacctgggttcaagcaattttcgtgcctcagcctcccaagtagttagaactacctacacgcaccaccacatccgactaatttttgtatttttcggtagatacaggattttaccatgttggccacgctagtctcaaactcctgacctcaggtgatctccctgccttggcctccccaaagtgttggaattacaggcatgagccactgtgccgacctaatctaaatttttaaaaataaaatttgacctttttttttttttttttttggcattcatggcttctctttgtcctctttctcaggccaaccagtaatgtcaaatcaagttaaatgaattcccaagttcctcattggttggctcattgccgtgtgatgctaagtgttaacctttctttgaatgcattatacgttctgatactttttttattatcatctgaaatcatcaaataaggtgacatttgttttccaaaaaataagtttcaccaagacacctggtttatagcacccttagtgaattggtaattttttcatagtgcccttgggccaaaagaaactctgctaaataagtaattaggtccaaatcacttatattcatatgattatctgatagatattgctgtatttcctaagaagatataaaatatctagtagcacccctgtgtgttcgctctggtgttccttttggcaacgtatgacgtagactttatatatgaaatatgaagtgttctctttcagaaaaatagtttacatttaagtggtttgccttaatcatgaatgtgaaatgtgtactcattaaatcaaaagttaagacattaatgcggatatttctgtgaatcagagaaaatacagaagcaagcaaagttatgttttgattttgtttttgtttttgttttttttttttagacgaactcttgctctgttgcccaggctggagtgcagtggcctgatctcggctcaccgcaagctctgcctcccaggtttatgccattctcctgcctcagcctcctgagtagctgggactaaggtgcccaccacgacgcctggctaattttttgtatttttttttttttagtaaagacggggtttcaccgtgttagccaggatggtctcgatctcctgacttcatgatccgcctgccttggcctcccaaagtgcttggattacaggcgtgagccaccgcacctggccgcaaagttatcttttaagaggttatcttaggtcttgcgtggagtctaggatgatagcactgatggtggcaggttagttttttgtttttttttttaaatctttctgaatttccacataaaaatagaaccagctagacagcaaaactaaaactcgtgaaacataacagaacttcttgacaaagtgtccccatgaaccccaatataagcagatgagaactaagaaaaagacctacagttttcagtttttatgcataaaatgagacccattgggatgtctgatggacctgagagtggaggcacccaatgtagtcaacaggtattcactggtaagtacaattagccagtttgaaattgggagagattttgtcaacctcataaggtgagtgaggaacccatggtaaggctaaagtgattggagcagcttagctctctgacctcttgagagtgacccaccagtgtgtccttctaggattccactgaggagaggaattaaaattgagcaggaaagggacaacagtgacattggaaagagaaggtccagataaaaatgggagaggggagcagaaccaggaaatctcagtaaataagcgatcatattttcaaacactatgtgaaaataacagaagagagaactttatgacgttagagaagtttatctgaacaaagcagtattctaaaacttcaggaagattacattcctaagaggtcttctaggaatgtatttgggagtgtttataccaattttgagccccatcagtagtcctcatattcatctgacatttgataatttcagaattaaaatttttttccatctattgaggttgtgtttgagatatattgagatattcttcatagtcttttaaaaaagattttttgttttgtcttccatatttaatctacctgaaattgatttttgtacatggtgttagaagtacagtttcctttcccctgcacctaaattatcatattagcattgtgtaccaatttattctaacctccttaactattcagtagtgctagctctattgtaaatcaagtttctctttatatgcatggatttcttatgtctctgttaccttgatgtgtttgtctgtgcctataccaatatcatgttttcttaaatactaaagctttgtgttaaatcttcatgtctgtctgtcaacctttttcttcataagagtcttgacttggccttttgctctgtgacaaatttagaatattcatgagaatgctcccctccaacacaaaaagaagtattgagtttgtaagtggaattgcattgactttagttttctttgtggaagaatcgataagtttatgtattctttcatgttttctctcaaagttttatatttttttcataagggacttagaaatctttagtccaatttatgactacttttgttgcttttcttggttgtaaattaaaaaaaaatttttagttataggtgttattgaaatatagttgacttttaaaattgatttttgtatctcaatgttgctaaactttttaatttttataatttatctgtaggctttttggggggttcatataagtaaacacatcctttggaaatgacagttttgaaattgtcaccagttttgaagttgtcatcattaaataatatttgatacaggattttttttatagatatactttatcagggtaaagaaattgttcataatgctaccttatatatttttttcctctgtagcatctttttcttcttaaggttgtttactatgtgcgttttccccttatttggtcagacttactagtgattcgtcagttttactaggggtcaaattttagcctttatttatttctaaaatttaattttgttttctattcatcagtgttctttaatgttttcctttcacttcttagggtttgttatactgttctttaatcttacgtttttaattttccaggtaattatcaggtttgtctagttatctttttgttgctgatttctcatataattccattttggttcaagaatgtggtctgtatgatacaattatttgtttatgtgtttgaacaaaatgtatattaaccaaattggcaggtgtattgctttgtttctctccattagatcaagtgttaatcttattatgtacatcttatgtatccatataatcatttatccctttgtttagatctagattccaatatatcttatttctttaattattttataaatttttgtgtttagcctgtgataaatccaacaattggaagttgtcacatattatgctaatgtttttgtttctgctggttctcattgtgccttgtttccttgtgtgtatattaagctatcatttcatgtttcttagaactctgggaattctttgagcactgggtagaaggggacatttctcccaaggggattttcacttgtttttgctaagaccctaaggcactaccaatccagaaccaattccaaataaaatattagcttgaggttgcagtccacataggcaatgtgaatttatgcttttttgtggctataaattttcagagcattccttcaccactttttgcttaccataaataacaggaacatcaagattttttgctgtcctctttactaaggggttattacaattatggtgtagctcttttttttttttttttttttttttgaaacggagtttcgctcttgttgcctaggctggagtgcaatggtacgatcttggctcactgcaacctctgcctgcctggttcaagcaattctcctgcctcagcctcccaagtagctgggattacaggcacctgccaccatgttcagctaattttttttgtatttttagtatggatgaggtttcaccacattggccaggctggtctccaactcctgacctcaggtgatccacctacctcggcctgggattacagtgctgggattacaggcatgagccaccgctctcagccagggtgtaacattttaaggtacatgatttataaaaagcttttttaaatagcttctcctttagggatataagcttgtggcttctctggaattctagcttttactctcatttaagggtgttgaatttcccttcctcccttgcaggttcagctgtacacttaaaaatgtaacctctgttagtgtttattttgttcattgctgtatcctcacctgagaataatgtctggcatgtagtaagtattgttgattggataaagttagtattttatggagtgattttagttgttatttagtggggcattctgggttcttagttgtactaccaaacaacatctattttaattattctttagatctcagctgaaatctcacttcctaagggaaacattttctgcttagacttctgttacattttctcattgttcatggtaattttagggatggtggtaatgttatttctgcgttttattatcattcataatggaataggtttgttgactctttttctctttttcttcccatcttttcctgtttttacttcttatccctttcttctctcctttcgctttttttttattccctcccttgccctgctttattttcttgctcacttctcttccttttttctttcttcccttctttcttcataatatttttcttctacctaaaggattaaaaaattttttttctaaggcacttctagtggtgatgaattattttaggttttgtttgaaaagtctttatttcacctttatttgtaaatatactttcactgagtctgaagttcaaaattgacgggttttttgcttttagaattttttaaatgatgattcgctgtcttcttatttcctatgaaaagtctgctgtcattcttatgtttagtcttgtgtgtataatatacctttttctctctggctaatattaagatttttaaatttgtcacttattttacacagcttgattaaggtctatgtcggtataattttttttatgagtcttacacgtgggatttgttgagcttcttgaatttgtatgtttatacaaatttaggaatttttttcatccattatttatttgaatatattctctgtcttcactgtcctttgaggactccaattacgcatatacctaattgcctggagttgtcccatagcttactgatgctttgttcatttttttctttctttttttctcaccatgctttagttaggatagtttttattactgtttttttaagtttgctaatcttttcttcagcatgccaattattctgccttcttttacatacaaaatgtaattataactccttgcatatcattgtctactaattctgttactcatgtttactaatagaaactatgtctgtttctattgagtgttggtttttttttcctcctcattatctgttctcttttagggcttctttgcatggctggtgatttttgcttggatgccagtctttggaaactttatcttgttgagtgctatataatgtttgtatttctgttaatattctttagatttcttgtggttgcagttaagttacttataatagaagccatttgatctttgagacatccttttcttttttttcttttttttaggtcttgtttaacagaaccagagtaatctttagggttaattttcttccaactacttaagcaattcttttctgaattatgtaaattatgtttttctactctggctcataggaaaataaatgattcccagccctgtctgggccctggggattgttttctctgtttctttcaggtggccttttttttttgttttttttagcttctggtagtttccttccatgcatgtgctaatcagtacttagctgaaatctcagaggaaccctctgcatattttcagagatctttctctgtgccagtcattcttgtttagtatcccagcctattctggctgcctttaattgccctcttctccacttcctcaattcacaaagattgctgggctccaccaatctggaatccctctccctcactgcacactgaaaattctttcagtcttataagcaagggtagttgttgagccctcaatgattctttctctggtctcaaggattattgtcctgcacggcctgatatcctgtgtctgaaatcaattgtttaatatattttgtccattttcaagttgttttaggtgggctgctgctacaactaatactaccacactactctctcttggttggaagtgaaagtcttaatgtttcattttttaaaattattttttcttattaaaattttttttatagagacagggtctcactatgttgcccaggcttgtcaagtgatcctcccacctcagcctctcaagatgctgggattacaggtgtgagccactgcacccttatttcatttttaaaaactatattttggttgagaagatgaatgaaaaccatccctgataaagagaataagcttttgtgtcaatattcagataaggcttggatgctttctcttgtataaaatactatacagtgtgcaatatacacaaatttcagaccatttctcagcatttaaggtcatttagaatgaaaaataaaacagtacaggtcagtaaatgaattccagttcttatgtagaattgtcatagtcctgattcaatttaacttaaaaattggactgtttcctctgaatttcctgattcccttaagattccctagaatccagtaggcccatagatacagtggtcattcattttctcagctgtcaggtaaaaattttaccaataagcatttcttactttaaaaaaatctgtgttgtatagcataaaatagtatattatctctgtattgttttatctggatcagtaaattaaagacattataataaatgtgctaatgaaaatataagatgttttcaaggaaaaaggaaagacccttattagggccaaaaatgctaccggcacatgaaattttacacctattcttttctaccaaggcacttttctaaaggcactgtgataaaactaaaacaaatgtgcttggtagagtgaagagcctttagtttgagccactagtcttcacattctacctgaatcacttgggtccatttatgtaaagtctttgacaccgtgttcatagttaacagtgaaacctttaaaagatttggtttgctttgttaaagcatttccattaaatagagaaggaaagtagaaaattaccattaaaacaccatggtaggccaggcgtggtggctcacgcctctaatcccagcactttgggaggctgaggcgggcagatcaccaggtcaggagatcgagaccagcctggctaacacggtgaaaccccatctctactaaaaatacaaaaaattagccaggcgtggtggcgggcacctgtagtcccagctacttgggaggctgaggcaggagaatggcgtgaaccagggaggcggagtttgcagtgagccgagatcgtgccactgcactccagtctgggcgacagagtgagactccgtctcaaaaaaacaaaacaaaacaacaccacggtaatagatactgcgagcaatattcacggatgaatgctataaggagtggacagaaatgtaagggcagacaggtatttgcatgttctcacagtactccaaaacatttcttatttaaaaagagaaaactagtagtttacagtggagaaaacttccagatgcaccacttcacctgtaataagacatattaacatcatatgcactcatatattggaatatatgcatcacatatgatgcacttgagaagactacatcagctctgtggtgatgtggctttcagaatgcataacttcagtctaatgagaaaacatctgacaaaccccaactgtgggacattctgcagtgtgtatgatataacatcaatattatgaaagaagaaagactaggataagtctcggattggagaagactaaggaaatgtaaaactaaatgtaaggggtgggggacaaagtgttgtaattttaaatacacaaggaattccttactgagatgacttcacacctgaagtaggtgaagtaggaagccatctggatgtctagaggaagagcattcctggaggataacaaaggcaagggcttggagacaggagtatgtccgatgtgtttgaggaatagcaaggaggccagtatggcaggagcacatgaagagaaggggagaatgctaacaggggagattagagataacaaagagtaaggtcatgaaggccttggaggccttggtaatggtgcaggagtccattgtaaatgtgtttcacctctattccgtttgatttctgatgttcttttattctgagcctgaaggggataaagtgtataagtataaaatgtaatacctaacatctagcactgtgtgtagtagatgctaactcagtgattattgaattagtgtacatggtgagatgtttagaaacattttaaagatcatgtcttcccttgctaaaggaatacttttcatttttaattacttcctgtaacataaattaggattctgatacctctgtatatttttaaaatgtaaaggttttaaaataatttgtcaccttcaataatatctatttatgctattgaacagatgtcttaaataagcttctatttttattagttttagtatttgtaatagagtttatttttctttgaaaataactcactttttatattttcaaggattcaacatttttgtaaaagtgaattgatttcatatcttttttttttttttttgagatagagttttgctcttatcacccaggctggagtgcagtggcacgatctaaactcaatgcaccctctacctcctgggttcaagagattctcctgcctccgcctcccgagtagctggggttacaggcatgtgccaccatgcccggctaattttgtatttttaatagagaagggtttctccatgttggtcaggctggtctcaaactcccgacctcaggtgatctgcccgcctcagcctcccaaagtgctgggattacaggcatgagccactgtgtctggcctggatttcatatcttatttaaatcctatattcagattgttttgttttaaaatcttaaaatttttctctttattatcttgtttggttaaagtgccaggttttttttgatggaggggtccttatttgtttttatcagcatggagcagttaagaaattcactttttcccaaggattgtacttatatcagagttatgtgtaggttttaaaagttcactggtccacctttacgaattttaagtacatccatatagtacaactttaattctgcttgttgatggtgttaatgtgtatgagagccttagatttaatgttgagtactcaagagagcaagagagtgtacaaggagtggataggcacaaagtatttgaacacactgtcttacatgttttcataatggccaggtaagctctgtctttgcattttctggaaaagtgtgcaagtttgtggtgagcactgcttttttttttttttttttttttttttaaacttagtactttgaattagtctgaaagatgaatctgggtttggccagtaatgaagaggtgaacagggagtcataatgttgaaactggacattcagatctttatagcatgatttccttatttttcaaagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtaagtatgtggtggggaaagccgggggaaaaatggtactgtcatcagtattttgagggtggatgttgggccattttatcaatgagtcattttgttagtttagaaatataatgtttgttatcaattatttttctcataaaactcataaattatttaaaaaatagtgaagaaataattttaattcttgttagatgtgaaataagaaaaaaaccttaataaactattaatattataatgcaaaggaaggttcttacatttttttaaactttatattctccacagtgtatatagcaggtccagaaaacccatgttcaaaaaagaagctaaaaaaaaagttggggaaggcctaagtccatagactataattttgccatatgtaacttggtctcaggaggaggcaagttttagttttcttccactagctttagatgtgctattttttcctgaggtattaggcaggtagctatgttttaatctttacagaaatagaaatttcaaacatctttttccttgaagtcttgacaggaggactggaacatttctaccaatctctaggtttgaagttaacaaaaataagtatagatatctggtacgtaattcagcaaatgtttgttgaacgaatgaataaactcatcagatcctgtgtcgtgtgtgtgtgtgtgagagagagagagagatgccaacactcctggcattttctccttgtctgccttgcactggaaatcatgatctaaacatcacagatttaattttgtagggatgtagctctgggtcttcactaccttacttttgagcttcttctcagaaagctttcaaaacgtgtttctttcgttctcctacatctatcccatataattcatgttcattgatttatagatttttgcacatacaagacattcacattaaacccaagaaaaacagactcttaagatggcccatggttgctaagtttcttcagagaaagtatgtgagggttaaaagagattggggttctagtgtatttggtatttcaggtctcaaaacaagtcatcaaaatacagacttcccagcagtttgtctccctttttttcttgagttttttagataactggacgctctatataaacacatctccctcagcaaagtacatcccgtttttttctcaatatgtattcatattcccttccttcctccctctttatcagacccatctttgcctaccgtcttttaaggatttaaaatattctcattagaagattttccttctgtatgcatagaggatttgtttttattctaaatgtagagattttctactgttatatgtccttccatttgtattttatagttttacatcctaatatttaaagataaagtactactttaattttaggctctattatgtgagttctcaactccaacttcttactgctcataagaggtactaattatatttagttctttagtatatgtgtacttttttcctatggattagcactttttgaataattagaattttggttttaggatgatgcacttagcttttaaagcttatatattaattgttcaaatgtgaatctatataaagcatattggtgcagcacattttaagattctagaaaaccacaaaatctgtttattcatgttgaaacatacagaacatattctccctagatcagagtcaaacttgtggaggtatttgtagcattttggtaacactccctagagaatttgtagactttgggggtgcatattaagggataacatacatggcttttcagaatattttctgaataaagcagcttcagacaccagattttagtttttggattaggaaagagtgatgtgtttttccaccctcccctcccccaccaacacacacacacataccctccccatctttcagatataggccatcttgttttattggatgagccccccaaaaatacacagaaatatgctaaatatttctgtaaaccttggaaaggactctgccaggatatttatctactctccaaaatagtgattgtggaagtgtttgtataggtccctagctttctactaaagcctatttccaaccagtcatagatttttgtgtgtgtgtgtatctacatgttaactatctttggtattcattgaggccttttttgcttatttatggttattctgcattggctaaaacaatgagttgctcttatttgtttccatgctatcgatttgatgatttgtaattctagactttaaaatttatctatatcttcacttttcttagatccatcctaagcagattcatgaacttttcattatacctatatcatattaaaaatatgaaaccatagtattctagaactcggaggacttgaatttgtttctcacatgaagagtttttttttttttggtaaagatttccaggtattaatatctttgttctttaagaagctagaatttttttgtgcagtgtaggtgcctttctgtcctttatttaagcccccccccctttttaaattgtttttcaagaattaaataaaattagaattatttatagtagttgcgaagcaggataagcagtttaaaatcctatcacaaaaaatactactgaaacaaaaatatctttgttaacaaatatttccaggttgtaacaatataatatttgatatacgaatattctacttccatagaatttgggcagtctgtgagatttttacctatcatgttttccctctaaagggcaattataaaaacgctagattatcttcaggtattaggactcctcatcattggtttcagatgttaattggctacaccttgataaaaggcagataagtgttaatggcagttggctgtgattttatattaagtttctgcctattttatagccaagaacttgtgcatatttgtatattgtttgttgatattgaatatggaattcagagagaaaataagaactcaaattctaaattactcagatctccattaggaaaacagtgcctgagaaacactttttcccccttctcaggtactgtatatcttgcagttagcagtcttcatcttgtataatgcaagcagactacaaactctgtagctgggagtgaaaatttgttactcagtatgaagcagtgaatgagacaattgattttatcgtgtgacacctgtaccaacatgttagcagtaaaactcctccctacattagagaatctacaataaaaagttgctactagggaattgtttttgttttaacacaagttctagatgtgccctacatatgtaatgctataatgtctacattagagctattataatgaaattaagagtttggttataattatcctaattccttgaaaggttaaattgtgttcactatacttaagtacctaaaaatgttagttctttgggaacatggaaaccaggtatatatagcttttagtagttatttctacttatctgaagccctccttggataataatttttttttgttttcatttttgagacgtggtctcactctgtcacccaggctggactgcagtggcgtcatcttggctcactgcaacctccgcctcccaagttcaagtgattctcctgcctcggcctccaagtagctgggactacaggtgcgtaccaccacgcccaactaatttttgtatttttagtagagatggggtttcgccatgttggccaggctgctcttgaattcctgacctcaggtgatccacccacctcaacctctgggagttgagtgggattacaggcgtgaaccactgcacctggtggataataatttttaattggtataatagtatttcttttaagcataacttcattttcaaattaatgcaactttctgtaaaatacatgtgattagtcttgtagagactggcttttgtctcacatgtctataatcagtcataatcagtccattcttgttcttgtgctaaagtgatctttttgacacacataaatattcgattgtggtataccctacttaccattgttcacaatataaggaccttcctcctccaatcggctttttatttgctccttactgcttttccctttacaaattcaagaacaaaacacacattaaattgttagttgtatatttgagagtcagtgtactatcatggttaaaaagggggactccagcaaattggtctgggttcaaaacccatctccgcatttatcagatatataaccttaggaagttaacctaacttctctggtccttagctacaaaatagggatagttaattgttcttactttctagcgttatcttgataattacataaataaattttaaagcatttagaatattccctggcacaataatttattattattttatagttatgataaagtgttttcagagactgtataaaacaagagtcctaatttagtgtgaaagtttcaaagaatgggagaaagggcattttaagtagccgtatcagcatatgcaaagaccgggacatggaaactaacttctgttctgagtaactgaaggtatggcaagggtttggtggtgtcaggggacttaggagagaagttagaggttacaaaacatcttataagccttattgatttgggagtgctgttgaggaatttttatcagaaagtccatgaagataaataatttttactttaaaaaatcactttgatgtgggagagtagaattgaggggaagaagaatagattaataaagacctgtttggaggctattggagtggcttgttctagtgtattattagtccgttctcatgctaacaaagacgtacccgagactgggtagtttataagggaaagaggtttaattgactcacatggctggggaggtctcacaatcgtggcagaaggcaaatgaggagcagtcacgtctcacatggcggcaggcaagagtgaatgtgtgcaggggaacccccctgtataaaccaccagatctcatgagacttattttttttttaattttattattattatactttaagttttaaggtacatgtgcacaacgtgcaggtttgttacatatgtatacatgggccatgttggtgtgctgcacccattaacttgtcatttagcattaggtatagctgctaatgctgtccctcccccctccccccaccccccaacagtccccggtgtgtgatgttccccttcctgtgtccatgtgttctcattgttcaattcccacctatgagtgagaacatgcggtgtttggttttttgtccttgcgatagtttgctgagaataatggtttccagcttcatccacgtccctacaaaggacatgaactcatccttttttatgactgcatagtattccatggtgtatatgtgccacattttcttaatccagtctatcattgttggacctttcggttggttccaagtctttgctattgtgaatagtgctgcagtaaacataagtgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctctagcacctgttgtttcctgactttttaatgattgccattctaactgttgtgagatggtatctcattgtggttttgatttgcatttctctaatggccagtgatgatgagcattttttcatgtgtttttttggctgcataaatgtcttcttttgagaagtgtctgttcatgtcctttgcccactttttgatggggttgttttttcttgtaaatttgttggagttcattgtagattctggatattagccctttgtcagatgagtagattgcagaaattttctcccattctgtagaagcctgttcactctgatggtcgtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagagtttttatggttttaggtctaacatttaagtctttaatctatcttgaattaatttttgtataaggtgtaaggaagtgatccagtttcagctttctacatatggctagccagttttcccagcaccatttattaaataggcaatcctttccccattgcttgtttttgtcaggtttgtcaaagatcagatggttgtagatatgtggcgttatttctgagggctctgttctgttccattggtctgtatctctgttttgataccagtaccatgctgttttggttactgtagccttgtagtatagtttgaagtcaggtagcgtgatgcctccagctttgttcttttggcttaggattgacttggcaatgagggcccttttttggtgccatatgaactttaaagtagttttttccaattctgtgaagaaagtcgttggtagcttgatggggatggcattgaatctataaattaccttgggcagtatggccattttcacgatattgattcttcctacgtatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttctttcatgatttggctctctgtttgtctgttattggtgtataagaatgcttgtgatttttgcacattgatcttgtatcccgagactttgctgaagttgattatcagcttaaggagattttgggctgagatgctggagttttctagatatacagtcatgtcacctgcaaacagggtcaatttgacttcctcttttcctaattgaatgccctttatttccttctcctgcctgattgccctggccagaacttccaacactgtgttgaataggagtggtgagagagggcatccttctcttgtgccagttttcaaagggaatgcttccagtttttgtacattcactgtgatactggctgtgggtttgtcatagatagctcttattattttgagatatgtcccatcaatacctaatttattgagagtttttagcatgaagagctgttgaattttgtcaaaggccttttctgcatctattgagataatcatgccgttttttttctttggttctgtttatatgctggactacgtttattgattttcttatgttgaaccagccttgcatcccagggatgaagcccacttgatcatggtggataagctttttgatgtgctgctggattcggtttgcctgtattttattgaggatttttgcatcaatgtttatcaaggatattggtctaaaattctttttttgttgtgtctctgccaggctttggtatcaggatgatgctggcctcataaaatgaattagggaggattccctctttttctatttattggaatagtttcagaaggaatggtaccagctcctccttgtacctctggtagaattcggctgtgaatccatctggtcctggatttttttggttggtaagctattaattattgcctccatttcagagcctgttattggtctattcagagattcaatttcttcctggtttagtcttgggagggtgtatgtgtcaaggaatttatccatttcctctagattttctagtttatttgtgtagaggtgtttatagtattctctgatggtggtatgtatttctgtgggatcagtggtgatatcccctttggcattttttattgcatctatttgattcttctctcttctttattaatcttgctagcggtctatcaattttgttgatcctttcaaaaaaccagctcctggattcattaatttttttgaagggttttttgtgtctctatttccttcagttctgctctgattttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagaggttttgagtgagtttcttaatcccgagttctagtttgattgcactgtggtctgagagacagtttgttataatttctgatcttttacatttgctgaggagtgctttacttccaactatgtggtcaactttggaataggtgtggtgtggtgctgaaaagaatgtatattctgttgatttggggtggagagttctgtagatgtctattaggtccacttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatttgggtgctcctgtattgggtgtatatatatttaggatagttagttcttcttgttgaattgatccctttaccattgtgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgccttttaattggagcatatagcccgttcacatttaaggttagtattgttatgtgtgaatttgatcctgtcattatgatgttagctggtgattttgctcgttagttgatgcagtttcttcctagccttgatggtctttacaatttggcatgtttttgcagtggctggtaccggttgttcctttccgtgtttagtgcttccttcatgagctattttagggcaggcctggtggtgacaaaatgtctcagcatttgcttgtctgtaaagtattttatttctccttcacttacgaagcttagtttggctggatatgaaattctgggttgaaaattcttttctttaagaatgttgaatattggtccccactctcttctggcttgtagagtttctgccgagagatcagcttttagtccgatgggcttccctttgtgggtaacccgacctttctctctggatgcccttaacattttttccttcatttcaactttggtgaatctgacaattatgtgtcttggcgttgctcttctcgaggagtatctttgtggagtcctctctatttcctgaatgtgaatgttggcctgccttgccagactggggaagttctcctggataatatcctccagagtgttttccaacttggttccattctccccgtcactttcaggtacaccaagtagatttggtcttttcacatagtcccatatttcttggagactttgtttatttctttttattcttttttctctaaacttctcgctgcatttcattcatttcgtcttccatcgctgataccctttcttccagctgatctcattggctactgaggcttgtgcattcgtcacgttctcgtgccgtggttttcagctccatcaggtcctttaaggacttctctgcattggttattctagttatccattcgtctaattttttttcaaggtttttaacttctttgccattggttcgaacttcctccttagttcggagtagtttgatcttctgaagccttcttgtctcaactcatcaaagtcattctcggtccagctttgttccgttgctggtgaggagctacattcctttggaggaggagaggcgctctgctttttagagtttccagtttttctgctctgttttttccccatctttgtggttttatctacctttggtctttgatgatggtgacgtacaggtgggtttttggtgtggatgtcctttctgtttgttagttttccttctaacagccaggaccctcagctgcaggtctgttggagtttgctggaggtccactccagaccctgtttgcctgggtatcagcagcggtggctgcagaagagcagatattggtgaaccacaaatgctgctgcctgatcattcctctggaagttttgtctcaggagtatctggccgtgtggggtgtcagtccgcccctactggggggtcagggacccacttgtggaggcagtctgcccgttctcacatctcaagctgtgtgctggtagaaccactactctcttcatagcagtcagacagggacatttaagtctgcagaggttactgctgccttttgtttgtctgtgccctgcccccagaggtggagcctacagaggcaggcaggcctccttgagctgtggtgggctccacccagttcgagcttcctggctgctttgtttacctactcaagccttggcaatggcgggcacccctcccccagcctggctgctgccttgcagtttgatctcagactgctgtgctagcaatgagccgggctccgtgggcgtaggaccctctgagccaggtgcgggatataatctggtgtgccttttgttaaacctgttggaaaagtgcagtattagggtgggagtgacccgattttccaggtgccattcgtcacccctttctttgactaggaaagggaattccctgaccccttgggcttcccgggtgaggcgatgccccgccctgtttcggctcacgcatggtgcgccgcacccactgtcccgcacccactgtccggcactgcccagtgagatgaacccggtacctcagttggaaatgcagaaatcacccatcttctgcgacactcatgctgggagctatagactggagctgttcctattcggccatcttggctccaccctcatgagacttattcacaatcatgagaacagcacaggaaatacccgccttcatgattcagtcacctcccacggggttccttctgcgacacgtggggattattacagttcaaggtgatatttgggttcagacacagagccaaaccatatcagctaggaaatgaccgtagagatgaaaagatattgatgatataaataatttcaataaatatatagggttggtttgatcagcttgaattttaattgttgaagatcacaaaggttacagacagcatttttgagagttaaagtgacatttttcagagattaccatgaacagtaacaactgtgaatagccaaaattaagctgaaacataagatttgtgttgggttctaagatagttagtgctgcaaagtcatgttgaggtgatgatctcagggatttttaggtgtatcctctgtgtatcttcaggcctgcctcttacttcgttggttccctaattgccattcatcctgcctgtatcagggaccactttacccgtcttctctgaagttcttggttattttatctgaagtttgttttttttttttttttttttttggtaaatttctgtgattattctgatttaccacatttggctttgaaatactgtatttaaatgttgagaatgtcatgccttaggaattcatagctagtctaaactaaataatgaaggaggaatatactgggaaaatccagccaacttaagtggctccattacgtcttccagtttaattctttattactttctgagaccaattccttttggggatttggtttggtacagaggattagcttacttatctctgtatttttaatttaattttattttattttaagacgtagtctcgtggtgtcggccaggctagagtgcagtggcatgatgatcttggctcactgcaacctccacctcctgggttcaagcagttctcccacctcagcctcctgagtagctgggattacaggtgcatgccaccatgcctggctaattttttgtatttttagtagagacagggtttcacgttgttggccaggctggtcttgaactcctgacctcaagtgatctgcctgccttggcctcccaaagtgctggcattgtaggcatgagccaccattcctgacctctgtttactttttagaatatgctgcttagttcttatgaaatcaaaggaaagattaaatgtcttgattaaacgttttagatctgtgttcaaaaaaggtttaagaaacattggttttgctacatgcatatattctttcctggtaaaaaaaaatctcaatttgtcttagaaagtctggtgtgagtgtcaagtaaaaaggtggtcacttaacaaagtatatataagcccttgacttgtttgcttgaataaagctgacaaattgtacacaccaaagattctaatgctgtatatccaagatgaagtctgatttaattttaaactacagccatagtttaaactacagccataacaatgggagtacattctgagaaatgcgtcaggcacttttgtgaatgtggaccatacttaaacaaacctggatgatataacctcttgctcctaggctataaacatgtacagcatattgctatacgaattctgtaggcagttgtaacacattggtatttgtgtatttaaacatacctaaacacagaaagggtacagtgaaaataagatacaaaacatttttttaaaaaggttacacctttatagggcacttatcataaacggagcttgcagaactggaagttgttctgggtaattcagtaagtggtgtgtgaatgtaaaggcttaggacattacagtatactactgtggacattggaaacactgtacacttaggctacactaaatttatttaaaaattttcattctcgaataatgagttaaccttagcttaccgtaacttttttactttataacctttttaattttttaaaatcttttggactctttaatacttgacttaaacacgtacagctgtacaaaaatattttcttcccttatattcatacttagcttttttctatttgaatttttttgtttttttactttttagatgtttttgttttgttgaaaactgatacacacactcatgtatttgcttaggtctatcaaggcatcactaggcaataggaatttttcagcttgtttataatcttacgggaccaccgttgtatatatggtccatcattgactgaaatgtcatgctgcacatgactgtcgtttattaaaatttttatttaccaaattaactttttaacatacgttgtaaccagtaatttcaatgtatttcgatataattgacatatcctctttgaaatttatagaaattgatttttatgtaccctaatttctctttcagggagaagatgggtatagtttaaccctttcatatcatccatccatccattcctactagttctgcctcagagtatatcctttattcaactactactcaccaccctattaggccatcattatctatcactggcctcctaatgcattttcctgctttcgttttataccctctttagcccattcctcatggagtagctaggacctttaaaaaaaaaaaaaagccaaattaagttactcttaagcttcgcctaaatcctctcttgatttcccgtctaacaaagaataaaatccaaagtctctcaggctctcgaggtgtactatatggtctagccccaaccagtctctctgacatgagttcctacccttcaccacctaagttcatgctgcctgagccataccagtgaggggtttactgaccctctgaactgactgcttttccttcaagcatttgcctggtcagttacttctctgcttgttttcatctcagttttatgttccctgattatttttaaatacttcctaccctgttccatcattctatgtagaataaaggacgggcactttaaaattaaataaatctagctttatgaaaaacctgtgttgtctttttctcttgtgattttgccatggattagaattgtctcataccagcacccatctctggatgggggtttgcattcatgggggagagtaaaacacccttacctctccctccctccatctgtctttctctctgtctcactctcgttttgttttttaattatttgctgaagtcatgtaagaataattagtattgtcactgatgtgtaatttctgtgccagagcacacaaaacagaaattaagcttaagtttggtatattttctctctctctctctctctctctctctctcacacacacacacacacacacacagtgactcttgagaaaatctggtattgatggaaaaggaacatttcttcattttctttcgtctggaacatatgtttaattttgccttcaaaccaaacctttttgcaagatattaagcataaaaattttaattctatacaattaatttcaattttagaattctaggagtctataatggtcttgatgataagtgttatacaaacagtgtcaaaagaagagtttatcaatttgagcttatttatgtgtataaaatttgatgagagatgccttgatattcacctgaaactttattgaataattattgaattatgcattttccatgtttattctttcttagaattagagctcaatagtaagagttctataaagataattaaatgtatctttaactttcaaaaaacaaacttctaaaatcttatgtgtagtgaatcttaatttgcaagctctaaagtgattttttgccactgtttcctttttgaaattactcactaagaaacatctgttttccccctagtagggactacttagggagctggtggataggcatgcgggatcctggtctgaaataacagagttacagaatagcattctgagattcaccaggagtctgtttcccaaaaaaagattaagtacctgtgttctaataaattgttagacccttaaaaaatatctttgtatatttcacacctcaagcgattacttgcctaaaagcatatagcaaagtaataggttagctgtccttagactttatttatacctgactgaataggttttcagacctcaggaggaaagacagtcaaataattaagtttcctacatatttaacagggaacttaaaatatataagaaatattaaacagcatgggtgctttcaacagagttacacgtaaagtttggccttcaaagtctgcaacatagttcaccacgtctactgatatgtaatagtgactacagcattttttgaaatgagacatggaaattgttcactcatttataatggaaggaaatattcttagtcataatgaatgtacaagacagatatcaaatttgagatgagttttccccaaaaatgtacttgtgaaaagacatagtcaccttgtattcaagtctttaaaatctcttttctcattgacattggtttaccttgattttcaaagtactgttaggagaaagacacattgaccttaaataactttagtcagttaatagttttgataattttatagaggtcacattttaaaaataattaaaaattaaaattagcacagattttaataattacagttggcccttcatacccatgggttctgcatctgtgggtcaaccagctgcagattgaaaatatttggggaaaaataatggatggttgtgtctgtactgaacatgtacagactgttttttcttgtaattattccctgagcaatacagtgactatttatatagcatttacattgtattagatattataagtaatctagagatgatttaaagtatatgaaaggatgtgtgtaggttatatgcaaatattataaaccattttatgtgagagaattgagcatccgtggattttattttttaatccatgaggggagaggtcctagaaccatttcttcacagatagcaagtgacaacaatttatgttggtgtgagctcaaaattgctaatgttggatgttacaaagactggaaaaacaaatgaataagcaggttatatcattgaaataataactttataccagtatgatcaatgaaagattgtacttcagttacatgagtgggtacttgcttgagataaaattctagtatgccactatatatgcactgattcaaaaaacggtatatttcagtaaacttagattgtaaggaaagatgaatgcttgggaaaacagataactgagaaaataaggtgatgacagatacacaaatgtggaagatgcatgtgaagattttgaataattaaacctaaacttaatttttaaaaaatctatgtatgggaaaatgatattggccatttttgaagagtaaggtatacttagttttttaaaaggaaatggaattgttaagataggctttatgtgattctcctacttttagggtctggaaataaacatctaacactttattgttataatcagatttatgactttatcacatgcgccactagccattagttgatcaatttctgtatcttagcaatgctcccttcatgttctgttttccacataggagtaaggtaacactgaacattttccaaagtattacccctgataaaagtaatatttttgtttaggtgacaaacagcatgtttggtgcttcaagaaagaagtttgtagagggggtcgacagtgactaccatgacgaaaacatgtactacagccagtcttctatgtttccacatcggtcagaaaaagatgtaagttaatcaattatgttgtattttttcagcaatgtaagtctgtgtctgggttcctgaaaaacagcatatcaagtgcagaatactgtctgtggttgagtgacaatcttttcagcacagtgctagtccctttggtgcttgtatccttttgggatacaaagacaatgaatttgtattctaatggggaaaataaatatcccatgattctcaaattgggatatggtaatactgtgatagaagtactcaaagacatggagtaaacatggtataacttctagatcactgattttttttgtttgttcaatatgggaaataacttgtttgatattaaaacaaatgcagatatagaacagaaagcagatttacgcagacttgaagatataatggcaagctgtaataaaactttatgcttattgtgtcatctagctgtaattctggacctcaggtgtatctctcctctgttcagccatagggatactataataggaaaaatttggaagaactgtattcaaaatgtgatggatgatatagagatatgaattaaatgctttggaaggctaatagttcaataatcccatttgggataaaaggatttagaatgcaaccaagtcataattagcaaatttataaaatacttaaaaatgaatgtaattactaaaattctgttaagctactttaaattatacaatgtactctctagtcacaccagttgcattcttatactttgtacacctgcccagctttttttacctttcacactttataaacttgctatgccaaatctccttatgtataaaacaatctactctagctattaacctaatgagatttatactgatgtttgaagcatttataaagttctaagatatggaacaaatgcccttgtttttctttgaagttgatcattagtaaatcacttcctttgactttgcagaattttgcaaatcagcttaacctactaggtttatgttaggatgtttgttattctgtttttgtattttccttttttattttgatttgaacattcttgtgtcattttgaaaacaaactatcaatggcattattgggcttttttcaactaatgtgtgttgtggctttgttgataattagtgtgtagtttaatagcttatggaataatgtcatctaattttctgttatcttattgcgcttttagctatgtgctatgtaacttataattgaattattatttacacaggtttctatttaagtattgaccttgtaaataaagaatttgggatatatttttggtagtatcgccgcagaaacgaaaacctacaatttgtgtgtattgctgtgattatataatgaaagttaagtttgcttggaaaatgttaatgaaatatttattactgatgaaatgcatttattctaattaggaagataggaagctttcagactgaaatctaaaagtatataaagagaatgaatgacaaagagatatatgtcttctcaaaagcagaaatactatatgtctacattttaaaatcagaattagtatatatacttacacacatactcacaaatgttggccaccattctgatccagttggttggcacagaagtaacagaatggtttgattcacaaaaccttttttaaaaaaacattaattaagaacatagtatggcataggaattaagaacttggactctaaagcaatacaaatatgtgtgtttggatcctgactttgcctgttagcaagaacttctccaagtctcagtttccttttctgtaaaaataggagtaataatatattggctaccttatacattggctgctgttgctgttacttttttaaaattacaaaatagcacaggtaaattatacaaatttttaaaaatacacttgaagaaaaattacctataatgctatcagaaataattgctaaaattctaattttatgctttaaatatttttattgaaaaatacacaattatttaaatcttctaggtcatacagacatattttccatcaaaaagtttgtaccagtttttactgtaatcaccactctccatgccaacaagaataccagcaattacatttaagtctttgctaatagacaagcttattgttttcatgtacatacagtaaaacatcattaattttacacacacacagtgtgatgggtcttttccatatagttattggtcatttgtatttcttcctttgtgtaccttttttgtgtcattttctatttctctattgagatcttaagtcttactagtttgcattctccatgtattgaggataacaacctcttgtcattcattacaaatattttcccagtttttcacctttaattcttggtatatgtagtatacgtatatttgtcattttaattaaatgtgatccatcagtcttatttttaaatggcttctgttttcgagatcatacttaggaagacatttcccaattactttcttataatacttttatgttttgttcttcacatataatttatgtccattagaaatgtgttttggtttaacctgtgaattgtagggttccaaatactttttttttctacaagcttatccaattgcaccgacaccatttatgctttaaatcacgggtcagaaaactttcccttaaagaaccagatagtaactattttaggctttgtggaccaagaagcaaaatcaaggatatatataaaatcaaaacctattttgtataataggcctttatataaccatctgtaatgtaaaaactttcttagttcatgtatcttacaaaaacaggcagtgtgctggatttgtcctgcaggaaataatttgcccacccctgggttagatcattaatttatggctaattaaaatatccctttattatatgtgctagtgtctcatacattcttgggcctgtttctaagatcttgttctgtttaccatactgatcctgtgtcagaactacaacataattgaattgccatagctttgtagaccactttaacatcttgggtaagaatctttgacatcctttgttttaaaaaaatggtttttgattgttgcacattaatatcaatatagatggtttttcggaaggatatttctccctttaatcttgttctttatgcgttttaatagggttttgcagttgccattttcattgcatttttcagattggtttttactgacctatggaatactttgtgtagttattttataacaaactgccatgtaaaagtcttctattagtttttggtgattgagaatgtaagccctggaaatcctactatgtaagtttttatgtcagctacctgatttgctagctgtgtgtcttaggacatcagtctctgtgtgtctcagttttctcatctgtaaaataggaacaatagtacctagctcatgaaggattttttttttttaagtgggagaatagttagtgtttgtgaggggggcactgaagtgactgctgtaattaagacagactgtagaaaataggttagcaatgaatattgaaaacctttaaaatgtaaacattccttgagtcagtcatatgtctttccgtaaatttgtacttcagctgtaacctgacattcagacaatataatataatgccatacttgtttttaacaaaaaatttgaggctcaagtgtttaaggaattaagtacattgagtattacactatttttcaaatgttccttatgtaagcttaagaatattttaatgaaaattatttgaaatacctagtagatgcatatcatcagttacctgatttgtaagctaccctgttctgtgacttaatgactattttattttactgtctgcctcctcccttgccccttttctcttttgttcttgtttgtttgtttgtttgtttgtttgttttgggggatattttgagacagaatttcgctcttgttgcccaggctggagtgtaatggcacgatcttggctcacagcaacctccgcctcctgggttcaagtgattctcctgcttcagccttctgagtagctgggattacaggcatgcatcaccacgcccggctaatttttgtatttttagtagaaacggggtttctccttgttggtcaggccggtcacgaactcctgacctcaggggatctgccctcctcagcctcccaaagtgctgggattacaggtgtgagccaccgtgcctggccttgttctttttaatgtattaccttctcatagttttctttttttgtgcctgtttgctagatttcattagtttcatgttttaagttatccgttttccaattttaaaggttctttagcttctgtctagatctggaactcttatgtgtgtgcatgcatatgctttcttcctttttctttgtctctttttctctttgtagatatggtacagttaaaaagtcataattcatttgtggtttttgtcctggaataataacatagtgctaggaattatattatcaccataattttgagtatattatacagagtcttttaaaaataatattttaaaacttaaatatcattttttaattgctgtcatggtcatggaatttttatttaacaaaattttgttgtatttccttgcaacaatttgtggatttctttgacattctgtatattaaaggataaagaagttctgtgaagggttaggggaataaccagaatcacattactgtttcttctagttgcttcctggtttttattgttgttgtttgactgcagtgtgcattgtagatttctgagagatatggaagacctgattattatgatgattttagagtgtgctgtaacttgttgttttcagcattctattaatctttttctaccgtttgccactcttaagagcacaagttctatgccttattttacctggaatttgtgaagataaactttctttagccccttgggcaaaaagttatataaattaagggtattatttaatacatttctcaagagtctgaatgccccctctcactcctattaatgagagttctgcaactgaggggaagattagattattagcagctgctgctaccatttattgagcacatactatatgccatatcttatttcatttaacctatacttcagctctgtgaggtaggtagttattttcattttataggaaggaaaccaagtattggttgttccataggtaagtggcagaaccaggattcaaacccagattatttctgactccaaaactagactctttttacttgtgctgcatcccctactgtaatgtgtttcttgatctaaagttttatatttttctaagaaatttacctttatattattaactttcagaatttaaaaaatatatacattttgttttctgctaatagtacttactgttctgtcagagtatatttcttgtgcattttctatactcataaaaagcatttctgtgacattcacatttcttcactgtgtattaaatccatttttagcaccgatttgtttgatgaaatattgccttcagaatttaaaagtacaggttcttagggatagactttataagaaattagatatttgcatttttgacacattttgaggcagtaattttaagatatgtctgtatagctgatcgatgcttattttacatgaatgtgttgaaggttacaaactcttaaatttaacattaaactacttttattattcctgtaaagctgtgtttactaaccaccttcatgtagtggcacatagagaaaattgtatataatattacacactgtggtaagtgaatcagcctacggttcttgatctcaagtaattggcctagggacctaccacctctttaccttcatgctctgcttcccctccctacttactccctcctcccattttgagagggcaggtagatacccaggcatatctgtaactcatggatgtataatcagtgtgagaaagtagactaaaatgtgtgttgtctggagttaactattcaataaacataaatatctgatgaaaaatgttttaagtgttttgtttgacaatattcacattatggattgttctaagtcatgcatttatgttggccagcatcttatatttgcagcctttagaaacaactgtactttttcatttatagcttataatgacagaaaatcatgattcttaagaattttatataaatcttttacctcctttttttgatggttgatttgtattactattaggaaaaccagattttaagatatcaagcattatttgggataaagaaggccactacataatcataaaagaaaacttactaaaaaggataaaacttccttttttattttttaattttacttttaagttccaggatacgtgcgcacaacgtgcaggtttgttacataggtatacatgtgccataaaccttttaccttctgtgatcaactaaagctttattatatattcttgttcttgcaatttggaaatgaacttttaatatacctacaaaatattttcagttaatgcagtaacagtaatctataatacctaagaaaagaacttatcaggcatcttttgatctgttgggttataattgggaaagaatatatagtttaattgtatagataaaggatgttagtttaattatctaggttgcacaacctctggatttgggagggaatatttataaggtttgatttttttttttttttttttttttttagaaaaatcactactgtcgtattaatattactgttttctttagagtggtgtataactcagccctacctcaagagttactgatgtgtaccattggtctaaaactatagtataaaaaattttgcaaactttagtataattgaaacaacttagaattttgacatgaaaatagtatgaaatgtatattgtaaaacctctaccctttaaatgttttacctcagcaccacaagacagggtgagaaaatagaaaaaaaaacaaacaaaaatacatgtttcacttcttggtttttctaactgtggtcagtgtcagcatgatttttcatccctggaaaccacagatcagcctctgatagttctctcttttgtgagtctccattaacctccttttcccgttataccccagctagtcaacaggacataaaataactgttacttctaccaccagaatgcgtcttatttttagtctcacttctgctgttgtcgtttagtatctcagcatatcccatttctgctattagaggtatcttcccaaaacccattttgattgccaccttcttgcttaatattatttttctttttattgctatagttggtagccattcttgtatgacatttatttcgcattcttctatgccataacatgggtgagctttatctccaaatagagatgaactttatctcctttcatagttatcctatcaccactgtttatgttctctaataatattacaaatctttattttttttaacaactggatactgggtttttgtgttcaatttttaaatttttgttcaatttttttgaatttcaatagttttgggggtacaggtggtttctgattacattactaacctttgttacacttatactcactgcatattcttgagggaagaccccttcattgtatgtacctaaatgttaccactctatagagtattcctgatacctttgtgtagctccagtgatgtttcatgtttcctttagagcatttaccacactgtgccttaaaatataatgagttgtataattcattctctttccccactagattgtaagccccttgatgacatggctcatgtcttatttaattaggatgttttgatggttgtctaatataagacaggaaatacgcaaatatgcacacacacatattttcatttactcagcttcagtatttacttttgagtatataacactgctacattcatttctatgaggatatatataatgaatgtatgttctgtgaacatatcttcaaataatttacatctacaaggaaaaaaaaatggataaattcaaaggcattgtacaagtgccatgaagttcacatcacaaatacataaattatataccatgtctatataattttatttttttaacttgctaagtgaaagagtagtgctgctgtaactcaagttagtgtgacttttagaaaacttatagtattaaaaattaatttcatttctacagtttggttttatcgaattgtgatattctcttaagaaacatggaatatattatagaatgtttgttttatgtttttctgaagaatgagaaaatgttagattttcacatttatggtatgatttacagatttgtggagtgtaaatgcaatgctctgctctgttttctttatgctctaatataattaatttgtttctagatgctggcatcaccatctacatcaggtcagctgtctcagtttggggcaagtttatacgggcaacaaagtaagaattttgtatttattctgggatactttatttaaagagaaaaataagtaactaccaaataaagaacaaccagtacttcctttgtgggtttattgtatgacttaaaaggaaaaatgtttaattttcagagttttattttacttacatagcaaaacctcattatttcagaccttattgatcctatggttgctattacttggatatagcatagattgaaatttatttcaacatcttttacatctgtaaattttttgcagtatttttgaagaatttgctaaactaaaaatagacattctctgtgttttcaattaaaggaagttaaaagcttttttagtttatttgactggctactctgtgtgtgtgtgtgtgtgtatgtgcacgcctgtttattaagtaaactcattacttagcagtttgtaaaatgttctttgtttcacaagtatttcttaaatatttcttcttttgctttagctcagtctggatatagaatctagatttttgactcacggtttaatgcttgttccgttttgcaggcttctacttctatttttttaaagtgttgtaatacttttaaagcgcttagcacagagcctagtgcatagtaagtgctcaataaatgttagctattatcacataaaatttttataaaactaaacaataaaatatctttatattttctcaaattaacttcccaaattgttaaatattagtatgattttatcatctctgttaatgtcagatctgttgatctcccatttctgttaatgtaatctctgttaatagaagaagggaattaaaagtgttataaattcccatcagacattataggataattgaataactgaagaagacatctgatgactatcctaaccagtttcaagtaaaaatcaataatttgatttggaactctcccagtataatgaaaagcaaagttttgacaggtatcagaatagtttgtcataacactttaccttccaaattgattcgaagtgggaggatgaaactaattttgtatacaagcatggtttccatttacttttttctgtctatcttttgtggcttttctcttttttgctatggaacacaattttgttaatatagaattagtagataaaagttattctgtattaacagtttctccaattaaaccaagaaacgtatttccaaagcttattacataaaaaaattgtttatctacaaatatttatcctagttgttgaaggactattattagctagtaatttattctgcttaccctgtgttttagtgtggctttcacccttctggtaacccttactatagaaatatctagctattttaaagctaccttttatttcttcagagcaactgcaaagaacttactttaccttttggaagaccaccgtttatcacagcagaaagtagatatggattggagaaaaattgtatttgagaaactaaggttattttgtaaaggataatggcaattactatacttataatcagctatctggattttttaaaattctggtctaatttttttagcctacaaatctgaaattctaactgggctaagatatggaatgggttatgtttaaaatgcagttatatcattggtatgacagacatttatgtttttgtttttaaggacatacaaagattaatacatgagaaaatttattttcattagaaaaagaatttttaaggtacttactagtttaaaaagaagccatgtatggcaaacattttccattggagttcagtatattaaataactatattcctgtaacattggtgaagcaacattttgaatgtatggcttactcttttaaaatgacattttaagtgttagatagagtacagaaaaattgaatcttagatcaactggaactgtaatgtttcaggtcagggtgtaattatgtttttccaagatatcgatctagaagctataactagtggaaaaagaaagagtctaggttgccaatttctatctgttaggacagacccgagaaggccaaataggtcattcagctggtaggtaatctgaacaaacaccttgtcagacagcagaacacaagctaccatgtgggtcttgagggttaaggttttaataatttaagtcagaatgacaaaacttaaggaactgagttaaatgaaggatggagagataaggaattagtaggtgagtgtagattagagatattattcttatggcaacttactgtaattgcacattgagattggtgtaactaaaagttcgtttcccaagtgcattgagtaccactattaattctgttcagttggcaaacttttattgtaatttgtgccattaaaaatgtgagatctactatctattgtatgttcttgatggttagaaaggttagaggtggaagagatatagaaggaagagtgccctctctagaagtaagagtcactgagattaaacaagaaagggagtttgtcttggaatagatacagaagtgcttaaacttagatttggctagatttgggtggaagtgattatgcagtgccatgaggtagccagaaaatgctggaacagagacctgtatggtcttcagttctagtatagtatgattgtatccaaatatgtaaataattggacttttcatccaataattcacgtgaatactgtacatggaatgataactatagaaaccaatgaacatactcttgtattcaagttgcataatgtttcctatttgttatatttgagtgtgtgataagctttcaggtgaattaagtcctcacttaacataagttttttgaaactgcgacttgaagcaaaactacatataacaaaaccaattttttgttctcatcaacattacaatggaatgaagttgaatgaaacaacactattcaaggacctgctgtatgtatttttgcctgaaatcacagtttccaagaatgatcagtggcattaagtgaagacttactgtacaccttataagcttcaagacccatgagctcccttaagctgtctcctagattagaatcaacagggaaccaggaattaatttctcctggatagtcaaagcattggaattaagtggttgatagttgcatttaccttttcttagttaccaacaggatctaggaccttgtaagattggagaaaaaggaaactgtcatttactgagtgctttctgtgtgcatattatcttataggcacctagcttagcaaaatatctgggtgaattcattatacaaatttgtgtctgaattctcagaggacccaggcatctagatggaagaagagctaaatctgtcagaatttctaagttctggactcctagcttgagaacaatgacatagtctcatgcttccagcagacatttctttggcctcctgctttaagaacacctatgtgaaagctacttgtttcatagagaacccagagcacaggtggggtggttcagaagtgatgctatcagctatgtaaataggtgcatgacatattttggttgctttcggaaattgtaggaccattgaacagatactaaatgcttagtaataagtacagagtgctctaggatttcttgctcttttgaacacatgttttatagttggggaagataggacatatttatatgtaaaatattaaataacagcctgtgatgctaacacatagattaaaagataccatgtgcagaatggtgtagacagacttttagggagcaaattctgtctataccattctccttgaggagaaccaaaaaaaaagggaagctatagtggtatggaaaaacttcaaaaagcaggtaggaattaaagttgacaaatacttatgggtccctaccatacatgttgtgccattctagatactgcagatgtgtggtagaagagatcatcctcatttatgccatctctgcatagtgtacctactgctatggtgttgctgcattatttattgcatgtcctcattgcctttgtatcctctgtacctcgcatatgacaagcactcagtaaatcttgaatgcatgatgaacaagaagcagtctcatataatctagtaggataagtacacaaatgattttactatgtagtagaataagaagttcgaggttatttggatgtttcagatgagatagggcacattcaggatggtacggctgtagactatttggatatttcaaagacaggagtaatcaggtatcttggaaaatgattaggaaaagaatttactgatgagattatatttgagattagcattgaacagactgtgagtaaagttgttttagcagtgggaataacatccacagcatgggatagatttaggaatggcctactttatcaagacaggagacacctgttaggctgttatattgatttcagcaagaagtacagtcttcacatttctgagagatttatttcaagatcattgctacttttaaagttcaagaacacagctatagaataacattttccaccataaaacatcctttttgtgtgtgtgaaaaccatcacttgattagactatcttattttatcttcacttttggtaccacctgttggctttcttttcataagtatgacacacgcacacacacacacacagagctaatatttattgaatattatctactgtgtatcagatgcgattttaagtatttatgtgaattaactcatttaaccttcacagcagctccacaagagtttaaggaatttgttcaaggttacacagattgtaagtagtagaaccaggattatattactttgtaagagtaactatgtgaacatgagctgaaaacatcagtttctttgatacctgaatgccatgaccctagaaagccatttgtacatagtagaaactaccagtgttaaatccacaggtgccaagaatctgttgaattaagacattgtgatagaatgtattcattctaataattatgtatttattgggtgcctacaatgaatgaggtattatttcaagatatagataagaatatagcaaataacaaatgtcctgtttttatggagagagagagagagaatgttagtaatactgcagtagtccaggcaaaaaaaaatgggatgacttggactagtggaggtgttgagaagtgatcagatttggtacattttgtagatagagctaacaggacttgatgatgtaggagtgaaagaaagggatcaagaatgatttctaaggtttccgacctgcaaacctttgtgaatgagtgccactaatctagagcagaaatttaggttgaggaagtgtagagtgtacttgggagatccacacagctattccacaggtaaagattctgtggcactcctctaaagatccagccagatgttgagactctcagctgattcgagcacagcagccacttctcatagttgtggaagccacttagctccatccatgtttcttgtcttatacattcttagcacctagaaggcaaagcctgttcctccgccaggtgtataacttgtcctcattttcatatatctcgtcattctctcagactgaactattgtaacatttatacccacctgactccccaccactgccaccaccaaacacctggctgagtctcatatgttatttaattcatatactatcttctgtctcctccaggaaaatttttctgcttccagactcactctattcccaagtctgagttagtgtggtccctcctacaagcagtcaagcacgctatgtctactgcatgtaaacaccttggtcatagcacttatttatttttaagtagtcttttatatctctagaacaagagaagggaaagtattcttgctgaggagttagatatgagtagtaaaggacagatttgaggaaaggaatagagaaagaagaaagaagattataaatcagatatgtagtgtgtaaacagagtaaaatgcttgttaaggttagaaaacatctttgggtcttgacagaattttaatactctagaacagtggttctcaaccctgactgcacccatggaaacacctggggaatttttaaaattccactgccatgattgcccaaaatcacaattgctggagaggagacctagacattaaagttccctggatgatgcaaacattattaactaccattaaaaaatggaaaatgatattggttgcaaaaaaggcattgaaataggagtcaagaaattggatcattgtctttaatgcctcattacttgtgatcttgagcaagtcacttaatgcctagtgtgaattctttatctgtaacctacttggataatctctggagtcttttctattctaaaatactttgaatttaatgaagaaaattgcataaggaaataattttacaggaatcattaaccagctaagtgcaagacaggttgaaggtaagaagccattgagataaagcaccatttatgttgtcctttttagtatgggcatgccagtgagttcctagaggaagctggctgctttgcaaatggaaaaggggacactttaaggcatcagttaaggactactctctcctgcccctataaagattttaggggactttatttaagtatgaatattcagggatttggttgctatgattttattttttcatgtaacttaatattttttatttctagcaaaaaattgaataaagaatgacgtattttgccataagtgtttaagtgatgtgctgttaatcagtttgtgcagtggaaataattaatggaataatttcttagatcatattctttaagggtttctgaaaaatgatcaataaggaatttgactaacaccctgccagataagaggtaggaatctatttagaatgtgttcgtatagtcctcctaatattgtgttgttattatcaattgttagattgaaagaaaaatttgactcaaaattataaccttttaaactttttttaaaatttgtttttattctttgtaaaaaggtgataaccttttttataagatgattataagaaggaattgagaggaagtagtatagtgctttgttgataagtgcccaataaattttaattttactgtccttccagtcacctgctcatatacaagctcatttatacatatttatatttttgcctgttttagtttttttatgccaagaaaaactccttgagttcttcccatttttctttttttttctttttttcagctgtatgtcctattcttggcataatattttagagatgatttttctgtgattgtttctaattatactagtgagagattagatttttttccccttgaccctattcagttgtgttagtttgactcaagcaactcaaagttaatgacttagtatatttagtttccaaaaaacaaatctttatatatacctttccagtgccattctttatgttttaaagaaattcagtttttaaaataaatttaaagtaacaattattaagtattcaggggttgatgatccaatttgaagtgatatattcttttttgatctttttatactacttcaacaaaattaaacttagactttttgaatttattagctgtttttgtgaagattaattttagaaagctaaaattaaacactgaaagtaagttactttattccatacggtctctgtccagttttagcactaaaatcagttcaaggatgccaatccctaattggccaaatagccttaccattcttgttttcttctccaaatttgtttttttgctggtcagataacttccaatttctaaaatattcctgaaatgataaatttttatgatacagcatagaataatatgtatgtggagacttgaaggagtcaaatctcaatgagccttttgtagggcttaacgattgttaaaagggggccaaaagggcactaatttttggaaagtgtatgtttgtttatggtggtgaatgtgtagagagggtgaaaagtaaaggaaaagtagaacaagaagaaagaaaactgataggtatgacgatgagagagaaagaaaatggaagagagcaagacgtggagatttagaaaaaaggttgagggaaacatattcaaaagggaaaaagaaagcagggggaaaatacattagaggtgttgaaattagtaggcactcacagaggtgctaatcgagagttctgttgggctcctgtcatgctgctattaaagagcattagcagctaagagatctaaattctagtcctagttctttgtgttgccgtggagaagtcagttaacttacatgaggctcaggttccttacctgtgtgtaaaatgggaacattgaactaggtgatctttaagatcccttccggctctaaaattgtttgacattatcttggtggtcagtaactgtgagaaacacattcctgaggaaaatttgcagctatagttgacttcaggacagcatgtttagggagtagaatgtaagctccctgagggtaggggccttttctgttgtgttcactgccatatccccagcagctagcacaatgcgtgttacatagtaggcattcattaaatgtttgttgaatgaatgatgtgaaaagtatgttgatggtttgttaggagcacacctagaaagcctcaaagaaaaatggtgtgctttagggagggaaaagacagatttcttctgaagaaatcttaagcaagctgatttttaatccttattcttccttattttgtcccagattcaaagaaagtggcttcagctagtgacattctcatagtcacaaaacttacggtgactgtagacatacataaaagtgtacatgtaatctaggccagttcccttaaagtatcttacagaaaggcaggaccaagcttaggtctccatggaatctgagtgaaaagtatatacatggaatatattagttatattgaattagattgattggattaaaattcattcagttgagaggcacagttagtctacaagctgagatacaggctgccaaatttaagataacgatcagtgagatactcgctaaccactcctatccctaggttagaaggtgaaacattattatgccaaaggataaaatcaccttaaatccctagcactgaagtcatctacttactgattagttctcactctatcttatcacttttatttaatctccagttcagaataagtttggttgatgaagcagactagaagtagaaagcactaaaaagtgtgggtcaggaagatggaggaaagggagaggaattcgtagacagatataacagtgtaagtgatagctgtacttcttgactttgaagcataaaagggaaaaaaataaacgtatgctgtctatgataattatcctggattattaaaaaatttataattcctatgatctgaataaaaactcaggaaatatacatttctaaaaaaagtttatccacagtggttttgtttgtttgtttcgtatgagaatgataaaactcttagcagtctttaaaaaaaaaaaaacctattagaatgtatagtccatccccacacctggctccaggggtactagataaatacaggggcattatattttgacgtctttttaaatgttttaaaattttgtcttttatagctatatcagtttgagttttttttaacagttgctggcattttatgttgggtttgtaaaaacagtaatgttgagaaatatgtataaatagtaaattggctttttctaaaatataattttaaaggatcacataaaattaaagctacttcagcaaagcggggttaaatgtctttctgtatacattagttgtgaataaagacataaaaacacattactgcaaaatttcataatggcctctttgtatatacacatgtacatatatgcaaataggcctttaagaaattttagagcaatatccattcataatattgtaacttgttagtcatttacatacttcataatgaaattgaaatatgaaaaataggaatatgaaagaaatatccattcataatattaaatttcagactggaacatattttttgttaaaatcagagtttatttggagtgaatcgaatatatccatttaaaatttgcgtactatgttaggtcattaaaagtgtcttaaatcgccaactccagaagatggataacaatttcattcctgatggcaatgaatttccttcttctgaatttttttattaggtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggtatttattgatggaccagaatatttttcaaaatgtatcttggtagagtaaacaaacttttagttttttaataaggtaattaattacttgattttctggttcagtgcctttcactgaggaagaaaatacctatgctctttttatttcagtgcaaattgttaagtacagtacaagtggtttttatactgcagctcgcatactggttgtcagtggggtggatatcaagggttaatcatttcctggggagctttttcaaaaggcacctgtcttcctcaaaggaatatgtgcaatttaaaattcctccccagatgattgtgatcattgctccctcgccacacatccattgctctaatgagcataaagtaaaacagatgacatagactatacatttagtatgcagaggatagaacgatatgccattgaaatgaaattattctaaatatgtgtgtgaaatacatttatattttatgtcacagtcacaccagtagttctctcatcttagataccaccttttatcagttgcactataatttgccctttattgtttgtttactttttcttttcaaagagctagaatgactaaagaattaataaaaattagaactgcaatttgaaagtatatttgagattctagggttggaccaattgattatttaaagagaattttaatgagtgattgtagagagcttatttagtataatggacttctttttcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacaggtaagatgtttattgatactgtgtataattgtctttctgggtatactcagatttgccttttcatattttcactttgttcttgaggtgtggcttctctctaataagtgtgtttcatcatgcatttatgtccaaagattctgttacccatcacaaaacgatacgttttcttgaaaatcaggttgattttggaaagcacattaaaacattttgttgttgtggttgttagaaaaggattgttcttggattcgccaccaggcaaattttggttgatatgtcctctctttataaaataagttgattacctgtgtggtaagagttctaggtttatgaatagaactggagacatgtttgactattactactttgctttagttatactttgagtaccttctcaagtaagatttggttttgtgcattggagacttaccaacaaaagactttttaagatcacatctatagtatttgaaaaccgtatcatgtttagggattcaaaacaaaaaaacgggtttttgtactttttcacttctctttgtactgtctgttgcatatactttgcgaataagaggagttactcattttgttaggattttcaagctgtttgggtaatttgtatgagaattatgtctgaaatataacactttcttgcaaaagtagtatttaagcttgattgcctacatgtatatatatgtattttttaaatggagaaatgtaggggcaaaactaccttgatctagttgttatcatcatacctgtttgattcactttattctgtctagtaaaatctgaattaaaataggtttagcacatttactgtttaatcctcattccataaactccaggttttgcttttatttagatatctataattttactgctcttttaaattttaaaaaacttatttgtgaagggttatcaaaattctcatctccttgatacctttctaaccttatatctttatcataactttatcatatctttgtgcgttctcatagtattgggcattgaatgtataaatttttacctttccatagtttttcacattttgtttttaaaatacactttgcttaaattgtcaatgtaacatggatctctaaaaccctgcttatttctactattgacagattgtatttattataaattgttttcatctctgagcacttattccatgtttgatggtacctgtaatagcatcagcaattctaatatgctattaaacaaaaatttccattgactttctggctcttctctagagtgtttgttgttttgtcagctgcatgttttatcaaaaaattgtttcactataggtttatagatttagtcaaaacccaaaaaaccctgtcatcttcatacagattaaccccgcttacagcattgatacactaagtgccttttatcagaagaatatatgacattaaagacatgtggtttcactatagaatctgcattaacaattcctgttgacactcttaattatttggccttgctctaagttctgccttatttttttttttttcttcacatgcttagtcttgtacaaaaaagggagggaggcaactgtaactatttacgaaataccagttgtgtattaatttaaaattggggacaccatagactgtgttttcttttaagtatatgaaaggtaaactatatttagataagaatgatgtatttttgagcactgaattcaattttaaaacgcaccattcaattcaggtcactacatatttattgaatgtctattatgtcttcctgaacactaaagggcagaagacacagagaggagtttaacatgggaggagtatgacataaactcctgtgtccatgaggagtttatattctagttgggaagatgaatactgtaagagagaagatctattatgaaaagtaatatttgcaagctttaccagtaaagaagaaaaacaactatttagcaagaataatcttaacactaacctgcatatttttgaggttaggtaattcaggtatccaggaagttggctcttcaagtacacaaaatggtgccctgaatctgttttcctcaaggttcatatataaatttttgagtttttgttttttaactaatctgcctaaaatgttctggttctcatttgttcatggaaggactttagagaagttttcaagtaaagataaagaatagattcagaaaaataatattagtgttggttttgaaacatattgttattttatatggagaccaaaaatacacacttctgtttttcttcatctgaaagttagtgttcttactgtatatctaaaactattttctatgtacccagtatgtctggatttggaatgaacaggaatcaggcatttggaatgaataactccttatcaagtaacatttttaatggaacaggtaagcttattctggagctagtaccctacaaaaagtatgatagatttatgaaatataaagcaattcaacatactggtctttaaatacggtaggattttttattatgttagatggtagattttaattcagtgaaaaataggaataggattcaatacagtgaatagttgagagagatgtaaattttttttacttagcatggtaacgtagtaatttgtgttataacatcaggattatttccttaacacctggagagagcctacacattaacttagttagtatttatgcctcaaaatattttgcttcatagcttttactgtcctcagccctgtcactgtgagaactatagcttagactaggttgggtggtatgacattctggctatggagatccagattgaagagaacctttaaaattgtatggaacacttacgttttttcttaatagttttaataatactaatgttggcatttaacctttatgaattgttgattcagttttatgtataaaatttagttacatggaaaaccaactctgattttgacagtaaaaaattccttcagtcttttggtttatttcttttatcaactgcttcagatagaagagaacaggaagctttgttgctattttgctttaggttttaccttctccaccctacagaccctttcctgagaaaggaaataaaggatgttatgatcataggagcaaaaatgaacagcattattggagaggattaaatgtaaaggaagtggaaggtaaaagaatgctcactgaaatggagcatttgtagaggcaagagaagatttaataaggaaatgtcatttgtagctatgagcttttaatttctaaatgttaatgtatgctcagcagcatagattaatcacacaagattaaaatctttgaaaaaagattccaaattttagcatttgtaagtggtggcttgtgttcaagatgtagtatgaaatactgtattccattctttctaaaatgtacatttcttcataatttaatgtctttgaaatcaggctacatctgcatatcatagtttaattgtagtttttttctaaatgtgatgtaaattaacagtaaagatgtctgacagtgccatcttagattctgcattatggttttatacagtgctataaaacttgagaattattttttaaattctgttttaactaagcatattttatgctaggaaaattcccaattctttcataaaaatatagattgggggtttattaactttattaggttgaaacatagtctcaaataataaatggcaaatttaaattccatcttggaggacctaaagatatgtattaaaagttaatatatattcaaaatgtatgactcatttataatcaaagaatttgagaaattataaattgaaacaggatataaatttttaatttctactgtcttattcagtggtaattttttattcaaagttcttaagctgcagaaataaatttataaactgcagtttttgtaaacagccaggtataaatgatttatcctttacccttgtaatttgaaattgtcacctgtctttgaatgttaataaattaatggtgtctattgtttttctgtcaacaaagtaatcttgagataacagttactgtttgagattcttacagttgtgaaatttggagaaaactaaaaattaattgggaagtggcaaaataaattgaaaatggtaaaacaaaaattaaaagctatagcgcaggctaaaaggacggtagaaagttttcttcaaaaattaagaacccaaggttataagaatactaaaaagttaagaaattgagatgattaaaatagacaaagtagagaagttgggttaaattttaatttttaaaggaagccagctgattgttttaacttaaaatgaacaaaaatacatttaatttattctatatatatttattgagcgcctactgtgtaataggtaatataaacttctgggctttgtatcatatttctatatttcctatccatttaccatatatgggaaccctactgccaccctgttgtaccccaccctcaaaatgcgcacatgcgcacgcacacacgtttgtatatgaaagcggtcaattacaggtggaagtcctcagggcttctgcttcactgcctgtgcctcagctatatctttctggccatttgcaggaggcactatcattgtcaccatttgtgtgtaaccgaagcttcaagcattctagatataacctccatctgagcataatgaaaagacaagttatatcgtaacaatctccctcttgttagctcacaagctataattttaggttaccatcttccatgggggaaatatatgctttttattctctttgttacatctctaggatttggggtttctattatgctggttgcgtattcctttgctaaattgttcatggaattctttgacatgaaatcaatctgcaagtatcttttgagcacctacatacacctagtacagtgccgtgcattatttaggaagaaggcgcaatcatttcgaattatattatggttggtttttataatctcttaaaaaatatttgtagaatcaataaccagtgtcctttcttattatttagacggaagtgaaaatgtgacaggattggacctttcagatttcccagcattagcagaccgaaacaggagggaaggaagtggtaacccaactccattaataaaccccttggctggaagagctccttatggtaattaagctttttaatgatggccagtagaaagtttccattgtatgtgcacacacatatacatttacatgtacgtatacatatgcttgtgtgtgtacacatgtatgtttgcattttctaatcaggttagtgtaattttttcagaattgatatattagaagtgatttttcttcccagaataccatgatagcaaagttaaatgggaaaactttgtacaaaaacccaagaggaagtcctcattggtattcagaagttattttcttctgttatccctgccttagtttaccttaagtgttttattttgtggtctgccttttctctccttaattgatcacacattttttcaaaataatatattcctggtgattaataatgactgactatacattgaagatgtttttctgagccaaggtttttctcaacctccacactgttgacatttgggccaggtaattctttgtagagaggagatgtggggggctattgtgtttatacagaatgttaagcaatattcctggccttggcctacaagatgctagtagcactttctgtttctaacccccatagcctctattgtgacagacacaaatgttttcagacattggcagatgtcacctggggaaaaaaaattgccccctgttgaaaaccattgctcatgggtcatgtatagcttatgcagactcttggtctccgttaatatccttcatcaccctttttcactgtctctaatagataagaaatttggctaatcagggataaatggaaataaaggaggggaaacatatgcaataacaatataacaatgtagatatgaaaattctgtgacagcaatgtagctatactatttttatcacatagtttttttcttttgggaaaacctgatagagaccagtaacaaaacggtgaatttaaaagaatcagttcatccattattttaagatagaattaatatttgatcacattttcaaccaagaaggatttctgtgccattcagatatgaatacaaataacagtatatgaagaagggaaacatttattgtttatattctaaagtttccaaattagtctccccaaaataaaaaaaaaaatgatctgccctggaagttgagtacctagctacttgattctcagttcagactctaatgtttttaacctttcctcataggtccattttttcatccctttaatcattcccgttgctctccttggaccatctctagtttctccatatcgttcttgaattgtggagccccaaactggatattgttctccaataagggcccgactaatgccaagtatagtgggaggattatttcccagttcttgcatgttttacatctataacatggagtccaagaaaatctgaaataatatggagttgttttataattgattgcaatttgctcactctgtaagtcgctttcaagtagaatactgacatattcttttaaattttattttgttcatttgtatttgagagttaactggtatttataatatctagtcaaatatttaaataaaacaagcttttaaaccaaaattgttaataattaatccaatatcaaattaaatttttaagcacctacgcatgacatggattactgttgatttcccttgtattattttgtatgttgagttattaatcagtaaatgaaaatttagttcttcattgttaccctggatactaattttttgaagtacgctttcatagcattaaaaaaaagaaaccttttggtgtattatcatgaggaaagttaactttataatctgtagcaaaatatcataaatatcaattgcaattctccggattattttcattacatagttggaatggtaacaaaaccagcaaatgaacaatcccaggacttctcaatacacaatgaagattttccagcattaccaggctccagctataaagatccaacatcaagtaatgatgacagtaaatctgtaagtaactgagaagtgtgtatgtgagtgatgtagtttttcccttcagatttctcttatattaacaattacttactaaatactattacaaaactgttttatcttgatatctgtaataacctaacttctgaagaatgtggaaaagctttataacttagaagatagcctatttttttcctatttcatataggtttgcaaatttctgttgaacttctcagagttaatttagacttttattgtagtccctgtcagctggatcccatgaagtttgataatatagccttctaaggagctgtgtttttcttgagtaagttttctccttgaagaatttatacacatttttatacctgtgttgattcaaccaactcagcttcttctttctgacttaacaaatatgtttatttcttccacatttcactgaaaatagcttttctctgtgtgtgatgggagtttatatattattaaaataattgataaagaagatcggtaagaattaaaataagtacaaagttttaaagcttgtatgtctaacttatcttcaaggtagctttggtgattttaggtaatatactatatttagtttctcttttacatgaaagcattgaggagtgtaacttcaagtgtatcccaaagcataaagacctgagaaagagatagatttttttttttctgtgactgaagatctgagataaataagatattttcccttgatttctttttctttaaatactcaaatgtggatgatataggatttatttgtataccatggaacaatgatggaaacaattttctatagaacttgaaaaacaggtaataatttaactaccaatttaaatgtaataaagaataaatagcaaggtattaatatgtgaacttgaatttgtatacttaacaaattttaatgtcacatttaatttttttcatgctagaatttgaatacatctggcaagacaacttcaagtacagatggacccaaattccctggagataaaagttcaacaacacaaaataataaccagcagaaaaaagggatccaggtgttacctgatggtgggactctagaaatctatgtcaaagatattatagaatgcttttttttctattttttaactttttcttgaaaataaaagcaactgtgtttttcctacccaggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgagtaagttttttctgtttttccatgtctgtatataatacctcttcagacttccagtttttaatatcatgtcatcaaattatctcacctactgctactcattgttaacctgctgattctctgggtcattcccattcatgttagctcttagatcactgtcactctgcagtattccttttataatttggcattttatgtgtgtgtgtgtgtgtgtgtgtgtgtgtgtgtgtgcatgtgcatgtatatatgtgtgtgtgtatatatatatatatacacacacacacacacacacaccttccagaatcctgaaatctcagctccttgaatttctttcctccaggaatttttgtcctgtagtatacttcagccactcctttagttatccctttgacctagtcattgttcgtaactgcagtctctcaattttaaaatctgagctcgcatgctttccgacttccactttctattttctatttctcttcttctagtactgtgattcctgtaatcatttcactccattgggaccttcaatctattgattcttcggtattttaactgttcttccagatccccgtctcttttcccctgtgatcaactcccttcttacccatgaaattctgtggtcagtcataattgttcatttacatatcccatgactacttgccattttctcatgttgttatacttgcatggccaaagctacagtactgattgtttctgcctatttcattcctgacctgtgctactgagctctgctagagaaaaacacatgatatcactgcctggtcttcctttattttcatgcccaggagcctcaaaagtaggctcttaattctaccagtgataattataccttgcatgcttagtccatttactcttttgctctcttatgcaactatcgtacacttctgcatgcccctaataccttttctccttattcttactatcaaatgatgatcttgcttttcacttttactgtactaagaaagatggaagcaattagaagagcacatttagcacagtctagccaacaaatctgactacctacagccacctacacctatgttattcttgttttccaccctattaccataattgacccatgcgttctacttacaacacattttcacactttgttgggtcattttcatcaacatagaaatacattgttacttctctcatcttagaagaaaatcttcctttgatccaacctcctccgtaagttactttcccatttctttatttccctttgaagcgaaacttttcaaagagtcatctccatttctccgacttggtcttctcccattctctggtaagcccatttcagtcaggattttgtccctgccacttcactaaagctgcttttatcaaggtcaccaaatgaccttcatgttattaaattcagtggtcacttggaggaactcttgctccttgatacacattcttgtacttgaatttgagagcaccatttttacctcatcttcactggttggtctttttcagtttcctttgctggtacctcctccttttcttcttgacctcagtgtcattcctcttctctgcatttacatccttgatgatctttttctagtcttattgttttaaataccatatatattgaggaatcccaaacatatgtttccattccacacttctgagtttgagatttctacattcaattgccaattaaatatttcttgaatgatcaccccccaacttattctgtctacagcctttccaatctcagttagtggtaactctgtacttccagaaacttggcattattcttaactcctctttcttttataccccataatcaggcttttcccaaaatatatacagaatctaaccaaagctcactacttttaactgctaccacccttgtttgaatcattctctcttgcctgaatactccattagccagtcactgggggtccctgattgtccttataccccttcccgtacaatctcttcatataacagccaagacaatccttttttaatacattactcctctgctcaacacccagtaaatgtttgtggtttcattatgattaaaaaccccaaatcttttttttttttttttttttttgagacagagtattgctcttgtcgcccaggctggagtgcagtgatgcaatctcgggtcattacaacctccacctcccaggtccaagcgattctcctgagtagctgggattgcaggcatgtgccaccatgcccagctaatttttgtatttttagtagagacgggatttcaccatgttggccaggctggtctcttaactcctcacttttcaagtggtctgcccaccttggccttccagagtattggaattataggtgtgagccaccgcgcttgaccagaaaccccaaatcttcacaggcctgcaaggtcttacatgattattgtttgtcccctaaccccacctcaacagcttttccctttgttcactgtattccagcttcactggccaccttgttatatctcaggcatgtcagtcatgtccctgccttagttgctctaggagttccctcagactagaagagtcttctgccagataattaatatgactatgtcccttatagccttcaaatcttcagatctgaccaccttaatgaaacctaactgaccaccctatttaataattatgcatccagtctcccctcccagttcccctctaacatgggccattgtttatttatttattctgttaattgattttgtctgtccccctccaatccaccatcctcaaccagaaagtaagtttcatgttgtcagtgatcttgttttgctcactgatgtgtcgtaagctcctagaacagtgccaggcatataataggcactcagtaaatatttgatgaatttaaacttttgcaaatagttactcagttttcttcttgccacacaaataaatgggaaatttatttaaaatttatttaaaatttaatttatattgggagcatggtattgaagaatttaaagcatcttgagttgaaatcaagtaaaagtagaaaatttttaatcatgttttgtatattgtgatatgttgtgttatttatactgtattgcaagaatactgagggaaggagtcctatcatattttacagacacacacacaaacacacacagtcttcatttgcttctgtataagtcagtaaacccaagtaagggaattagaagtaaagatggtcattttacagttggagtctttgtttttcctgaaataaaattagaaatctctttttctggatttcaaaatgttttcttttcctccttattcagaaatctctaccccaaatttgcgtcaccctgggcatcttcaccttgtcgacctcaagacataggtaggagaatctatttgtgtttagaccttttaaaaagaaatttacaattgagaatcagttaataaggcttttttcattttattatccagacttccatgttccatctgagtacttaacgaacattcacattagggataaggtgagtgtagtttattattctactcagtcagcatgaatttatctatttttcacatgtttttcagttcaggcagcatactatttttgaaataattagtaatggtctcagggatatgctttcatatgtccatgttaacttgttaaatggtaaatgttaggactggtaaaaaataaaaattcttacatttaacaacaggttacaaccataaccgcagttgatgagaataaactagattggaacatttgataaatatccttctgataatcttattttatgaccttaccagtaaaaagattttcgttacaagtattacagatacagtgtttttaatgagatggtctgtatctttaaaaactatttatgacctttgacttttctctgtattttttcatttccatttttttaaatcacctaaaattctaattctaaagtagttattaacaacagattacagcttaatctctcttttttcaatctaagaaagaaaatggtggcactttttgctttagaagaactgagagtttgtttctattaccaaaaaatattcacaatggtacctaaattttagccttgggaaactacaatttagtgaaaaaatatatttttgttatatatttgtgtataaatatctatgtgtatgtgtatatatacaacagcattctgagtgtgccttacagttctgtggtcaagtggatgttgatgtggacaggcaagtaaagggatacctttctcaatgtcttctaatacttgagtagataaaaggcaagaaatacaagatggagaggtctcctattttctatttgcggattgtgtgatttgctcccaccaccactgtagagctctttcgctccaattaccaaagtgttccagaaccttttcttattaccaatttgagaaatactaatttaggagaatttgtcacattggggctgctgcctgaatagggataacatgaatggagagaaaaattacattcagagaatgtgtaataaccaaataagtatttcgatataggatcaaataacgagataaaaatgttgttttgggacacttttaaggtttatttaaatgtgaaaatttgagactattgaacctatgttttacagtttggtaagcagttatgtttctaccttggggagagaaatgtaaagcaatcatctttcagacatctatttaaacaaactgaaaagccatttctttatgatttttgtattcatcatctgtgatttgctgaaagcatacaactgacttgtgaatcattcactgtcagatatagattcagtttaacattttttataagccgtctatatatttggcactctacaaggtgctttcatataccttcactcattttatttactttcttagtaaccctcataggtgtcattgtccacatttgacaagtaaagctaagagattttaaataactaggacacagtcatattaatgagtaataaaaccaggacttgaatacaagtcctagatctctgagcacaatgctattgttaggttcttttccccattgggtattaaatccttttagtggatcttgcttggaagtctttattgagcttttcttccagtcagcatatcaattagatgtatcagaaataattgtttaaatgacttcagtcatttaaatgaggaaattcccttttagaatcttaactacctatctgtgtaatcatgtaataacagttatctactacaaagtggggagtttctgtttatctctccattttttctttagtagtagcaactatatattaggatttgcagatttgttttatatttcagaataagttatttttctttttcagctggctgcaataaaacttggccgatatggtgaagaccttctcttctatctctattacatgaatggaggagacgtattacaacttttagctgcagtggagctgtatgttcaaagtattttaatcacttttgtattatagtggatcttgactatgctgaaaacatctttaagtgatgatggctatctttaaatggaactatttctccatcaagaaatttatttttacattattaaagtgaatttaatttagattaaaaccgtatcttaaccatggcttcataatctatatacctaaaaagaatttcaaacttaatgctgaagctgggtgcagtggctcacacttgtaatcccagcactttggtgaggtggacagatcacttgaggccagaagttagggacagcctgggcaacacagcaaaccacatttctacaaaaaataaaggaaaatattagctaggtgtggtggcacacatctatatagtcctagctacttgggaggctacagcaggaggatcgcttgagcccaggagtttgaggtgtcagtgagctatgattgtgccattgcactctagtgtggctgacagtgcaagaccctgtctctaaaaataactaataagtgccaaatttgtaagaagacagaattgacataactcatggatttggtgaatctaatttttgtaaatatgtgaattatatgatattcatgactatgttttttattccttgtggaaccatatgtataaataattcgatactgaatttaatcatttcataaacattattacttataagcaaggcagtgtgcatatttgttgtacgttttgaagtgctgattaaagtccacattttcattatcagcagtctattggccagtttaaacaaatattaatgtaaagaaattggttcattgatattttttccctgagcagttctgtatttacctgatgctctaaaattaagttttctgtcgttactcaaatgtacagttggcaacacattttgttatcaatagacaattatgtttactatagagtaaactattagtaattatttatgaccttatgattgggagaccttttcacaaatttaagtatttcataacatttctaataacatttctataaatggctttggatcaaatagtttaaagtatataattcagtatgttgataatgaattgtttcgtttcatttcacaactgagaggatttttcccttatgtttttccttcatttttgtgagaatagagattattacctgttgttccttttaattgttcataagtaaataaatacattcaggcactcattcatctatcactggcagttctgttttcatattttatttatgtcttaaaaactacctcatgacgttggtaggaaagcatttctttacatggaggtttattttgtgggacattacctcctctggatgttacttcctcagtttacaagtagtgtaaattctcattgattcttttatgaattgtaatggattttctcttagcttttgagaatttagaatctgaaatttgaataaaaagtaaatatattcagtataatttttcaaaatgctctagtttcaagatagttaaaaaattatgtggaatttacataattaattcaaatatagtttgtatttagttccttatcaaataatgcaaatagttggagatacctcaatttcttttgagtgttaagaagagcaagaaaggagtgaagtttttgcaacacattgtgtctttatttggtctgcctatgtttttatcacattgcttataaaacttttaaaatccttgtttgtataaaaagtttctttagttaaataaaagtgtgtgtattaattagtgtgccttctggacaaattaagaaatattttttctatatttcaatgcggttgtatttaataacttataataaatgagtaggaagcattcatatttatttattttatgtgtaattttttttttccggaggaaagctttacaaaatgtagaacatgtttgatgtaagccacaggaaaaagttaattatcttttcttttaaaaattgaagttttaaccgtgattggagataccacaaagaagaacgagtatggattaccagggcaccaggcatggagccaacaatgaaaaccaatacctatgagaggggaacatattacttctttgactgtcttaactggaggaaagtagctaaggtatatttctttccatgtgcaaatgtataaatctaaacttgaaaaaagaagtgtcctcttttatctgtttataagtaccaatacatccagttccagtaatgtgccacatatttgccaactgtttaattccatctccttggcttgacactcttagaagagtgtcccaaaacaattggtttcactgatagttacattattgaatttggtaagaggttttgtaattttgcataagccttggtaacatttgaaatattttttgtgtctactgctttgtaaaataaagatactctcttgcaaccccagtcatatatttttatatttttgtaactttaagcaaggatgagatttttctaaaagcagtatataaacaggctttttacacttggactagttgcaggaaatacatctgaatgtttatttgcaagtaattttaagaaagaaaattacaggcgttaactatgactatttctgtgactattttgctaaatattggggagaaatcggctatggagaaatgttgattattttattttggttttgcaacttttcctcacttaaacgcctttctaaccgtcccatgtgcaaaattttcatcagtgtcaatgcatatttcatacctgcatttagtacgttgtgtttatttagtctgcctagtagagaatatattattctctacatgtggagagaatatattctctccactctatatattattctccacattatctgatttcacaactccatgatttttctgatacattttccatcaatgattctgaggtttataattaaagagttaaatttgtttgttttaaataaatttaaacagcagaaaaatgtttctgacagttctttggacaattttttagttgtcaatttgtttttttgtttgtttgtagttttgaatctgctttactaaaatgattatttaaaaaggtaaaacattttaagaagacaatgtaaaatgcctaccagatatttatcacaaaaatttttacatcccaagatttcatataaaactcaaaaagccgggtgcagtggctcacacctgtaatcccagcactttgggaggctgaggtgggtggatcatgagatcaggagatcaagaccatcctgggtaacagagaaaccccgtctctactaaaaatacaaaaaaaaattagctgggcctggtggagggtgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaacaaaaacagatgtcccctaacagacaacaccaaataagatccacataagaaattaaatctttttttttagatgtttctcagtggtaaatgtctttacttctcagaccaagtccacatactgtattttgtatctgaattattttaacagttccaattcatgtgactattgtgttttcagaaggtgtatttatgagttaaccttctagttaaataatcacattaattaaaaatagtgcctgagctattgtatatgttacctgctttttaagatatgtagtatacagtagaaagctatagcctttgtatcatggatttgaatttaactcctattgctgttatttatgctttgaccttctacaattttctttttcatgcctgtttcctcttttgtaaaattgaggtgagattttcctctaagtttttatgaagattaaatgagatttcatatatgtttatatacacacacacatgctgattacagtgcttggcacacgttgggtatttgatacatggtggtggttgtactagtttactgctattgtttttatcatcgttattatagctactgtttttgcaaggatgaaaaaattagagctgattgttaattaggttaggtcattggttctcaaactatagcttgtatcagaattacctggaaaacttgttaaaacacaaatttctggaccatacctccatcatttatgatttagtgagtctgtgggtggggcctgagaattgcatttctaacaagctcctaagtgacggtagtaatgacatgctggtcttggtccagaactatatttaaagaacctgtggattaggtgatgctacaggagtcaaaaacatctttggaagaagaaaaaaattttattaggaaagaactgaagttttctccattcaatttgaacatttttgctcaatattattgtaaattattccaaacttacatatgtaaaaaggggtggatattttcagtaaacagctacataattttagttaaattttgttagatatatgtatgaagaaatcaatttgtgagaaaatcagctttccagaattaagttctcctcatgaagttaaatatttagaaaacaatgttaacattaatgtaggactcctttaatttccagcaaaagcaattcctcagtcaggtaaatgtcattttaaagaaaattgtatctatttaaatatggatttacatattttttatatattatatataaaacataatttagctcagttttatctatcgtgtacagttgagcttttgtctttatctttaaattttttaactgtgatgtgaaaaatgtgagaaataatatcattaagttactccctcagaaatctctttcaaggtaatagtttgttggtaccttgcactgacacgctttaaaattattttcatagtaatgaaaacaggcagaattgttggtattaagatattaatgagcagctcactcttggttatattaaaatacaaattcatgcacttaaaattttgaagttgcagtatattaacgggataaatttttcaaaaaattctttaaaggatgtgttcagtgctttcccagaatattgattagtaattaagaaatctgggacctgttcataagtatatttattaacagccttcatcaaattatagaaaatccattaacatgtcatgtcacaagttgagtccccatctgtaaagtgggtgtgccttactattcacagttaaagaacgtatattaaataacctcaattcactgtaagaagcctacagtatgaattaacattttaaataatagctgatattatggtgttcttgaaaggtactgaactggtctacaccataatcctggagtccattcataatattttatgtccattcataatattttgtatgagcatttttccccaaatcacttactattttcagataattgtaatattaaataagggattagataatctaaaccagaagtatttcttatcctctaaaaattttgtgaccctgagttctagaatccaatccattatttatttacataatttcctgtaaataatatatacattaaaatgttgacattggttgggcatggtggctcatgcctgtaatcctaacactttgggagaatgaggcaagacgatcacttgaagctgggagtttaagatcagcctgggcaacatagcaagactctgtctctatagaaagagagagagagagaaacatagccaggtgtggtggtatgctcctgcagtcctagctacttgggaggctgaggtaggaggattgcttgagcccaggagttcaaggttgcagtgagctgtgattgcatcactatactccagcccaggtgacagagccagatcctatttttttttttaatttaacattgtattttgcttattctttccttttatatactcattaactttttagcaggccatgttctcctgtgtcgttttgctggaattactcatattttactaattttaaatttgcagcaattcagatagtatatataatcttcatgcattaaatttttaaaataatttcttccacagttaatttttaggtgatagaggctgccttattatcagtagctttctcaaagacttaaaatttaagaattctttcggcctaatttgacctcgtggatctatcaggatttctaacagttaagattttttatgtcacagtctgatataaatgtgatttttcattaatttcacagttacatattagtacatccttatactttagtaatgtgtacttttcttcaaagattatttctaataactgtatttaagatagtttgctacttcctaaaatttaagttaatatggatttattatacaggttgagcattctgattcaaaaatctaaaacctgaatactccaaaatctgtaacttctgaatgccaacatggtgtcacaagtggaaaattccatacctgacacctttgctttctgatggttcagtgtacagtgtaaacaaaccttattttctgcacaaaatattagtaacattgtataaaattaccctcagggtatgtgaataaggtatatataaaacataaatgaatttcatggttagacttgggtcccatccccaagatacctcattttatatgtataaatattccaaaatccaaacacttctgttcccagaataagcaaaatctcagataagagatactcaacatgtaggtaagagaaagctgacatttcatgagaatttgagaaaacacctctgcagtgtgtgtttctctacataactagatcagtgattacattaatgtttttgtaatattatttgactatatgaatccattgcattcagttttgcttgaattgaacaagtaacctttggagaatacatagcctaattttattaatagaagaactaaggtatgaaaaagttgtctaaaaagtatttggaactctttctagcctttgcaatcatattataatctagaaatccttttttttccactaaaagcaaatatatacatagaccctctaatgtatcatttgataatattagaaaaattaaatgttttgttcctaaaacaaaggaagaaagcttgtgtttattcatcatatattaattacacatccattaggggcttggcactattccaagttgtaggtagtagtatacaaagtagatagacacttgctcctacagaatgtatgaggttgtgcatgtgtgtagtatgtgtgtgtatatataacaaacatgtaaatggtgttaccagtaatcaaagtaacttatgtattttaagaagaataaaagtacgtggaaaacaagattttaaaacgtggaaggcaaaattttacctatgtaatttctaaatctctgatctctatatcaaaatttctaaatctctatatcaaaattatttacgctgcttaggtttaaactatatttttctgggggaaaatgtacattgataaagttaatctagtttgaattcctagtcatacattgtagttcatcaatgtgaaaaattttagttaacttactcagtataacttaccactttgtggaagttacaattagactttttttccctgtaactacacattttgaaaacaaaaatgccaattttaatttcagaagaatgataacaaattttcttcacgaattcagatagtcaacttgaaccaagcaataaaattattttaattcctagctagggctgggagagggggagtagtgctacacagtgtattagggcaggatgtcatggttgtggtggtgattctggtgtttgctaatttttactgataagcaaataacctctgtgtcttaattactgtaccagtcacatgaaggcaaccttttcaggctaaagtcaccatggtgtaccttctttataaactctcaggggactgattttttttttcctttttcttcaccttataccaagagagaaggggactgaattctttcagcatttctggattgccttgtaatgaagtaaatgaatctgttttggatcttggactaaaaatattaaaaataatgtgttacactacaaaagacacaggctttttgtcacatggaggctttttgtcacatgggtctggatcctaatgctaggtgtgccgcttactgtatgacttgtccaagttacttgtaagcctcattttcttcaggtacaaaatgaaaataatgatatctgctttacagaattattacaaagattagaataaaattagctgtatctctaattttagcacatactaggctttcaataaattctgctgttaggtctgtaatatctttaaatttatttaagtgtaatatctttaaattttaaatacttggtgttccatcttaaaatttggtcattatagtctaggttttcattttaatttaataatggaaatactcatcatggaatcagtttgaaaccagacagataaggtaaaatatgttaacccatggtagctaatgtcacttgttgccttaatctttaatacataatacatattaagcttcataattctttaagttggattatgcagtaatttgtgctaattcagatggtagaattggtaagaggcttttagagcctcttgcttattggggttgcagaggtatttgttgtttgcatttttttctaatatacatagctattctgcatctctattcttgatcttgggtgggaagtatcatgaagaaattatgtcaccattcttaaattttaaaactcatgaagttaatacagtattttgaaagtttgattaaagtgagctgctatctagttttcaaatgttcctacagcagaaccattgtctagttttcggtggcagttgatttatatttgagtcagggttttgggtttgtgaaatgcaagtctagtgatgtgtgagttttaagttcattattttccccagattttaatgaggttagaataattttatgtgttttccttttttttttttttttagacggagtcttgctttgtcatctgggctggagtgcagtggtgcaatcttggctcactgcaacctccacctgccaggttcaagcgattctcctgcctcagcctcctgagtagctgctactacaggcgtgcaccactacgcccagctaatttttgtatttttagtacagacggggtttcaccatgttgattggtaaagatggtcttgatctcctgacctcgtgatctgcccacctaagcctcccaaagtgctgggattacagacgtgagccactgtgcgcggccctgcttattttttaatataaatgtaataaagacaatttggaaaattatttctaaacttttttcatggacaaaatctttaggtttttatacttcgttgaagggggctttattttaaatatcctgtaatttccagtgattcagagatacagtaattgccccctctttttttaagttaaaaacaatacacaacatttcagtgtcaagtggtccattagtagtctcttgacttacacacagaaagcctgtctgtattttttgtactcattggttagaaactacagcacattatttttcttcaagctgtattttatgtagaggaaaaacagttggtatatctgtgttgatgttgattcatatatattgggtattttatttatttttatagtaaaatgtattttgacaaatgtaaaatgaaaaggggaagatatctaaattcttgaatttgtttttataggagttccatctggaatatgacaaattagaagaacggcctcacctgccatccaccttcaactacaaccctgctcagcaagccttctaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcactgcagtgttggctttgatttgaaattgcgaaattatttcttcaacatgaaaaatagaggaaacaaactgaagttttacagatatcaaactgaatggtgtgactcaaatgtctttttcagcttccaacaagtaatttaatggaaatatagtgaaccgtttcacttgtaggttaaaaatgtagacagtattaatcagagaaaacttttttaaatgggttgtggcagcattagaaataaaacattctgaatactcttggaacccaaccaaagtacttctgtgaaaaatttatgagaaatttcttgatagacctttaaatttatctttaagaagtaatgtgcaaatgaaggtaagccataaggtgggaatgggtagactttaccttcagtttgctggcctagatatctcatatttacaagttagtggattcttttcccatctaaatacaaatactgtattttaaaaatcagaagattgaagcttccaaagcagaactagagagtagaaaaaaggcaatgagttttgatcctttaaattttcatttttaacctatttttctatgaagagtaaaagtctgttggcattaaccaaatcttttgaaaatgaaacatttatgacattgctgtgtttgtgtaccaggaatataaagtggcttaaaatttacctttttctatgcattttgagatatgagaaacactataaaaaacaggattttctatctttcataattaaaccaaagcatctcctcagtaagaaagatagcactatataaatcattttatctattgtgcacaaaccttcacagaacactataccttatttgacataaaccagagtcaaagcatagaaatcaatctagaaaaaaaaagattacatttttcctagtaattcactttgtaaaataaaatgtaatttttcctacataaccacaaaaaacaagtaggaag

SEQ ID NO: 13920 - DNA, 92334 bp, Human
ggtgacctaggcagagaaatagggagtttttttgttcccagaaatacacagatgttctaggtttgaccttctttgagtgtttgttaacttgaaaggatttgaaatctctggtctggctgtagattaaaagtctgtagaatctctcgaggggaagaaacttcgttttttcattaagaggtatttttaaaagcatgttttctaaaagaattgaagcaggccaggcacggtggcacacgcctgtaatcccagcactttgggaggccaaggcgggtcgatcacttgaggtcaggagttcaaggccagcctggtcaacgtggtgaaaccctgtctctattaaaaatacacacacacaaaaaaaattagctgggtgtagtggcacacgcctgtaatcccagctacacggaaggctgaggcttaagaattgcttgaacccgggaggcagaggttgcagtgagctgaaatcgcaccactgtactccaacctgggtgacagagtgagactctgactcaaaaataaataaataaataaatagaattgaaacaattttcacttttttcttttttcttgttttaactttcctcaaagtagacacagtagatatagtagacaataacatagctttatgtatagcctatttgaaaaagaaaggaatatgccatccttcccgctgatttgaaaattagaatgtggaatttcatttcttttggcagttgttagggatggtgctccaaaaaagcaataaaaaattataaaacttgttgcaatattttgcttttctcacttgtgtacaattaaatatttttgctctttagttattgggagcttttctaaaatcagttttcagataaataaccgtttgggtactgaagcagttgctaaagggcatacagttagggctgaacgctgaataaatgccattttttttttaacttgtggagagctgactatcaacagtagtttccacaaatgagagtttacatggctgtcttcttttggctggacaattagggatgaaatggctttaactactggatgataaaactgttagctgtgggttgaacacttggtagtgattatatttgtcgttagcgctatttacataagatttagggaggatacaaacctatacaagagaaaagggaaagtgattgggagaaaagaatggtcaagctgacaatccttttggggtctttttctcttgctagtgtcaggggatgccaccgggacaaatgaatgctttgaagtgagaagggcaaaagctctctaataaaagacttcaggaaagagtgcaggcgacctggggaaatatgctgcggtcaagtttaatcctgggaaaaagtggtcctggagaaagcagatgaggaagataggaaggaagatagggagggggagacgctgggtgtggagggaggaaaggggcgggggtgggggcctggaaagtgacagggagcaagcactaattgtggctaaggcgactgggtcgagaaccacagactggggaaaagggagagtacgggaggaggaggaggcagagccccgcggagccggaccggacccctggccgggaaggtatcggcgcggggcagcgggggcagcttggcccacatcgggccccttggcaggctcaggcgttggctcctcggggctccctccctcgccggcgcattgttcctttgccgggagacgaggaaattgccttttgattgcggaagtcagcggacggggctggggcgaggcagcgcgggtcagaatggcagcgtgggaagggcggcgcgctgcctgtccccgccgcctctcgcgtccgcagcccgcccggggcggcaggagcagcagcagcagcggtggccgcagtggcccctgcgcgtcgccagccccgagggaagcgcgctgcgcccacggggcgcgctgagcgcgcgcaacaggtgaccccctgccccggccctcgggccgtcccacgtccagccccctcggtctcctctggatcttaactactgagcgcaatgctgagccatggagccgggttggccttgtggatcacactgagcctgctgcaggtgagtggcccgagaaggggtcagagctgatgcgccccctccccgccgaaaaccaaattcccactccactttctcgtctatcgggttgtgctttgaagagggaggtggcaaaatttcttcttctgccttgggaagaatgatcctctggtgagccccccaacccagaatgacagcttatccagctgtcaaagcaaaaagccaccttctctctccagctgctctcaagggacagcagctagggagaaagttgccatccacctcccctgcaagcctcttctctggccagagggcaaaaggactggctgaggcaagggacaaaggataagtagaggagaaagtgtggcttgaggagcttgctgtggacatgtccctgagcagtccagactgtggacttaaactgttgtgtctgattcctttgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacaggtaaaggatgacaggtgcaattggatggccaagccacacggggttgggccctgccttttcaagctggtgtttcatttgagttccagggatacaaaaaatgaaggtaaaaatacctgtgaagataaatattgacagaaatgtctggtttcctcagatctagccagaagcagcttggtggactttcagagactcccttagtgctgaaaacagccaactagctactgaaagggtcggggtggggtgcagggcggtcagcaaagagaaactttgggctgcggtgggaattttttaaagtgatgtggtttaagcttccattgcattaaattgtcaaaccctggaataattttaagtaaacgtttttagaataaataatagaagtacaatattaggggtatgcctttcctcaacttagttttatttttagaactgtacataaaatctgcaggaatagaatggagccattcatcagggaaaattagaaaagtctcttgaaatgaggacatgaaaattgttttgtatctcttgagtaataacccaaacagcatagtatcagagaacgtcctttgattactttacagcaattattttccttacacttttgctgaatccctccatgtggatatgttcagagtttgcctttcttgcctcagttttcttatctgtaaaatgggagtgttagacttaggtcattcaagtccaagttcttaccaagtgctcaacacttaggtatgggctgtcatgtacattacctcatttaatcctcagagctaccctcagacatgctctaaattctttaacaattttcaggttttctgacttcattagtcttcattatctctatttgttgcaacagtgtatccttaccttcatccagagattcaaatttatgttaaaattttaaaagtcaaatttagaaatgtgttgcccttagtattctttcacatttcaacctgaaacaggatcatttcttttgctacagttcttcaaagaggtgtgagaactttcagctctaaaggcaggtgcagcagtttcagagaatttaactgggctcatgtagtaagtcaactagatattatctttttttttcaaagaaaaaaatcaaaatgcccaattacatcacttaacttacttcagatgaaacttttagatgatatctgagatttgcagcatcttaagttgaaaagagaaatcgcttgttaagaatctggtggtttctctgactgggcgcagtggctcacacctgtaatcgcagcactttgggaggctgaggcaggtggatcatgaggtcaggagttcaagaccaccttggtcaacatggcaaaacctcgtctctactaaaaataaaacaaataaataaataaaaaattcgcctggtgtggtggcgggcgcctgtaatcccagctacttgggaggctgaggcagagaattgcttgagcccaggaggcagagaagccagattgtgccactgcactccagcctgggcaacagaggagactctgtctcaaaaaaaaaaaaaaaaagaaaaggaaaatgaatctggtggtttctaatatggaatcagagagcctgaaatagaccacataattagaacattttacaaaagttgaaaggctgggtttttagtccaaatgttgttggtttcttaatattacaggatagttcttataaatactcatattgctaatactgtgaaatacataacatagaacttacagatgtgttaattgtgtttagaaaggcatctggccaactagtgtatgtgttcagtggagcagagcaatttgtaaaagcaggctgagctttcagaagtttgttggagaaaagattaagacctttaagaagccagaatatggttgtttaaaccagaggatttactttttggaaaaacagtaatggaaaaggacttactgtgggtgtaattagttagaataggctttgagtttaattatgcaagtaggtattcaagtccagaggcatttctgaaatgtaagaaatacttgcattttattgaccatgttgagtgaaacaagacttcatcagcatccacaatgtgctagcattcagggttctcaccatttttcttaaagagacacactttacttgtctacaaatattatgagctgcatgataaatgtgaagcatgaaagttgcaggtggtatttgcataatgataaatttcccacatgtatttgtatgatggttgtttagatttaaattacttttttaaataagatattttaaaaattgtttcagggaggaattttttagtcggttgttatttatttgtcagtagttctttctacattttaaggacatatgtgaattgttcacttagttaatacaaagtactagtattcccctatgttaattgctgagctatagagatgagatgcataaatcatattttactgttattaaagcaatgccaactagtataatattcaaactcagacaaacttcaaacaaaaaagtaattgaaaatatctgtgctttctttattctattatgcctgtcttatcagtctaaaacaaaatagaatgagagcaagacatgatttggatagaaatatagttgttgcttagatgatctctatatcattccaaatgtgactggcctgattatttttcctgataaactgtctaaaatagctcattattttcatgtcatatagacacgaccttaaggataaaaaaattgaattaaatgggcaatatttcagcaatagtcattttccattccagatttaaaatcagaatcgaagaacataatggatttaaacccagttcagtgcacatgtatcaaacataatactgttgggaactatgccaggtagtgattagtaagcttataaagatgactaacaaaaagtggttcctgaccttgttgtctcgtgcagaggtgagagacggttatgatgaaagtggcaacagagctttatctcatcttttctggatgaggactttactctgcctcatgtatgccatgctttcataaccatagaggacaagatatttggcaattctcaggtttacttggtcattaaacggtcaacgcaacaagaatatcctttgaaagccaaagtatttagtgtgaactcaccagaaatcagacaatgaacataccagatatggaataagttggcatttttttttcacttcttgtagagctcttcttaaacttggcacttttgaagactgtactcagagtctagagcagaggttgcaaactggtagcctctagagatagctaggtgtctaaataataactatgttgtgtttggctcatgtagtgtttgtgaaaacatccagatcatttcaccagcattaaaaatcaaaaattcacattaaaacccaaatgtatggattctcttaaaattttggaagatttggcaaaactgtgcctaaaactctctagagctgacttgtgtcttctccttttagataccaactcactggaataccacttcattcatttccttacctgaatgcattctaaagacatttgaatttgtgacttctactttgtggttttcatttgaaaattttagggagcatttatttgtctggcaataagaagtaggttttcagtacttaaatggcatctaatacatggtaggtgttccgtaaatactgattaaatggatggatagatggatgaatggaaagatggatgaatggtggatctgggcacggatgatgagtagaagagatagatagaccaatatatagatacagataagcatgtagatgtgaatgaatgaaattaatattttagtgagagaatgtacatatactaaaaatatattctattctcattggattatgggtagattacagagcccagggaagagttgtagtggtagataactttacctgtagaaataatattttaaaagcattttccctcttgttaagtcagtttcagctacttattagtcagcctagaaaaataaaaaacaaaacctctcaaatgattttaattattttaatatggctaacttgtctttaataaaaaacattttaggaacgttaattgttgaatcaccatatcagctattatttccacttcttattgtattggtttactaggagtgtcttaacaaaatacccctgactctaggtggcttaaacaacagaaatttattttctcacaatcctggaggctagaagtccaaggcgaaggtgtctgcaggtttagtttcttctgaggcctctccttggcctgcaaatggcacctttttgcatgtcctcatatagtggtacctctgtttctgttgtctgtctgttaatgtcttctcataagaacaccagtcatattggcttagggcccgctctaatggccccattttaacttaatcacctctttaaaggccgtatctccacatactgaggtactggggtttagggtttcaacatataaatttggtggggacacaattcatcccctaatacttctatagttttaaacataagccatcatttcttaatatctgtaggttacctgcatcgaaatatcttgcagagctggttatgaaaacatattcttggtttctaccccacatggaaagaattagaatttagaaggaatagagctgagggaatctgcattttaaacaaatatcagagtgaatcgatgcacacaagtttaagaactattgacataatttttctattatttgttggcattaagattttgatacaattcttcttaatgcatgatcaaatctataatgcctaggagtatttattatctttcccaggaagagaagagtactctagtatttgttttgtgcttctttaaaattttattttatttttttaatttttttcagacaggatcttgctctgttacccaggctggagtgcagtggcacaatcacagctcactgcagccttgacctcccaggctcaggcaattctcctgcctcagcctcctgagtggctgggactacaggtacccaataccacacccagctagttttttaaattatttgtagagatggggtctccctatgttgctcaggctggttttgagcctctgtggccagcctgttttgtgcttttatagcatataaaagactaccacatattatgtttaattggtaacagtatgaaatacatattatactgaccatctatagcctaattttattctcatggcaaccctgtggagggggtattgtgaaagggcagtttgcatagagactaagagttgagttttgaaggtagactgcctctaccgcttactagccacgttattttgggcaagttatttaacacttccaggtctgtttccaaacctacaaaatggggatagtataacaataactcatggggttgttatgaggttttcattggttcatacatcaaatctagaaaagcttttgtcacatatgaagtgtgtagtgagtttcctattattacttccaggttggagatgagattggtcttcataagaattaactgacaatgtttacgaattcacacagctaacatacaatagagtcagaacttgaactctggtttactggctccaactccagtattctttccactactctgcgaaaagtatattatttttaagttggcattagctttttcaaattaccacgtgttattttattatttttcaaagtcaagtccttttaaagaggaccaaatatcttataaaatcttttaaatatatatatacttagcatacacaaaaatagaataatggttaaatatgttttagtgtgaagcaattgcgagtcactattgatctctgattgtgttgaacttttggtgatgacttcagtattttgtaatcagccatttacagttcatttatttcaggaattttaaggtcaagctgagctacctatatggaatgaaccagcccagttctctgaaattggtcttcctttatgtgcctagaaatatttctctattagtctgacttctgttggtaggcatggcactttacacattagctaggaagaaataaaatctaatttgtctggacagaatgaaaaaaacaaacaaaaaaaaaacaaaggaaaactgtttgccttccattcctagatgccagtttgctggaatccccctgggaataaaagataatattagatttttctgacctggtaggagaaacaaatcccattctatatgtatgaatgtgtataaattaagatgcatatacccctaaacatataatatgaaactaaaatgaacacagtaagtatatatctaggtttgcagggatttttgtttttgatattgtgttttcttccttttatatggaaaaactcagtacctaaaagggtaaaaaaggatagtataatgaactaccatgtactcatcaccttccttcaataattaccaatttatggccaaccttgtttcatctatatccccacccactcccccactgcacatcattttgatacaatccaagtcgtgattatttcatttcacttgtaaatatttcagtctacatctctgagtaataaccacaatataattatcacatctaacattaacaataatgccttaatgcctagatgtccaggtttagaagtacatatcaagtgacagctcatgaatttctacataagaaggcttttggacagcaatctgattagaagaggggtccaggggacttctctgtatattgcatttatacagcattttagataatattgaaaaagcctcagttattgatattaaataattgggctggaactactgaagaatatcatggggatgagggtgcattagtcttgttaagttgtctgggtgccctcagtgctgacatggttctctaatattcactaaaagtgagcttctaattttagatctagtgtatacagatgttacattaaatgcacagcaacctgatgtattagcataatttaatgcatcatctttaaagtaagccagaaaactgactattgtcaaacagcaataataacaaagtaaaagaaattatctctcagctagatgcggtggctcacgcctgtaatcccagcactttgggaggccgaggtgggcagatcacaacatcaggagatcaagaccatcctggctaacacggtgaaaccccgtctctactaaaaatacaaaaaaaaaacttagccgggcgtggtggcgggcgcctgtagtcccagctactcgggaggctgaggcaggggaatggcaggacctgggaggcggagcttgcagtgagccaagatcatgccactgcactccagcctgggtgacagagtgagactccatctcaaaaaaaaaaaaaaaaaaagaaaaaagaaaaaaagaaattacctctctagaaatgtatttaattaactggaggttgtgcacaattcttttccgttttgtttttcttctcattttcaaaaacctgcaccaaaggatggtttggttttttgccccatcccaccctgatttttacaagtaatcctccaattatttcatatgaatagtggatgtttactccattttacataaaatgctacataaatgcagttccaatcaagtctcctcaccactctgcttgttactagattggtatcccaatttctgtaaagatgctgttgtttggttgggaggcagggataaaatccagtttgagaagaactcaagtgcctagaaagaaacttagactttatcctgaaatagaaactcatgaaaagtttttgatgcttcaaggggaatgaagatgacagatggggcagatgtacaaagagattatttggcaatcatggaggaaagacggaaaataaggaagaggcggggcgtggtggttcgcatgcaatcccagcactttgggaggctaaggtgggaggatcatgtgagctcaggagtttgagaccagctggggcaacatggcgaaaccctatctctacaaaataatacaaaaattaggctgggcacgctagctcatgcttgtaatcccagcactttgggagtccaaggcgggtggatcacgaggtcaggagttcgagaccagcctggccaacacaatgaaaccctatctctactaaaaatataaaaattagctgggcgtggtggcaggcgcctgtaatcccagctactcaggaggctgaggcaggagaatcgcttgaacccaggaggcggaggttgcagtgagccgagatcatgccactgcactccagcctcagcgacagagctagactccatctcaaaaaaaaaagaaaatacaaaaattagctgggcatggtggtgtgcacctgtggtcctggctactcatgaggctgaggtgggagaatcacttgagcccaggaggttgagactgcagtgagccatgatcacgtcactggactccagcccgggtgacagagcaaggccctgtctcaaaagaaaataaggaagacacttagaaggctttcaaagtaatccaacacaaaatgaagggactccaggtaaaggcaataaaataaggaaaaaagggaacaggcaagaaaaatattattttcgaaaagggaactttcatgctcacagaattagatttagctgttactactgttgttactcattttgactatgctacagtagcaaaccaacatctgaaaaattctataaatatgcctatcattttccgtagacatctatttttattttttgtcattacactgaatatgcaattcatgacatcatttcccacactaggacagctaaggtgtgatagagagaaaacaggatttagagacaggtattggaagctcaactttactacctgttcctatacaacacgagtgagtcatttaatgtctctgagcccctattccaactgagaaagcatgttgtagattatcaggtcctatacagatgtaatgtggtgctgtcgtgcctttaagaaaagcttttggcaccaactcatggattggctgccctttttgttataaggttgaatttatttctatagcaaatacaatcacttctaattctaaagagtctagacatttctatatcaataaatactaatgttttaatgaccatgctgtcacaaaaacaattaagaagcaaatatcatttgtgctataaatatagctttctttctctttctaaataacattaaaaaaaaaaaaaaaacagggtctttctatgttgcccaggctgaagtgcagtagctattcacaggcactattatgatgcactatagcctccaatacctggacccaagcaaccctcctgcctcagcctcctgagtaactggaactaagggcacacatcatcacacttggcttcctaagtcacatttaaaaaaaagaaaaggaaaaaagaattcattttggttcaggaattttgccatactttgtcttttcttttgagaaaagaaaaattgtgttgacgtcaagcctgcttatggaactctggggctttctggtgctggtagatttattcaagtatatacaatgaatattatagaacttactgttgttattcattttgactatgcatttgtcattccatatttcaggtctgttgggaaccaagaattacaaagtgctctaaatttatggctaatgataaatattgatatattaatcaagactaaagctttgatttattattttttgatttgatttattattagttctcatattttataatacttcactggttactatgcgtatgagtgtgatgattggaaaaaccagaggctataaatgcacacatctgtgcattgatacctttaaccattcacataaattatataagtcaagtaggatttcctaattatgtacgatctgtcatatgatcagaagactataggtacatgactaaattttcaagtagcattaaaaattttctctttctccatatatatatctatatacatatatttaatacatacacacacagtcatattatatgaaatgtgcacccctgatagaagtatctaataaaattttgaaaactttttaaatccatcagagtttttattgggcttagatttaaagggagtctgaaaactatttagtttctgcagcatgcatagcaatagtggacaactgccagcaaagggctttatcacagtataaatggggttttaagtgtttgtttccagtgcaggttctcgcagcccaggcacttcccagtctcattgttcctttgttctagcggatgtacaaaggattgactgttttgttttctggctcagaaagattagataaagtctgcatttctgaacttcaccctctagacacgcaaccttaaaatttatttctatatctcatattttgtggattatatatgtttggattctactgatcatgacattattttttaaaatttttatctggcttgatagtacatgtagatgatagtattgatcccttttgaactatcactggaagcagctgtccctctcatccttgtccttaaaatgccacttcagcaaaagtatgtcatctcaattgggtacgacagcattgttcttgagtttcactggctattagaatctcatagactcctctatatcttgttacttttcaaaactgccttggaatataagtattattattatactccccagataggaaagtggaggcttagacaggttaaatagcttgcccaaagtctcatgactttgttagagctgagatttaaatttaattctgactccaaagcccatgctgtctgccattacatttcactgcttctgtggcaatattttcacctaattataggaataataaaaataataacagctaacactgagtacttactacgtgccagatacagttctaactactttttatataatattcaatgtaatcttcataacaattctactaaaaagatattattatcaggattgcataaatgaggaaactgaggcacagggaggttaaggaattgcccaaagcacacagctacaaataggagagcccaattcaagcccgggctgtcaaaccctagaacatatgttcttcaggtgaaccaaagggctgtgctgtggtgtgaaccatgcaaccttgtcttccaagctcacctgtgtttcgggcactctgttaatttttgtcatagttactgctgcctcagcttgcttgtcagctaacatttatgttattattaattattgatgttataaatgtggcatatataattttgcaatatgatgtacttagcataaatcatagcataaaacatagaaacattagatttcataggctctattaagcctatggtgtctattggtcagccatacatagtcttatgagttgtctgtttataactgccttttgaatatagagtaaggctatcttatttcttttatatgtaaattacaagtgaatatcatcttaaaacatataagaaggttatatcttctaataaggtctagaattcctggtgttatattgtgaacacaatatagtctaccaggaagtagtgaagtttctatagccatgccattataatatctgacctgacccttcaatattggtctccaatatcttgatcccactttctagaccaagaaccatgttggatttctgaaaatttctcataaagaggtctctcaatagttctactctcagcactcagggtaggggcagccccttatttcttagactttactccccactgtaccaaaagaatggctgctcactaaatatcattgacttagttcctaatcctgatatgctttttattctattcaagttcaatggtggagattcaacataggcaaagcaggacttctcaaactgatccttggctttgagagttgaaataaggtgaacagctgggtgcaagatttgcccattcccacttactctgggtgctctggcagcaccaaagtgccccaaaattgagattttaaaaacctagggatatagggggccagatgcggtggctcatgcctgtaatcccagcaccttgggaagctgaggcgggcagatcacctgaagtcaggagtttgagaccagcctggccaacatggtgaaaccctgtctctactaaaaatacaaaaaaaaattcaccggacacagtggcgtgtgcctgtaatcccagctactcgggaaactgaggcagaagaattgcttgaacccgggaggcggaggttgcagtgagccgagatcacgccactgcactccagcctgtgtgacaagagcgagactccatcttaaaaaaaaaaaaaaatctagggatatagggaatcccagctactgggagaatccattttggtaagcaaccctatcctaggtttataatcagatgtgtatcttttgtggttgtctaatatctaaaaaccacccaaagttacatatactagacaccaacaatctacaacctaggaagaagttcagtgtatatttcaaattatttcttaatatctagattttctgttgagatcttcagtatttatccaggcataacctggatgtttgtcaatgtttgaaaaagttgctaaactgcaagccaaagaaaatataactttgcttggactttcaagatcagagctaccttaacaacaacaaaaaaagtttcagtagaaaaaggaattcatatgactagtagctaaatgggtttttttttttttaagaaagtgaaagggtaggtttggaagtgaagcaaaatggcaatttatttcacaaataacagatttttgagaaaaatgaacctggactgcagtaaaataagcagttatttgcaaaagtcttcaagccatgttctttttttttctttttctttctttttttttttttgtgtgtgtgtgtgtatttgccttgcagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacaggtaagacctgtttattttatagctgagtagttaataggatacttttcaagttatactttattcaaggaataggagtaagattgctactccagagcaaagttaattaattagcaattagttaaatttttaaaaggagcttgtgggatacagtggacagactggactgaaaataggatgcgtggctatgctggtaacttgttgagtggttttgaagaagtcatgggacttctgtggaattggagttttctccaacttggaatggatactccctaatggcccttctaactcaaatccaaagcaacaagactttctgccccattttctaagtttgtgccataaaacttattttttagatgtttttattctttgtatactcttctcataacatcaagtcataatgtttcctaactattcctatgtttgaaacaagtctttgtttctccaatgtggtgaaaaataaggcatctgtgcacccacatattatgatatacatggcacatcactacctccttccataaagtacatgtctttcatgtcatttgctctcccctcattttctctcttcttaaatttttttattatactttaagttctgggatatttatactttaagttctgggatacatgtgcagaacatgcaggtttgttacataggtatacacgtgccatggtggtttgctgcacccatcaacccatcatctacattagatatttttcctaatgctatcccttccttatccccctcaccccccaacaggtccccgtgtgtgatgttcccctccctgtgtccatgtgttctcattgttcagctcccacttatgagtgagaacatgcagtgtttggttttctgttcctgtgttagtttgctgaaaatgatggtttccagcttcatccatgtccctgcaaaggacatgaactcgtccttttttatggctgcctagtattccatggtgtatatgtgccacattttccctctcttttttaaatcttcctctccatttttcatcttctatagttctttcctttctctcttctacttactgctgtgcaatgttatatacttcactggcaaaagccaccttaatacctattaagtgggggaggcagacaagtaaattatgatgtaacttgaggctgcagactttgaaaagagcactaatcaaagttccagtgaaatttccagaatcctgttatttactaatgctattatcaagttaagatgtacagaggaacacaaatgaatatgtgacttctaattaaatgtgtctatgtctcctataagggaattattaatgacatttggacatgcattttatcccactagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacaggtaagttccccctagctagctgaagaagaataaagtgaaatcaagggaatgtttaataagtcaagtttattatatgaataactgtaatataggacaaattgaaattcttataaggtatagaagacccatatccacttttctactcagaaaaagaaggattctcttttattctaaagtttaggctagcccttggcaacattttgaagtaggcaaagttaattactgatatggacctagcttctcttcttctctttttaatactctatctccttgctaaggattcctacttccttttcttaaacaggcaactgctgtctttatgacatcactcacagtgaaccagagttactttctccatgctatacataccctactcctgtgtgacagtcatttccaaaattttctatctaaccatatgacctgggacccaataccacaggacctactcccacagcctaccctagactaataaatgaatctatgctaagtattaatgagtaatttatacaaactttcattcattcagccaatagttattgaatgtaagctagatgctgggcattgctgatataatatccaagagagacaaagtctttgccctcacagcgcttacattttagtagaatctaatgcttctagcaagtctaatgtgtgaattaaatctcctctcttggtaagttatctaattttaagagaaactctaatatatgtagtgccttagacattagtttctggaactatgggaggctggtgggaaagatatttgaggacaccggtacatttacataccttttataacacacctcaaatatatgtagatattcctggccaaaaatgttctatatatcttaaaagttatttatgtacatcaagagcaaattgcattcctgactgccttgtgcaaaatcagagtgctgtgcccattctttttttttttttttttttttttttttgagacagagttttgctcttgttggctgggctggagtgcaatggtgcgatctcagctcactgcaacctcagcctcccaggttcaagtgattctcttgcttcagcctcccgagtagctaagattgcaggcacctgccaccacgcacagctaatttttgtatttttcgtagagatggggtttcaccatgttggccaggctggtcttgaactcctgacttcaggtgattcacccgccttggcctcccaaagtgttgggattacaggcatgagccactgctcctggccgcccattctgttaaggaagcttcattaatttatattctagaaagagtattcaccaaagggtatctcctttttaatcattttcctctgatgaagtagtaacacaactcattaactttatcatgatttaatataaaaattaaagtagttttatcacataaaattttgtaatcaatcaattgatcgatctatttactatgtactcaatattattgaatattaatatataaaggcgataagaaatgaggcagatggcagacctttttgtgcattccacttaaagaatttctgaactggaaaggaccattgtaggtctttgacctagcctcatttgccaataagaaacaccataaggctcagtgaactagaaagagctgtccagagtttcccagctgactaatggcccagtctgaaccagaatccaggcttctgcctgccaaggttttggccttgccactaggcatatagcctacctttggttttacaacattactttttgcctctttaaaacctttttttatttttattttttcaccatctgaagaggataatatttgcctcttgaagtgcttgttttctccagagcaaggaatgtggcttgcagaaataaaattacaggtcaaaatttggccataggacttgtgagagatcctgagtaaaagtctcctttctgttctttcctgattagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatgtgagtcttgggctccagaatgttccttggttgctcaaatcactctctgatccaccttaaaataggacaaaataagtcagcaggaaaactcctttcccaatctgagaagtggagcctatgtaactgaaggtgtctgtagtatggcccattcttctgagtcacttaggcaactgagtttggatttctgaatgatctgcatgttgtttctgtcttatgctttttcatgtcacgtcacttaagtagcataaatgcattagcattgataccagtatataaaacatttctgattcattcttacagtgagaaccagttagcatttaaccatgttttccatacattattttattaatttatgtcctcacttatctatccagtgccttatatatgtaaattactgtactattgttaaaacgactaagacatgctacttgcctttaaggcaggatccagcagactaccccatctggtgccaaatctggtctgtggcctgattttgtttagccctcaagctaagagtggtttttacatgtttaaagggttgtacaaacaaataaggaaacaaacaagaaaaagatgagacagagaccatatgtgtcctgcaaaacctgaaatatttactacctgatccttacagaaaaaattgtccaactcctgctttagaaaactttcattttaatcacacagatgtggaatacacacatgtacaaaaataaaaatagtacattttaataatagtgactgtattgatatttgcatgtatcaggcactgactaaataatttatatccattatttcatttagttctcacaacaaaactgtgagagatgtcttgttatttattaccattatacagataattcaaagaggtcaaataatttgtccatagtcatccagccagtaagtggtagagctagaatttaaaccaggctatttgattccagagtccattctctctgctattagagatctgaagtaagagatatatggtcaaaaaggaaagataaaattttctttcataagagcagtaaaaacttggaggaaatgggagcagggtgcggtggctcatggctataatcccagcactttaggaggctgaggtggagggttgcttgagcccaggagtttgagaccaacctcagcaacataatgagacctcgtctctacaaaaaaaaaaaaaaaattaattagctgggcatggtgacatgtgcctgtggtcctagctactcaggaggctgagctgggaggattgcttgagccctgtggttgagccatgattgcatcacttcactccagcctagcaatagagtgtgaccctgtctcaaaaaaaaaaaaaaaaaaaaaacttggaggaaatagaaatgatctttaataaggacctaaaaaatgtaacgtttgtgacaaagagggaaaagagggaagagcttttggggtggaggggacaaaataagcaaaggcccagaggcagaagggcccaggagacttgcaggtctacagaacatacaaccggaagccagctttccaaagggtagggaaggagagaggatggcttcagaaagtagtctcagttaagactggaaggatatggggtctgaacttaaagagccaaaaatgtaagcagagggcttgacattttattctgcagattatagagagaccttgaatgtttttaagcaaaaaaaaaaaaaaaaaaaagaacttaatcttgcaagaacattaatctttttagttggaaaagaaagaaaggaatgcctcatgatcacgacatccaatatctcttacaaaggatgccacatatcactagattattaacactacaacagaagattacattactgatatcactaaaatgattttagcggacatttcttgtgtgtcaaatgtctccgaaataaagaacactcatttgcaatccacagacatcaagaggggatagaaatgttttgaactgcagatattgtgtctcctatctactgctgcccaagaaaagtaaatgagtatccttacttttggtctgtaatatctcctttttgacatcatttcaccgtttagttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacaggtaggcaaatatgaagatgttaataccaatggaagagtaatttgttccctctcccaggtaacccaggtaactgccgtaactgctaatatcataccctggtgttttctgaatttgagatattaaggactttaaggctaacatggggtttctaacacctaatttgtcaaattagaacatttaaaatcacttccactagtaactccattatttcatgaaagaaagccatttcaaacaccaaaagagtaagatgcatacattctgaaaacaaacactgacccttcccacaaaagaagaaccttttgctagtgatcagcattagggaaccattgccttgacctcatgttgactaatgtggggatttcaggtaccaatgaagagtgattaaagtggagagggatatatttggattttagggaagggaagaataaggatactgaaatgagaaaacaggctcaaagaggttataacttgcccaaagctttgcaatataatcgtgacagcaagaataccaagactcatgtttcagtatcctcatactgtcaaatacttgtactcatattgtcaaataagagagttgcacttccaagttcaacatttgcttgataatccttgtaatgtgaaatactccatatttagagtgaaattcaaataccttctttcttagttcgcctgataatagggaaataactacatggattcactgttcttcttagaacaatgtcaaagaaaaggatcatgacacccacttagcttgccaatgtgtcttgcagtaatctcctcatcttccaaatattaatatccactggatgatgatcaaagacctacagagcttaaactaagcgacttttagtatttcacaggacaagcatctctgtcatctccaatattttatcactcacctcaaataacttggaaatggaagatcacagaacattaggggctctcagcatgtcagcataattctcaggagaacttttatttatttatttattatttttacattttgagacagagtcttgctctgtctcccaggcctaggctggagtgcagtggtacaatctcggctcgctgcaacccccacctcctaggttcaagcaattcttgtgcctcagcctcccaagtatctgggattacaggcgtgtgccaccaggctcagctaatttttgttcttttagtagagacaggattttaccatgttggccaggctggtctcaaactcctggcctcaagcagtccgcctaccttggcctcccaaagtgctaggatcacaggcacaagccacggcgccaggccaaacttttgtttttctttttctttcttttttatttttgagatagagtttcactcttgttgcccaggctggagtgcaatggcatgatcttggctcgctgcaacctctgcctcccaggttcaaacgattctcctgcctcagcctcccaagtagctaggatcacaggcatgtgccaccacacctggctaattttgcatttttagtagagatggggtttcaccatattggccaggctgctctcaaactcttgacctcaggtgatccacccgcctcaacctcccaaagtgctgggattactggcatgaggcactgcacccggcccaaacttttcttaaactgtgtctctggttcaccttattcaggtaacttgaagtaggcctcgatgtaaataatcaaattatttctctataccgaagaaggaagatggagagttagggactcaattagaatggatttatagaaaatttatggatgcaaaatttacaagaaaatttttaatacttgattctttcataatttaaggcagcaacactttattcttttcttttcttttcttttcttttttttttttttttttgagacagagtcttgctctgttgcctaggctggagtgcagtggcaccatctcagctcactgcaacctccacctcccccacttaagcaattctcatgcctcagcctcccgctgagactacagatgtgagccaccacgcccggctaatttttgtatttttagtagagatggagttttgccatattggccagggtggtctcaaactcctgacctcaagtgatccacccgcctcggcctcccaaagtgctgggattacagatgtgagccaccgcacccaaccaacagtttattcttaatgtctcctagaaattttaacaataaaaccttttaaaggaatcaattttgagataagtcctcaattaaatgctattattgccagccaactcgcccttccatgaacacatcagtgtcccccacctcagaaatgagggaaagttgcacttggtctcctcaacctatgggggtaacaaatactcctaactccacctaaatacttaaacaggaacttttctttgtgattttgtgaatgacaagattggagtaaatatttttgtattacagaattcatacaaaaagataaactcaaagtattatacagtcaaaaatcaatgactcttctggcaagatgttttctaattgagtctgtatttctggttacattacatgaacaaagttttttgtgataagattttgttttaatgctcagagacattcataaaataaatgttgaactgaaacacgcttaaggatggaagaggagaactatcaaaagtataccctatgaatatgcctcagtccatcaatgacccatctccattgctttttcctcagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacaggtagtaacctttataaattttacattttaaagtgttctgtctgctgaattactatttaacatgcaatttacaagtattcattaactgcctattatgtactgggcattgctttatggatcctttctattgtgtttgttttctattttaccaattgcagttcttatctttattagttccttctttttactttgcttggatttagtttgctaaacttgaaaaagagtaaagaacaaccgtttcaaggagttttgctgtaaaggagagcagagaaatagggcagcatctagaagaggaactatggttgaaaggaggatgattttttaaaggcagaagaaataacagcatgttttatgctggagggaatgatctagaagatgtagaagggaaatcatgatgatgtaaagtgagagggaagaattgctgcagttattccatgagtaggcaagaggtattgggatctagagcacaagtgaaggaattggctttagaaaggagcatggggaatctaatctcaatgtcagctggtatattagtctgttttcacactactataaagatcctacccaagactgggtaatttataaaggaaagaggtttaattgactcacagttccacatgactagggaggcctcaggaaacttataatcatggtggaagttcagttagaatggcgatcattaaaaagtcaagaaacaacaggtgctggagaggatgtggagagatacgaacacttttacactgttggtgggactgtaaactagttcaaccattgtggaagacagtctggcaaatcctcaaggatctagaactagaaataccatttgacccagccatcccattactaggtatatacccaaaagattataaatcatgctgctataaagacacatgcacacgtatgtttattgcggcactattcacaatagcaaagacttggaaccaacccgaatgtccatcaatgatagactggattaggaaaatgtggcacatattacaccacagaatactatgcagccataaaaaaggatgagttcgtgtccttggtagggacgtgaatgaagctggaaaccatcattctgagcaaactatcccaaagacagaaaatcaaacaccacatgttctcactcataggtgggaattgaacaatgagaacacttggacacagagtggggaacatcacacaccggggcctgttgtggggtcgggggtcgggggagggatagcattaggagacatatctaatgtaaatgatgagttaatgggcacagcacaccaacatggcacatgtatacctatgtaacaaaactgcatgttgtgcacaggtaccctagaacttaaagtgtaataaaattaattaattaattaatttttaaaaatcatggtggaaggtgaaggggaagcaggcaccttcttcacaaggtggcaggaggggaagtgatggagatgaaaggggaaagagccccttataaaaccatcagatcttgtgagaaatcactcactaacacaagaacagcatgggggaaaccactcccatgatccagtcacctccctccttggacacatggggattacaattcaagatgagatttgggtggggacacagagccaaaccgtatcagctaggaaagagagaatatgtgggtgcagatgccaataggtggatcgttgtagggtgagcagttatcttctaattgctttcatttttttcagtgtaattggaagcaaagtcatcaagatttccctttttagttggacgccgtggctcacatctgtaatcccagcactttgggaggccgagatgggtggatcttgaggccaggaattcaagaccagcctggccaacatggcaagacactgtctctactaaaaacacaaaaattagctgggagtggtggcacatacctgtaatcccagatactcgggaggctgaggcataagaatcacttaaacccaggaggtggaggttgcatgagtcgagatcctgccactgcacactagcctgggtgatagagcgagaacctgcctcaaaaaaaaaaaaaaaaagaaatttcttttttcaatgtatatactattgtcctgtatcttatttttctctcctcttttgatcccacaaaaatataattattgctttatatagtcaacatctgtttagatttacctaccaatttactaccttttttctcattttttccccctgcatctgagatgttttatctgggattattttcctttatcctggagaacgttattcaaatttcttcattgagagtttctagggacaaactctctcaaattttgtttttgctgggcatatttttatatagctctcatttttatatagctctcggtcttgaaagatattttccttaagttccaactctgtgtttaaagttactttctctcagcacataaaagatattattctagtctttctgggatttattgttgcgctgagtcagctgtcagtctgatttttatttctctatgagtctgtttgctatgactgcttttttgcctttggggttcagttgtttcacaataatgatcaaggtgtagatatatttctttttgtttctcttgctcaagattgattggcatttctgtactttccaactagtgtctttctacaatcctggaaattctcagctattaactctctaatattgcctcttgccccttctccattccccactctgtcatcttctggtattctagaacacacatatatgaacacatcaatatatttcatattttccatgtgttttctctctgaactacagtataggtaactttctcatatctttgattcatttcattaattctttcttcagctttgtctaatctattttaaaatctacccactgttttaaattttaattgttatgttcacttttaagcattctctttggctctctttcaaatttatgttgtgctctgttgctctttagttatattttcattcccctcctgtattgttatatgcaaattaacaatgtttattttccatcctatgtctgataattataatagctgaaatcttcaggagttaagttctgttgtcttttgattttcctgccttttgtttatgttgctttatttctttaaatgtatgtgatttctttttactgtaagcctgttttccctagaattttattctgtggaaattatttaaggccatgtttgaaggtgagtttcagaaagaattttcatttgattctttcaggtgcacaagactgctatcaaaccagacctactttaatctaaattgtcaactttaggttctttgatcacctgggttttataaattcaggttgcaaacacattgaaactatcttaaggttatgagttctcagaggaaatcgttttctccatccagtattaagaaggctgaagttgtatggggagtaaagagagactatttatttcacttatacttagaatgtagcctttccaatgttatgcaaggtcagctatgagtttcttcagcctggaaaaatctacactttacctcctttctccaatatcctgcagtgctataaaatcaaagcttacatttgcatttgaaaggtgctctcaacacaacagttcgctttatgatccaattacctctctatcctttactttttggcctttgagaatctcttacattcctgacaagtcattcatttacattttcacattttatccaatatgtatagttgtgtttattagaaggattttcatggtatctagcctatcatactgccagaaagggaagtccaagacattgttttagacctaaggtcatttttatcatccccaccacccatattgctgggtcatatggtaaatgcatgtttaactttgtagaaaactgccaaactgctttccaaagtattgtaaaattttacattcccaccagcaatgtatgaaatttccacttcctccgtgttctcagcatgtagtacatggtattagcagtttgttttaaaatttagccattctaatggaatagccattataataagataatgatagctcatgtggttttaatttgcctttttctaatgtctaatgggtttgagaatcctttcacaagcttatttgtcacccatttatcttttctggggaagtttttgttcaaatattttgctggattttaaaataggattgtttgtttgtccttggtcaaaatgttttctgtcggtttttcattttgatgtccaatttatcagtttttttctttcataaatcatgctgtggtgtcatatctaaaaatatttgcctaaatcaaggtcacaaaggttttctcctagaaggttatagttttaggttttaaatgtaggtctgcgacccattttgagttaatttttatatatgatgtgagatataggtgaaggtttttttctttgcatatagacatctgataattctacctctatgtattgaaaagactatcttttctccatgaaattgcctttgaatctctaaaaaatccattgatagcatattcttctatctctgggctctcaattctgttctatcaatctatgtttctgtctgccctttgccagtattatcctgtcttgattacaagatttttagtgaaatcaggtggtgttagtcctctaactttattcatctttttcaaaattgctttggccactgtagctgtttgcctttcatataaaatttagaattataattgaatctttagaattgaatctgatccatatacagtaggatttttttaatgaacgcttttgtatcttaatccagaagtcaatgaactttgaaaaagaggggtgccaaggttccagtccctttgattattgtaattcaggaaagaggcacaaagaagaatgtatgttgaccaagtgccaacttcaagatctgtgtataagatttgttaaatgataagttggaagaaataaatgttgttaattaggaaaaggacacaggcttaggggttagataaatctagctttcagttccaggttggctatttgttagcactgtgatataggctaaattacttacattttatgatccttggtttccttgttaataaatggaataataaagtcaactttatagagttctgaatgggtgtcaaataatgtaacctttatgagacatatagctcataactggcacatagtaggccttcagtagttgttgttattatcattattttttaatatatatattataatttatattattatcacatgttcatgtataataacagcccctttaagaatgtgccagtatagaactaatcagtttgctagaccataatcaacagactgaagggaattcccaataccaccccataacaatcattggctcaggtagattagatagctttgaattctcatggggtaaggacagataaaatcacattaactaagcagttttcaaaaatagcagccttcattatctaaaatttaaaatcaaaaccacttaataagcatgcatcatctcatctttggatcttaaataattttgattccctatataagcagctttttcaaagtactagagcctctctagaggagtagttctccatatgccacaggaaatagaactgagagtctatagcaacaacacaaaaattatttttagtactttcaagtctgtctccattttttgactcatttttcttacactttcttaaggtgactaagtgtcatttgttttttcttctgtctactgttttagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacaggtaagaagtagagatatgtgtctgtgacttaactaagatctgagtacatgagacccctaatcagaatattatagaaatatcctaaaatcagactcatccctggcctttacaaaagctaagtttcacaaaagctagccatccagaaggtatatggaatggaaattgggcgatgggtgatggcaagagagaataaattctgatttttttttttttttttgagacggaatttcgctctggttgctcaggctggagtgcgatggcgtgatctcggctcaccgcaacctccgcctcctgggttcagcaattctcctgcctcagtctcccgagtagctgggattacaggcgtgtgccaccacgccctgctaactttgtatttttagtagagacagggtttctccacgttggtcaggctgctctcgaactcctgacctcaggtgatccacccgcctcggcctcccaaagttctgggattacaggcgtgagccaccactcctggctgaatattttaacatctccaatgaacatgtaagaactcctcactcgatgtctagacttatccccctattcagttgatttcctttgaaatgtttatgttccagttaaggtaaacaataatggataaaaaacaaaacaaacctcccaaagaaagcatctttcactcttatatattcttggtttgcaagacataaaaagaaaatgatctccaattaatatggttagaggtggagttgatctaattttcaggtctcatatattttcataagcaacgttaaacaagtgcttaatatgctatctaaacaatttttcttgaccttaatagctccctgttagaaagctaagtaaacaaataagtgtcattatggtcatgtatgtcagggagccatggcactgaggaagaaattacatagaattttctatgtaatacaatgaaagaacataaaaaattaatatatatgatatataaaatgtatgttcatttcttagaaaaaaattacataaacccaatagaagctttgataattattagtgggaccttgtctacttaattttatataattattttaagttggatttcaggcttctccttctgcatcctcaacactcaaattctgtttatcagctgcaggcatcatagatgcatctctttccaaaatcatgaatctcatctacttaatgaacccagaggacattaacttcattaactctcccagaagaacaatgaagtcactgagaagatgtttcatagtcttggtagaaattcactggtgtatgcccatttccctcattctatgacagctgacattgtcacttgcatgtttcttttttttttttttttttttgagatggagtctcattttgtcgccaggctggagtgcagtggcacgatcttggctcactgcaacctccgactccctggttcaagcgattctcctgtctcagtctcccgagtagctgggattacaggcacgcaccaccacgcccagctaatttttgtacttttagtagaaacagggtttcagcttgttggccaggatggtctcgatctcctgacctcgtgatctgcctgcctcggcctcccaaagggctgggatcacaggtgtgagccactgcgcccggcctgtcacctgcatctttctccctgatattttctttcctttcttttaatggttcttggcaccatccattggtgtagcatacttgggggtaggtagctgaaaagcttagcatggaaatcaggaggcctaggttttggtcctagctctgccattaacttatttccctaagcttctgtgttttaatccacacacaataattcactcctaccctgggtgtcagaatagggaaggagaaataataaagctgaggagaggagtggaggacgaccttgcattcatttcccagtgatttgcagttgtatcagtcacattagactgatttaattcatgcttagacactgtataatgtgggtgttcatgattggatgcctctattggttgggatacagtctcctactatcagtggctcttctttgctgtaggtcctcagagctctccccatttctccagagaatggaggttggggaggggtacaactcatcagacttgggagtaggcatttcacttccacccacattccactggccagaactcagttacatggctacatctgactgcctgggagcctgagaaatgcagtctagctgtgtgtcaagaggaaaaggaaatggtcggggaaccatattctgccacacaggttgattctcattttatataccacaaggattgtccaacttattgtgagctactaaaatagtctagtctgtgctatctcttgaaataactgtgtactttaagtaagtgggacttaaaattatttttattttttaatttatatttttatttatattttaattagaataaaggtacaagtatttgacccatattatataatagaagcattcaaaaaagggaaaaagggacaagaaattatttgaagaatggtcataaagttttgaggagagaatcaaatatgaataaattgagcacgagttattttactcaaacatatgaagagtgcacattatcacgataaaggaggaaaatgggagactcctgtaaagcacaataatagggattttgaaaggtgcctcttttagtaaattttgtacacagtcaattgtaaagaattcagtgggtaaggccttgataatccttatcatctcctcaaattgctgaaacattagtcaatattgaaataattttgaaaggtattcttatatttcacctgtttccactgagttgaaacatataaataaaccctcccagcccagataagatggcagaatatttaaaattaaagatattagatatacttaacaaatctaattctaatctgggaaaatgctcatcctaaaggaaaaacaaattttgtatctattttttcttaaacatgtgaatcatatttctgtgaaaacttttgataattgtgtcttttctaataaaatgttagtagttgcaaatatttccagcagtttttaaaaacaagcataatgagttgcttttgagagcaactaaaggatgtatagatggttggatggcagaagaaaggaaggaaagaaagcaaaaaggaagaaaagaaggaaagaaaaggaaggaagagatgtaccaatatataaatcttctggctaaaaagttcaactttatatctaggaaatgtccatatatgtggatcaacattaccagagttgttcactagaatgcagtttataatttttagtgatggataagtgcttttaagtataaggtatgctttggggcttaattcacaaagtccgaacatattacattagaaggattctcagaagtcatctagccaaatcctgtccattataagtgatgtactgatattgacaatcatatgaaactgttaagttaatcaactaatgattaaaacagtagtgtagttcatatatactgtaatattttaaccctatattcatttatggcagtactatttaatgggcacctatttctgatatgtggttcaacttttactcaatactgcaattactaatttgctgactatacctccaaccagagaacttcttgaagacattcatgcgtttttcatttttgtatacctggcaaatagtaggttctcagtaaacgtttgtgacactaatccccaattcatataagcaaatgattatagttgacatcagaaaacccattatcgccataacagttctctctgcccttggttggtccagcttccagacttcttacttccaagataggtttttaggcttatttcttaccactagagggcaggaaatgccttgcaaagggaaaacggtccctctggttgtgttagctattacttcccaggaatgaataacttcatcacaaaaaaattgaagctatcccagtttaaggtctttagaaaagctatcgtattcttcccctttccactcaaacatttttgctttattggtaagtttggttcaagttgattcatttagattgttgaaatatttgttccctttcttacagggaaccttctaaaacattgtataaggatgtctccacttgaaatgctttacaaacagcaaccccataaaaatgcagtagtggcatccttgtatttacgaggcatcccaaaggcctccggacatttttattttgattagttttctgatgtaagaacactcagcttctggaagctgagtgaaatcctcacgcttccttgacctcttatataatcagattagatctcctgagtgagtccacggtttgtgctgactgcaatagacgactcaaacttttgactgtgtctttctttttgaatcccccttcccccccccccccgccccccacctttcaaaatcacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacaggtaaggctgtatgaaggttcagggctccgtaagaaccaattcacatgtggctcagggcaccacagagctgtagcaattctgtaatgatgggatgaaaggcccttgagatcacaaaactgttatgaagtcttcgtattttaacccaagaaactccttatgtgagcagaccctgtgtgactagaatttatattatattcaaatagtgaaaaaagtgttcccgtttatggagtactttttggttgctagggcctggctttatatatcttaactataactaacccttatgaactccttattgaggtagtcattgttattattcccattttacagatcaggaaaccaaggttcagggaggtcaagtaactcgcccaactgtttaccttgttaaacagccagtgtgtttcagatcctggttttaaacccagttctgaatgactccagtgcctacaaagctctccatcctaaaatccatcctgaaatgtctgttggtcaaaaccactattcatcctttttcacacaaggtgaaaatgtgaacctttatggttctgggactagggagcaaaaatcttagcaaaggaaatgaatgttcagtccaatgtgctggaaagaattaaatttaaatagctaccattttcccaatatatttatgctttctggggtttatacctgagatttctgcttaaggttggcatcaatacattgtcaaatgtttcctactaagctatgggttgatttctgtattttaaaatgtcagtttttccatgaggttctgagacaattgtccttatcctgttacctagcgcaggacctggggcttagtaggcactcagtaaatacttggcaaaggaataatcagaaatcacttagatcaggggtcccacctgggagtccatggttcatgggagactttaggaatgtagtaacccctgaaattgtttatgaggttgctggggataggaaaggtatatgcatttctttgagaagaaacagtccatggcttttatcagattcttatggtttctgtgacctccaaaaagctaagaacctctgatttatattgttacaggatgctgacattgaaggggtccttagaatgatctaatcctgtttcctcatttggatataaaggaagtcccagagaaggagtgtggcttctccagggttgcagggctgactggtagtggagttcagtctagctccagtgctgtccattccatcatgctgtatccgagagcactagtcagggatataaagagattatccctacccttgaataatttgaagcccaattacactgacaatcacaataatgacttagatctgaaaagcagatttctatttacaaagcagtcttatgtcagggtctcatattgatcaacttggagcctaaaaatcaccagaaattaaaggatgtgttacctaactaccaaccccttgcttcctaccaatgtcaattcatgatgatttcctatccgtatgactttaatattgccaagtcttttgctgagattgttttaaaatgcaagaaagtgattctttattcagtgcatcctcttgactccttgaccggcatgaacttggacttggtacacgactaatggaggcaaatcattgcccctgacaaatcagtttaactggagggtcatgtctgagttgttctcttgatgattttggctgattatcttaatgcccttttccatttctgatgctcttgttctacattttgggtgaaaataccaatatttctaattctgtatcacatcatctcactgtgtagcaaggcaggtctccacaaattaccccgttccacctggagagctccttattgacttaacgtgatattcagccaggtttttcttcctgtaatagttgctttgcctttagcaaattgcctggatcattgacctttcttagcccatgcataaaatgccacttcataatttcctctccttaactctgtgatgactgtattctaacaacactgtaattggttttaggtaaatatcttggagaaagcatatctgtccttgctccatatctgtggtgagctatattccaaacactaatcagtaaacacaaggcaacaaaggatgctaatgcaacttgcaggtgtgagaaaatggagcttccatgccaaaatactgaaatttctggatcatttcatgatttgagaaaaagtagaggtgaaaaattggacacagccttggcatgtggtcagatcagaaacccctaatatataccaaatacagaggacatgctagtattaggacaagagtttagtaccctggatccgagttcatgcctcttttcaatgctcctcctcattaatatgtataatgtccagttaccgtgaaatagtaatgaatctgtggcctactgttgaattaaaattcagccccaaatggaaaaatgaaatctccttaatatcatgctctaaatacagaattgccttattccacagtgttcctaagtaacatgcatatatttatttactggttggggaggggaccacagatatacagaatggtttcgttcatatattagaaagaacctcacatgcacaaaattgtattaatcataattcttggttcaagaaaccatgcatccccagcactttgggaggccgaggcgggagaatcatgaggtcaggagtttgagaccagcctggccaacatggtgaaatcccatctctactaaaaatacaaaaaattagctaggtgtagtggcaggcacctgtaatcccagctacttgggaggctgaggcaggagaatcgcttgaaccagaaggcagaggttccagtgagccaagatcgcaccactgcactccagcccgggcaagagagtgagattctgtctcaaaaaaaaaaaaaaaaaaagaaaagaaaagaaaaaagaaaccatgcatcaactgccacctttactttttaggcatctagttagtaatttttgataatttaacatgtacacaagaaaccaaccagtacctaaaataaaagctaggaccttgacaataacctacatcaaagtatgtggtccccacctcgtgaattcactcaaaggtagccaacatcttgactcctatgttcacctctcccttgctttccatcttgcatagttttattgcatttatatacaggcctaaaattatgggtttcaaaattttttgttgtttttaacattatttaaaaaggtatttttaatgtagtatttaatatcttagggacttagatgttttacttattatacaggtaagattcatccatattttgtattttgatgttaaggacaagaaatccatatttttgtgttttgagttaaggaattaattataactattatataatatttcactgtgtgtgtgtatgtgtgtatatgtatgtattcattatccagtctcctgtatatattcttctacacgtggtttttatatagttttttaattttgccagtcaaatggatgtaaaacagtatttcactgtggttttgacttgcatttccttgatcaccagtgatgtggaaaatctcttcatttattatgcaaataaccatatgtgtttcttcttccatttttctttttccttttcttttctttttttttttttttttatgagatggagtcttgctccatcacccaggctggagtgcaggggcatgatgtgatcttggttcactgcaacctgtgcctcctgggttcaagtgattcttccatctcagcctcccgagtagctggaactacaggtgtgcaccaccatgcccagctaatttttgtattttttagtagagacggggtttcaccatgttggccaggctgttctcaaacttctgacctcaagtgatctgccctcctcagcctcccaaagtgttaggattacaggtgtgagccaccatgcatagcctcatttttttgaggggggcgggttgggggattgcttatattcttcttagtaacttttgagtcagcaaggtatgttggaattatctatatcgtttaccatcactcatattaatcatcagccatcatgtttaatgttccatcttatacatgacactttgtgcaggcaaacagcaggcttagaatgagttcatcagcttctgttaaaagatccgtttaatcactccacatagtgtaacaatctttcccctccagaaatttgtaacctaaggtctaagatttttcttttaaatgcacacaataataatctactctctctttttattgtcccagcttgtcatctgtgatcaattactcactcagaattcataaatatttagttactctctgtttccttttcagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaagtaagtggaacgattgcaaaatctgacagttggttggacttgaaagtctctagtaatttatctgaaccttgaattttttctgcttattcattagtacattacattcccagtaagtctcacttggtgctaacatcattcagccaagccatggcctataattacagaatatttattggtagataaaagcaaacatagtgagggagcaagaaggctaaatgtcccatttttcttccctatcttcctgcatcatggcatttagattctagacttcttgttttatcttatgattgagatcataactcattttataattatgttctaccaatgctgatcatgtaacatttatgtcaggaaaaaaccacaatgttaatagttgcttccaatttttcttgtttaattatgcatgaagtagtgctagtggtttatttggggaagggagatgttgccagttccttgaatgtgattcataaattattatgtaggtaaactctgatcagttcctttcctgaaatgtcttctcatttttctccctagttccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacaggtaatgtgaaatactgttcttgaacctgaatagatgcagtggtgcatttaactttcgggtagttcaggtatttcgattgagcatttggagggataaaagggagacagcaagaagggacaaagtcatgttgatagtgacaatgatgttgtccaacctggatgaatgaaaataaagtatgatgtcagcagagagtggcggggttggagggtgctttcagagaaatagcaatgaactgatgtgatcagctggtgcttctgaggcacacagattaagaattaagtgttacttgggtatcacttctttagaactcttttaggagtgttgccatagtagttaacatgtactgacagttcaccatgaaccagacccacagcaaagcattttatgtctacatcttgttcagtcttcacaatgctttggaagccaaggcaggaggatagcttgagcccaggagttcaagcacagcctgggcaacatgacaaaaccctgtctctacaaaaaatacaaaaaaattagccgggcacggtgttacgtgcctgtagtcccagctactggggaggctgaggtgggagaatcacttgagcccaggaggtataggatgcagtgagccataatcatgccattgcactccagcctggacaacagacagagaccctacctcaaaaataaaataaaattaaattaaaaaagaatcaatcttcacaactctatgggctggttagtattatcatcactgccatttttcctaatgaagaaactaaaacttacagaggtcaagtaatttgcctgtagtcccacagctagtgagtgagaaaaccaaaacttggaccaagacaccctaactagcccctcgctatataattagcattcctcatttccactcaccggctttgacttccccctaagctttcccccatcaactttagttcacacagaaaaatcagagaaaagtggcaaattgttactttctttttcatgtgagttctctcagtgggtgccaaaacatcagaagcattcaaaactttgtttgaaaatttcaacagttcattctctaagtgatgacttttaaatttattttctgttttagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacaggtaagcatccacctggagaagggctagattgtagaatgcctcatggttctccaaaatgggacagtgaacgggctcagctattcacaaatccagatttaaaaccaccaaagtttgtacaattcaatggtttcaagagccttactcatttattctttgtatttttctcttaatagagatctgcaaaacaaatgaaagggaatcagaaaccaaatcatttgaacacatttttatacttgctaaaggataataaaattttaaattttaacaagcaggctgggcacagtagctcacgcctgtaatcccagcaccctggaaggccaaggcaggtagattgcttgagttcaggagttcgagactagcctgggcaacatagctaaaccccatttctactaaaaatacaaaaaattagccaggcgtggtggtgcacacctgtagtcccagctgcttggaaggctgaggtggaagaatcacctgagcccgggaggtcaaggctgcagtgagtcgtgatcgtgccactgcactccagcctgggcaaccggagtgagaccctgtcccaataaataagtaaataaataaataaataaattttaataaggagacttccataattatgcatttttcaaaagttctaccttttaagaaagagtacacatctgtgccatctactttacctggtagagctaaaaaaacaagtatcaaatgtatgaataatatatctgtttatatcaatatcactattcatgtattatttttgaaagatctctagccatactatagttctcttacagatgaggaaagaacagttcagaaagcttgtaaaacagtatcaaggatacgtatataacaagacctaaagctataattcaagtctaggtctgtctggccccaaacctcgtgccctctccactgtgacacaatacttcttagatgtctcccattctcatgaccacttatttagttgtggggtctggggcttctataccatgccctactatgcctctatttcatatctatatttatatctatatctgcatatctttaaccctatgacaaatcctgtgttagaagtgggcattcgggccaggcgcggtagctcacgcctgtaatcccagcactttgggaggccaaggtgggtggatcacaaggtcaggagattgagaccatcctggctaacatggtgaaaccccgtctctactaaaaatacaaaaaattagctgggtgtgatggcagacgcctgtagtcccagctactcgggaggctgaggcaggagaatggcatgaacccaggaggcggagcttgcagtgagctgagatcatgccactgcactccagcttggtgacagagtgagactctgtctccaaaaaaagaaagtgggcattcagtagcaaggcaaagcccctgacctcaagaaccttataatctagtgaaggagatagaaaagtaaaaaggcaattacagtaaaacatggtacgtgctaagaaaaaagtggttatgagatgttagaggagcaaacaagaagagtcagggaaggctttcaggaggaagtaatatttaaagaaagactaagaagtcatccaggtgaagtgtaagttgtcttcgttccaacagagaaaacaaagccctggaggtgagagaaaggatggcacatttgggaacctacaccttttttagtatactagaataaaggccgggcacggtggctcatgcctgtaatcccacattttgggaagctgaggtgagtggatagcctaagtccaggagttcgagaccagcctgggcaacgtggcaaaaccccatctctactaaaagtataaaaagcaaaagtatactagaataaaaaatgtgaggcatgtggccaggtaagtagagagaccaaatcacaaagagctttgtttgcctgtgaaggtgttttggaattatggagagccactatagggccattagcatgggagtgctatgaaaatatgctagatagagtctgcagattgaaagagtaggaggtaaggacacaagtgactggtcaataggcagttgcaataatgtatggtctcatttatacttgctaaagggtatgatgtggtcctgaggtagtagcagtacacaaagagggagtggctagattcaagagatagaagatttaggatacagaaataaaactcgtatttgattatatatacaagggtgagagtgataactgaagtttctgacttgaaccaagagatagaaacaaaaaaacaatgagaatattgggggagggagatgaggagtccaatttggacgtcttgagtgttggatgtctgtggtacattcagggagagatgtaatttgcaaaagcaggagaaacatctaaactgaaagtttaaatttgggagttgtcaccttatggatgacacttcaaaccatggacatagacgaaatctaggaagattatgtagaatgagaaaagaaatgaacctagtacagaaaatattattataataacaataatactattttgcctttcacctcaggagctatagaacaaatactagtatccactactgctgaagtcaagtcttgaagttttgaccttagttaatgttagtaataaaagtctaaacaagagacataattcagctgtcaaacccacattcactgaacatgaacttgctcagcattcttcactttctagattcataggtatgcaccactctgcatatttatcagggccattttcactaacttttctatctgagatcctatttaaaatcagagaaaaaatggagaatcaaagtagttgtacagacaggttaagccaacaaatcctttctcctcttttctccataagggcacacagaaagtgtcaatgacacacaaataaagcaaatgcatcatcttctacctgcagttgattcaggagtttttctcaattgatgactttaccctaagtgataaaatctgtattttgttgctccacttgtctctctgcagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacaggtaattagcacagcataatgttttgtagcacatattgccaatgtctgctattgtgtaagaaccccagggtgagagggatgaagcaacattgggagatgatatctatctcttgatacgctgggaacattcaccctgatttgccacttccatgtcagttgccctatccacgcaggactcagcccaccacactctgtttctgatttttcattaatattggtgctattagcttcctattgctgctataataaactatcacaatcttagtggcttaataccacccaaatttattattttctagtcctgaagattagaatctgaaaatggttttttgggactgaaatcaagacaacagggctgtgtttcttgtagagactttagagggagaatccactccttgcctttttcagcttctgaggccgcccacattccttggctcgtgtccccctcccaacagtgacattgctccaatctctgcatgggaccttacatctctttctctgctctcctgcctccctcttccatcttttaaggactcttgtgattaccttggtcaccaaccggacaatccaggataattccttcgtctcaagatccttaacttaatcacatctacaaagccctttttgccacagaaggtaacatattcacaggttctgggggttaggacatggacatctttggggccattattcagacaaccacattggcctaattgattgataacttatttattaagtacataggtctgaaggcggggatggttatgttgacagggacataaagatgaatcaggcatgcttctcgtccttaaagagctgactgacgagacagacacatggacaaataatggcaatgcattgtgataaagagtacatataagagagggatgtctggcattcagggaagcatggaggtcaggtagaattgagacatcttcataaaagtgacatttcagtattgccttgaaggatgaagaaattctccttatggagagaaggtagaatactttgtacagacagtctgtcctgtgcaaaggccaagaggtatgaacaggagaaaggagaagttgtgggtggctgaaatgtgtgttgcatgatggaaaggtgaggctgaaagccagattggagccaaattagagggtgcctggtagccttcctcaggaattttatcttaaagcaatacaaaacttttagccagagagtaattgttttgtaataaaagatgtatctttaaaaagataaatcagatagcaatgggggaatggattgaatggaaatgaaccagaagtgaggagatccacctatcaattcatttattattgagtacctactataggctaggcactgttctaactgctggatatacagaagtgaataaaaaaactcccatggtcattatgtttatagtctagtggggaagaaagtcaataaataaaataaataagtaaaagatgtaggaggttgggtggtaataaagaccaagaaggaaattaagttaggaaggtgggatagcaagagttggggcttacaattttatctatctatttattattattattattattattattattattattattatttattatttttggagacagaacctcgctctggcacccaggatggagtgcagtggcacaatctcaattcactgcaacctctgcctcctgggctcaaacaatcctcccatctcaacctcccaagtagttgggacttcaggcatgtgccaccacacccagctaatttttgtattttcttgtagacacagggtttctccacattgcctaggctggtctcgcactcctgggctcaagaaatccacctgcctcaacctcccaaagtgttgggattacaggcacgagccaccacgcctggtcaaggggcttacaattttttttttttttttttgagatggagtctccctctgttgcccaagctggagtgcagtggtgcgatcttagctcaccacaacctccacctcctgggttcaagcaattatcctgcctcagcctcccgagtgcataccgagtgggactacaggtatgcaccactacacccggctaatttttatatttttagtagagacagggtttcaccatgttggccaggctggtcttgaactcctgacctcaggtgatccaccctcctcagcctcccaaagtgctgggattacaggcatgagccactgcacctggtcgggacttacaattttagatagtacagtccccaaagacttcattgaggcagtgacatttgagtaaaaatctgaaagaaatgagaaagtcatgcaaatatttgggtatttataagcagagccaatgccaacacaaagaccttgagtgggtgtgtgtctgacctgttggaggaacagtaaagaggcccatatggctggaacagagtgagcgaggatgagtggtggggatgcagatggacaggtaatgggggtcatgacatgactgcagtcataggatgataaggaccaatagctgaatgaatgcaggggccctggtgaagaatagtgggtacagtcaagaaatatttttgcattagcttaagtggcacttgggggctgagtggattatagaggaagggacagaagattccagagttttcacctgggatgtctggtagaagatgatgccattaattgagatagaagaaggaggagagagggtcaagcaaaactccagagttcagctgtgtattgagtttgagatgcctgagtgacttgcagagagaagggaccataggtatttggaaatatggatttgagctcagaagagaagtgagctggacataaaaagatctggaccagaatgctagttaaatccataaattgaatgagactgattgctcagctggggctatagaatatgaaggaaacaaaggatggatccttgggaaataacaccttgtaagggcctgacaaaaggagaggagaaagcaaagagagcctgagaaagagcatttggggtggaggaaagagaactcaggcgaaatcaaggcagatgtcctgttctgtttctactggcatcttaagacttctgaggaatcaggcagcatctgtgccagcagtttgcaaggaggtggttgctagcagcacttgaccttgccaagaggtagcacagaagtccaaaagggtttgcaaaattctaacatgaagatttttgtaaagtgcttttggcttttcctattgttactgtttcccgtatcactgaatccaacttcctctttctgtttgcttttccctcttccccacctgctcccttctcctcactgcatttccctccctcattctcttgctcctcgacttttccagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacaggtaagaccaagacccaagcagtaatgaatcgtgggggaattgtcccggtattcactggcttttccttggttggtccttagtttcctattctattcaggatgtagctttatatggcatttgtgactttcaggctgtttgaccctaaatcgcacctttgattatatataactaatttgtggccagtttttgcactggcttctgctcttttgcctccacttatttacttcctagggcttggtaaaaaatgaatgcggttcctcctcttgccatcaaactgtacaagagggctgtaacccatcatagtttaattcgagctacacccttcagctttctaacaagaaatagacggagaggagagcaggagcagagaagggcaaccacaaatataacaaacaggcagtgactgctgcgaattagaaacacagcgctagatgaagtgaaaacacagagttccaggaaagtgagagacatctctctgggctgcaaacaaaaaacagaatctacccttttcccataatttgagtcctttatctcctgttcaaaaaaaaatgttttggggggggacgagttctcactctgttgcccaggctggagtgcagtgatgccatcatggctccctgcagcctcgaccacctgggctcaagtgatcctcttgcttcagcctcccgagtagctgggactacaggcacacgacaccatgcatggcaaacttttaactttttaatttttattttttgtagagatgggggcctccctgtattgcccaggctggtcttgaactcctgggctaaagcaatcctcttgcctcgacctcccaaagtgctggaattagaggcgtgagccaccacggtcagcccacctattcaattcttttttctcatttgacaatagttttaggtgctcttctgtgccaggcacatggcccactgctgtaatgtgacggtgaacaagacagtcaagggccctgccctcagagaactctgcaatagcggggagggaagaggacaaggacagatcatcaaagggagatgatctgggaatgccttaaattctatgaaaaaaatgatgtgtcatgatagtgacttggcaggacaagcaactgctttagataggagaaggcatttcagcagagacctaaaggtgaggggagccacgtgggaacatattccaagggcacccaacagaagttctgtttgtcttttgaaaggagtgaaaaagagcagcgataagcttcaaccacaaatagaattgcctagatgtcatcatttctgaggcaacccaccctttgcacatctttccttacctgctcattaatgcttaaaggtctcccaatgtggcaacagtcttcattctccaaaaaatagcaaagctattgggataggtggcagcatgactaatctatacagtgataggagtgactgttaacacttctctccctaaatgaagttgtaccaatacagattttataaaaaagagcacaagagaactgagaacctaaaggagggtacagaggatgtaaagagacccagagagggttgttatgggatggtggctgcaatgagataggccacactgggaggagctggaacctcgtatatacattttctgggcctttttcataagctaaatgacaacgatttattcatcatttatgaagatttcattttacatgcctatcagggtccatgtggcaagcatctagaagtcaccacctggtttgttttgttttaatttataccatatctctagtccatatgcccttaaagttaaatggcctgaaatgtaggcaagatctgactacaatatgtacgactcacccacatgcccaacatagcatatactctcacctgtgggccaaaatgcctgtgtttctgttttgttctcagtaacaatttttcttctgtttaagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacaggtgagaagcccaggtgccaatggccaagggatggtgggaagtagcttccagagacacattttgattctgattttaatgacaagagataaagccaataatgatataccctgagctagcccctgaatttgggaagggactgtgggacaacagataaaggacaaggctttggtccaaaagaaatatgtccttagcttagctctatgaatctgggcaagtcattgagcatctctaggcctcagttttcttatctgcaaagtgggaataatcatatacatcatcactgtgtggctatcaccagtgcttcctaactgtttttatgtcatgggcacacacagaggtctgtgtgccaccctggagttaatcaacaaggctatctgcaactgaacataattgtctgtggacgtcagccctgtaccccaaaatctgatggaattaatatcttcacacacttgtaacccattcagggcacactcatgctccacagcaccatggtaaggaagatctggctatgaatatttaagaaaaggtatatgaggctgggcaccgtggctcatgcctataatcccagtactttgggaggccgaggtgggtggatcacttgaggtctggagttcgagaccagcctggtcaacgagaggaaaccctgtctctactaaaaatacaacaattagccaggtgtagtggtgggcacctgtaatcccagctacttgggaggctgaggtgcctgtaatcccagctacctgggaagcggaggttgcagtgagccaagatcactccactgcacttcagcctgggcagcaagagcaaaactctgtctcaaaaaaaaaaaagtgaaaaaaaaaaaaaaaaagtacataaaatgctcgaagacagtgccttacacataataaacactattaatgaaagctcctgctactatattattatcatattatctcttcctacaaagtacattaaaagtgtgtctgatgttgctcagctatcttatttgtatatgttatggcatagctgtgattatgtgatttttcactttctcctacattcagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaagtatgacatgttttgctactcttatttctcaaatggagtagaggaagtatatgttcaacatcttactcaaatagggcttggattaaatccatatttttacatgggattggtctggatttgaattcaggcagaagtctctgtagatttgttcgttcattcaacattaacaacaagggacaataaatctctctctgccctcatggggcttacaattaggtaggacgtactatttgtaaatagacattatattttgggtgtgatgagggaagtaaatggtactatggagacacttgttaggtaatctgacccaatacaagagaacttcttggaaaaggaaacatccaaatagaaacctaaagcaagagatttaccaggtagaggtaggggaagaagtggagaatattccaggtagagagaataaaatattccaagatgagagaggagggagagtacaagatctaccaataggggaacagaaagaagtttatttggccatagcataaaaggtgaggattaagggaatcagataataaaatattttgtattccatggtaactactttgaactttattttgaaccaactggagccactcaatttcagcagagatatcataatcattatttacactttagaaagttactctgggtacagtgtagagaatagattgaaagaggcaaaactagaagcagagggatcatagttagcatatactgctgtatgtccctgagataaaaatacttcgacgacgaagcatataccagtttcttcccaaaggcattttgggatagatactatcaccctcaaagaaagacaggtattcagtgtagggactttaatccaaatatttgtgtttcaataatacccagtataagtagcttctgggatcagatcagatagttattggttgttgataaaatacatagttgaaagttagaaatttaagcaagtagttgttttatttttttaataagcattaatactataacaagtataacttttatgccacattgtatccaaagagcagttatttgtgtgtcaagagaaatatgtgaaaaagaactaagagttttagtttatggcgagctcaggatgagttttccgtggctgactgtgggctgtgttcatgaaatctgctaagcagaacaccctgcactggttaccaaacccagggcagaactctaaacacttctgaccattgcatctggtattagagtagccagggaaacacaatgcaaacactggatggaacaaagctttacttacatagagaggagacagagtaagatcagcctcaacagtatgcatcagtcccccacagccagctgcagtagttgcccagagatgcacttgctatcttcaaccctgacaacagaaaacagaagggcgcattgtctgtggtctcttccagcagccaatggagggcagttggctaagtgcacccctctcgggccacagtagaaggaccctgtcctgtctcctcagaggacaactatagcattggtgttcgccatctaccatgtgacacacatgcttaagcagaacaaaagagcatacattgagcttgcaacagggaatgatactcccacacaaggcaatgagcccagcacagggtgtgtaggctctccatctcttggtaagaaagtatcttaagctcaagggccatttcttacacagccaaatgggggttgatagactatgcacatgagactgcctttcccaacagcctcgcaggtgctcagtttaagagctcatacaactctgttagaggctaggcttataagtcacaactggactgttgtattcagtcccgggtgctagaatttaagggaggcatttaccaaaagggggagtgcccaagaggacaaaaactgccatgaaagagagactcagtgctgtttcatgaggaatgattatggtggaacttgtttttgttttgttatgttttgttttgttttcttcgaggcttgtatttattaggatcgggtgaggctatgggtaacagaaaatccaaaatagcagaagtttaaatagaatagaagtttataattttcatgtaaaatcattccagtactcaatttctcacaaatatgcttcaaccataatgaatgatttgcagttctcaattttctaccatcccactccggcacctcctcctttggtacctgggtttctggtttttctctacgtagaatgcctctttcgtgataccttggcagagtgtcacctctgccttacagcttttactaactcctgctgatcactaatagccagcagctaaaagttgtgtgtcacaccacatagcaccttctctcaccatttcttctggtatgttttcctttctaccttgtgttatggctattttggactcatttccatttgtagaggttagagctaacgtcttatttacctctgtactgttcataatccccagaagagcacctggcacatagtaggtacttgtttctctcaacacgtgaaagaagtgttcactccactctctttttgtttgcatggcttcagaggaggacataattcttaactttgcttctctatatgtaagttgtttttccccctctggcttctttcaggaatttttctttatctttgattttctgtagtgtgaaaacgatatgcctagccatagtttttttggcatatatcctccttggtgttttctgagcttcctggatctgtggttggtgtctaacatttatttgtgggaaattcttagtcattcttgtttcagatatttcttctgttcctttctttcttcttctggtattcccattttgtgtaggatacaccttttgtggttgttccatggtccttcgatcttctgttctgcttttcagtctttgttttctttgctttttccatttggaaggtctctattgatatatcctcaggctcagagactgtcctcagccacgtctaactattaataagcccatcaaggcattctttaactgttactcagacttgtccacacctgtcctccagcttttcctaccccaaccttggttccctgggagatttatgctcatgtgtctctgctagggtgagccacgacactctgtatttgcctgtctgtccctcctatacctagatctcagagctagttggacccaaaggagctgaaaaaaaaaaattctccctgagttctgaaaagtgttgcctcctctgtttcctttagagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgtaagtgtccctggaggtgcgcacagagcctcctgtcactggagtgaaggggctgtgcacctttctctatcatatccatcactgctattcacttgcatacacttcacttttgcataagcctgtctgattgccacctggagaggaggacctaaaagtctccagaaatggaaacatttctctgggtaaagtaccctgacagcaaacaagttagatggtcttaaagtacctgaatgagttagtatttaaatatatcactttgcctcatatagttagagctataatggagctcttaagcaatttgaagctacaacttcaggaaattctgctgaagagctacctctttcattatgtttaatgtgccactggcaaatcacttcctctgcctgttttccttcaggagaaggggagagtttcttgattacagcattaaacacaggcacacgctcacacacacacagtctgatgcaggagagcagaatccttcatttcactaactgttgtttatgctgtgaaagcagagttgtgacccctcttggttccttccccacctctttttccaggcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggtaagttatcatgagttaactccactctgagacacagaattgcttcctcagaggtcatgtgggagatctttctgtgacaaagtttaagaaacttaagtagaaaatgtaatttttgtatcattcacccctctctctgctggatacagggagatgtaagaaaaagctgctcaaaggctctttgggcaataaagcctgttatcctctgggtttaattattaaatagaagagtaatgataatagcaaccacaacgataataacaataaccatcatttattgagcccttactacgtgctgtgcactattggaagtgcattgcatgtaatgccttattcagtcctcttcattattgggtcagtcttgttcactactcttttgttctaccattaaacattaatatgcctcaactgtcttcacccctccctgtctcaaatgcctcaactgatcatgcttgcaaaccacccaccaagtcacaaaaataaccaaaagcttaaaagaaggaaaagatgttcatgaaaaacattcttcccttctccactgaattttgaatagttttattctctagtttcctaaattattcaatatctacctaattcctacagataagaacaaagtctagggaatagttatcacaacatcacatacaaccactcagtatgagctttcaagcttattatatcagcatttgtcaaaccacctgtaagagtgttgtatttggggcacacctgtccatatatgtattcgccattgaggtcttgtgtgttatttctccaaaagagatgcttgtgcctggaatgacattaatatagtttacctttcttatatatttttatactgtttaaggtgctgcatgagtttcttaagcatccctgataattttgacccatttgtgggtaagggggaaacttgaaacctgacaaactgtgaggagtttctaggccaatgggtattttaggctcacagtatctaacagtctatgtgctttcacagtttatttaattgtactaaatctggttatgcacaattaattaaataatttcaagggtcagtggtgtgtcccagatttcctcacaccacataattgaagataaattagtgaactgtggaaagactttagacttaattagactgcaatgaagacagtgttttgctacatgaatatgagacagtaaccaaaaaagtcacaccccagaaagtagccttgtgttccccagccagacagccttcccattattgatgtccatggagatgagctgtgatttccaggttagctaagataacaatccatctcatataaacgccatttatagtgtacacactcatgctaaagacaacatttctttttaactactgccaacaaaatatttctaagactcacttatgagcaaattttattaaacaagaatccaggatgctatgataaaccctcactgcaccacttcttgaagctcattgtaaatagtatctgatctctatagtatttatctttctacttacgcttttctccagccaacatcaaaactggtttgcagtgccaaaacacacagcaggctgggtggacaggggaagagttctgggaagtgctctgagtaaggggccaaatttggatggggattaaactgtactcaagataacagatccacatgcagagcaataatcaaactgggcatgacatgtggagcacgccttgtgggatgactgctctggcctaggacatgatttctcttatctttttcctatttcccaggtcataggggtttccttattagctcaactacaatggttattggcaagatagtttatcaagtgggttcactcacaatgggagttgtccaacactctggagttgtgagacatgctctcatttaatgcaatgagctacccttattttatttcctaggaaaatgatgctgtgtgtgtgtgtattttatatacacactatttatgtattttggaaaaagtgaattaaaattaactttattaggagaatttcacatcgttctttgagattgcagaatctgtactttggaaatggccagagatagtggatgtggaggcagccttagaaacctaatttaaaatcactgaaatcacctaagtcacaagaaaggcagtccttaactgtgggttttctcctccaggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacaggttagatatattaccactgttttgctagaagggacatgctacattactaagcactcagctgtctgagcaactgatgcatgcgagcttccatagattaataacctacgttacaagagtactgtgcattttactgggtaatttataaacgttggattcctgcctccacttgcaggtaatgtgtcaaaagggacttcagcactatgcaaaagctccagttcattaagggaagaactgaaggttcttaatagattgttctttcttctacaactttcattatttttttttttttttttttgagacagagtcttactctgttgcccagactggagtgcagtggtgccatctcggctcactgcaacctctgcctccctggttcaagcaattctcttgcctcagcctcccaagtagctgggattacaagtgcacgccaccacacccggctaagttttgtatttttagtagagatggggtttcaccatgttggccaggctggtctccaactcctggcctcaagtgatctgcctgccttggcctcccaaagtgctgggattacaggtgtgagccaccatgcctggcccttctacaactttctaaatatgagtccaatactttactttgctcattattgtaaaaatttccaaataaaatgactgagtttagggagatccaaaaacaatatgaagttatatcttctacttataatgtgaactgaaattatactcacttatttaccttctaaggcatctaaagatggaagcgctctttgctccagacagaactctggaaggcaaagacccctgaatgaatgggaacacgcttttttccccatggagatgactaatgaaaaggagcagctgtctggctttggctccaggaaacatcactgcagtcactaggcccttcggccctaggaattggcagtgctcttgttctgcactgtgttttcagaaagcaggtacaagcagaagtatatagcatcccaatcagcatcctcaagagaaagggaacctaggctaccgtcttggatatagagctactgacatccaacattattacttctgcagaggatgtaccttctctgttgggtgttggaagagctgatacctaaccaatatggcagtaaattaggttttccatgggccagtgttcgttctgctttgttgatgctgaggtcttattggttctcacatatttgaagtatcactcctaggtctcagtagaaaaaaaaactctcctgccacttccaaaaggagactatgacgtactgttacacccaagagagttcttagcccctccctcacatcaaaaaagtcagacagatgtttttcctaaaacaaagcactcatttttggcaggaactctgtaaagctacctttacccaggactcaccagacagttactgttacctcccaggcaaggtcagcacctccagattaaacaaacacaaactttttagtcatacttacttcaaaaagagaccatacaagcctacctaaaggaaacaagatttcagaagaacaagggagaaacatgaaagatcagaaaaccaggatttatcagttcctgtaagaatcaagagatgcggctgggcgtggaggctcacgcctgtaatcccagcactttgggaggccgaggtgggcgaatcacttgaggtcaggagttcaagactagcctggccaacatggtaaaactccgtctctactaaaaacacaaaagttggccaggcacggtggtgcacgcctgtaatcccagctacttgggaagctgaggcaggagaattgcttgaaccctagaggtggaggttgcagtaagctgagatcatgccactgtactccagcctgggcgacagagcaagactccatctaaaaaataaaaaagaaaaaaaaaaagattcaagagattcctcatctccttggttacctgggctcaaggaaactcgagcaaaagtcacctaagggctattttctttttgagttggaaaactgaagctgatttagtttgtttacttatggaaaggggaggggtgaagataactcattactaaatttcaaagagagtaagaagctataaaaaatttgtgtctggaccagagcccaccaatctcccagcacccatagtaactgcggaggtctttggaagagcccctgcatttgagttccagctctgccactttttaactgtgtaagcagcatttcaattctctaatcctcatcttcctcacctgcaaagctccataaggttgtcctaagtagtagtcctgagtatgtgacagatcaaacctagtcatgtcccttctaaattaaggttttcccatagttcccattcacttaccagagcaagagcagattccagtacagggcacactgagccctgctttctcccgcctgcctcaccagccttgtctccaatcgtatttgctccaagtacccactgctctcttgctactcctcactcctcagagttcctgaatgtgacatggttcttttatacgcctgagcctttgcataatcttttcactctcagatgctttccgctcttatctggctggcgaattctctgtacacttcaaaagccagctcaaccctcaaccacccacactatcctgtcagcccacagctgggcagttgggtgctccatcagccccatgtccacgtccccatcaccgtctgcctacattcctctaatcctacatttacagtggcttttaaccctttatcgaattacctgccctctttactagactgcaagaactcacagtccaacaggggagacagatgtgtcattggttacaaaacaatatggcaagttcctggcacaaaggatgtgcttgtgaaatgtttatgaacaaatacgggaatgagccaagatgctctaaggatgtaacacattcgtgttatggcttcatcatctctgtgtacatatttgtttttcagaacacacctttcctatatttctccaatatatatgtttacttcagtcctgttaaaagcatgccagacagataatgcttgatgagaggaggtgtcgtctcccaaagcacatcagagaaccacatgcaaatcagcctcttgcgtggtggctgctgaactcagtccagtcagaattctgcctgtctcaagacagtcattaccacagtgaccctccttgttgttaggcatccttttttccaaagcgaataggtggacaggaaatagcacggtaaaagaataattaggattgagaaatgggaaatgctaggtttagctgatacgcaagtttattatgtcaacagatataatgtgtttcattcattgttgggttcctatgattcatatgttttattccattgttccatatggaaagagaaagggcagatcattatggtgagagagagttggaaggttaggaaagtgctggtctggttttgtttttattctaaatagaagagcagtgtgaccatagtaaggtggtcagcttctcctgacctcgttttcttcaaaggaaggaaattgaaccacatgatctctaactttctgctatagaattctgattctggacacatttaaagtggaaaaaaatctatcagatatttgttcattaaaaatagtgtcttgttattgtgtcatattcataattatctttctataatatattcagcacattttattgccttatctggcaatacgtgttgttgggtgatagataaataaggtggagccactgccttcaagaagcttacaatgtggagacagaaagaagccacatctgcaaaatagaggcagaaatgttgaaggacataaggaataaaggaaaataaattctgtgaaggttcagaaggcttctcaaaggatgtattaaaacacaggaattaaaacataggaaaggatttagaaatacccagatagggacagaaggagattcaatgtggaaggaatagtgggagtcaaagcgtggaggtttaaatacacaaattgtttagagaagaacaaacagtccagtttcaaacagagggtgaataaaaaggagtagactgggatgataggacgagagaggactgtgggtgggtgctaagtgctgggctggggaaagtagttgtgatattcatttttggaaaagttttaagggaagagtgcctgataacccattaattttaagctgaacctatactaggtaattatctccttcctaaaggtcctttttatctgcattcattcagtactttgtgtttacacttgtggtttcagagcagaccatgtcaaggttgttatagccaatgcttttattttacagatgagtcataaagaactttagggaccattcaagtagccagcaatggagtaagagtgagaactagacttcagatcctcttgttcctagcccaggcttttttcatccttcctacaaaagtcatggcgtgtgtgtgtgtgtgtgtgtgtgtgtgtgtgtgtgtgagagagagagagagagagagagagagagtcttgctgtgttgcccaggctggagtgcagtggtgtgatctcagctcactgcaacctccactttttagattcaagcaattctcatgcctcagcctcccaagtagctgggactacaggcacgcatcacacgggcctggctaatttttgtatttttaatagagatggggtttcaccgtgttggccaggctggcctcaaattcttggcctcatgtgatctgcctgccttggcctcccaaattgctggaattacaggcatgagccactgtgcccagccagaagtcattgcttttaaccaaaaattaagccatgaggaaataagaaaagagatctgcactaggagccagaaatatgaagttcagttttcgttcatatctttctgtgtgatcttcgagaagacatggactctctcctagcttcaggttccaaacctctgaagtaatataataaacttctttattatattggagaggttgaacatgatcaaacagaaacatgtttgaaaaagtccttatggctgggcgcgatggctcacacttgtaatccgagcactttgggaggccaagacaggcagatagcttgagcccaggagttcaagactagcctgggcaacatggcaaaaccccatctgtaataaaaatacaaaaattagctggccatggtagtgtgcacttgtaatcccagctactcaggaggctggggttggaggatcacttgagcttgggaggtggaggttgcagtgtgcattccaacctggtgacagagcaagaccctgtctcaaaaaaaaaaaaaaaaaaaggaaggaaagaaaagaaagaaaaagaaaaaaagtatttccacacttataaataagaaactcttatcagagagacactgaatttccaaatgtataataaattagcaacatatttgccaaggcattggtgttatggtggttagcatagctgccttccaaaattagcaaaacacaccaactcctcaccttcccctttaatgtgtggtgactacttgtttccctttgtggacctttctcaatatacttccattaacaggctgttattcctggaagaacaccttttgacttggaatggatcttttggagatggaagttatagatgtgatttatcaatatcatcttgatgttcattttacaggattacactcggatctgggcataagtcagaagaagcgggagcagggtcagaacaatttgccctggcctagtaccgcttcagcattatcacaggacatgccaagaaatatagattttaaaaaaacaaaaacaaaaaaaaaaaaggagtacttctcgtcactttcatagaattgaaattaacactagcaaaagttttcccacataaaccaagcctaatactccatcagttcaattagagaatcttcacaataggagggacttaagaagtcacccaagccaatctttaacttagagcagcgatgccctcctccagcttccctgggactgcttctcctccagcctctactagaatcccactcccatcttccaacccccagtgactgggagctctcaacctaggaggcagctcatattctaatgttagaaaacagcttaatgttcctaaactcctccttccttataaattcagcctacagagcctaattcttccttcaagaagaaaaataatcatgttgttttcctcttctacatggcagtcttccttaaatctgaagctaactatattatgtcccttgaagtcttctctatcattgttcaggtcagtcactcaaatgatctctaattcatcctaaaatatgcccccagaaattgagtgcagctctccagactgggctgacttatgcagagagcatgaaacttaggtcctatgatagggatcacaggcttctcattcaagcagaggttacaaatctgtgtgtttgtagctgcatcttgcttgtttattgaatttaggaccagctgattttcaggcactatcccacatggacatgtggacagccacctcagcaactctcctgctcaggtgactggaataatgccagtgtcagctggatagttgtaaatcaatgcctcactgtccctctaaatcgagtatatcccaagcaaagcatatcctccttcaccagtctgtcatttttttttttttttttgaggtggagtcctgctttgtcacccaggctggagtgcagtggcatgatcttggctcactgcagcctccacctcccatgttcaagtgattctcctgcctcagcctcccaagtagccaggattacaggtgcccgccaccatgcccggctaatttttgtatttttagtagagacggggttttgccacgttggccaggctgatctcgaactcctgacctcaggtgatctgcctgccttggcctcccaaagtgctgggattacaggcgtgagccaccgctcccagcctgtctccttatttctatcaatgatcccactgttctcttgagtgacatgagctcaagtcttaggccatccttgattctcccctgcttctcttcagtctgggccccatctagttcctcctctcagtgcctttcacagtcttctttccattctcattgccagggctcctggccagggccctgtgtccttggcctgactatcccagcagtctcttcattgagctctctgctccagccacctcacctcctatgcccacacacactgtttcctccatattctaccattcctcatttgccattgtatatatgctttcttattttgctatttgcctgattcctttgtattttgtctttcaagtttccaagactagtgaccatacatctctttttaacttcagcaatttataaagcagtgctttaacaaatatttcctgttgacaataaatatgatattagaatatttttagataaaatgatctttagaaaatagtgccaaaagatatgtaagttaaaataacaacaacaataatattgatatttgggccacttgacttctctaatgggcatctcagaattacttcctccacaactgatctgtctggatcttcccaaaccccccagtctacttctcaatagttttccctcatgttagtaggtgacacctccattcttccagttgttccccatccagaacatgtggaatcatccatactctatattcatcagcaaatcttttagttcttcctttgatatatccaacacttctcactcactgccttcatcactaccattctgaatgaagcagtcccacatgctttattcccattgctttccatcttccttaccctgctcttttctttttcatagcacacatctcatctgatttattatatttgtgtgtttattgtctgacttcctccatgagaatgtaacctctggaatggcagggactttgttttgttccttgcaaagtcccagctactagaacagtgattggcgtgtggcaggggctcaataaatatttatgaataaattgatgaatgaatgcatgaacccaggtctatccgattccataactcatattctaccctgctacccactgaccaggaacccgccctatttctccttgaacacatttttcagctactgtgttcaacaactaatttatatttaaataaatcggttttcttttcagaatcagcattcgagcttttacacagctctttgatgaggacctgaaggaattcacaaagccactctattcagacacatttttttctttacccatcactactgaatcaggtaaggctaacctttacatcatgttctaccaactgccatgtcacctacaagagcctctaatggggagatattggctgatggtggggggaacatttattttcatttggaacttaatctttatgtgaccaaaaattgatgtggatcaaagggattgtacaacctctctagaagaatggattgaaagggggttaatctaaaaagaaggtggaagtacagtatttttttctattaaaaatgaattattttctaaatagtgagtgaaaaccattaaaatcaagagttttcacaggccaaaatataagttactacaaaacactttcagttaaaagtgagaatgtatatatgcatatacacagaaatgctcaggaaaaaaagactaaaagaaaaaaacaccaaagtattaatgatgtgtatctcaaagtaatggaaatacaggtgatttttcttccttttgcttattatgtgttgactttgtagtactaaaaaccattaatataaaagactgtgcataacaatttctgaaagagacttctctagtgtgttagagggaaagcctgagtaataatagtggctagtatttactgttcaccttctctatggagacatagttttaagcattttacatgggataacttgtccaattctcatgacagtcttttgagctagatgctattatcatccccatcttaaagatgaggacatgaggcaccaagagattaagtaatttgcccaagatggtgcagctgaaattctggcactttctgcccaagcgtacaacctctgcactgccctgtctctgaatacttccaccaggctgagaatagcatcatttcatcaccttccctcccaacaccatcgtctgcgtagccttttcctgtaatccgtgttctgcaatgcttgatctctaggtctgggaagttctttacagctaaaactgtctctcgtgctgcatgacaaacgatgactcagcctcacaaacattccaatctatttatgccaaatatagggataatctcccaatttcaagctaaagggggatgagaacacagttaagaggatttagatgtctttacttataatttaatgtagggactttgtaaacacaattctttcctttttgaaatactgttacatgacaaaaattgcatgtagtccagtacaggaagacagtaaacgtatattcaaaaaaggatattaactacattcaaggaaagatgattgtgttgatttgatgagtcttgaaaagcaacatggaacaaacaaatctaagatcttaaaatgcaacttcaaaaatgggccacttcatagacctaaatttaagggataacacagtaacacttttacaagaaaacataggtgtaaatctttgtaaccttggattagaaaatagctttttagataggacaccaaaagcataagctacaaaagaaaaaatggatactctggatttaatcaaaattaaaaacttgtgcttcaaaggacactatcagcaaagtaaaaagacaacctacagaataggaagaaaatatttattttccaaatcacatatctgataagggctgaatagcatataaagaactcttacctcacaatttaataataaaaacacaaattacactatatatatagtgtaatatatatatttttttccttttttttttttcttttttttgagaaagtctcgctctgtcgcccaggctggagtgcagtggtgcgatctcggctcgctgcaagctccgcctcccaggttcacgccattctcctgcctcagcctcctaagtagcagggactacaggcgcccgccaccacgcccggctaatttttttatatttttagtagagacagggtttcacgtgttggccaggatgttctcgatctcctgaccttgtgatccacctgtctcggcctcccaaagtgctgggattacaggcgtaagccaccacgccaggccatatatatatatatatttttttttttttcaagacggagtcttgctctgtcacccaggctgtagtgcggtgatgccaccttggctcaatgcaacctccacctcccaaattcaagcaattctcctgcctcagcctccccagtagctgggactacaggcatgcgccaccacacccggctaatttttgtatttttagtagagacaaggtttcaccatgttggccaggctggtctcgaactcctggcttcgtgatctgcctgcctcagcctcccaaaatgctgggattacaggtatgagccaccgtgcccagccaaattacacaatatttaaatgggcaaaggctctgaatagacatgtctccaaagaagatatacagttgactaataagcacatgaaaagatgctcaacatcatgaatcattagggaaatgcaaatcaaaatcacaagaagataccacttcacacccagtagcatggctataatcaaaaagacagtaacaagagttagtgaggatatgaagaaatcagaaccttccatacactgcttatgagaatgtaaaatggtgtcactgctttgaaaaacagtttatagaaatattaaacctagagttaccatacgacccagcaatttcactcctcagtatatacccaggagaaatgaaaacatatgtccacatagaaacttgtacatgaatgttcatagcagcattattcataatcgccaaaaagtagaagcaatttaaatgtccatcaatggataaacaaaaatgtgatatatccatacaatggacgattattcaaccataaaaaggaatgaaatcttggtatatgctataacatggatgaaccttgaaaacattatgctaaatgaaaggagccagtcccaaaagatcacagatttatgatttcatttctatgaaacatccagaataggcaaatccacagacacagaaagtagattagtggttgccagggatcgcggggagggaggagtgggactgactgctaataggtatgcggtttcttttgagggtgatgaaaatgttttaaaattgattgtggtgacatttgcaaaactttgactatactaaagaccactgaattgtacaacttagatgggtgagttgcatgctatatgaatgatatttcaataaagctattttaaaaatgaggccactcttacctcttcataaactcccagtagcgttaccataccagataataaaaataagacttcttaaaatagctccaagcaatccactggattttccaaagccccagatgctgtgtaacatgttttatataaatgaaatggcatttttatcttggtggcaaacttatggcctttatctcaggtgccccaagctttatatacaagtgcaaagtccaaaattcctctataagctatgcaacattaacttcaaaagtatgcagtgacacctggcctcactgctacagggtgggagccagcctttcatcatcttcttaggtgcatactcagagcctttggaaagtaaatgcctcatcgtgggcatcacttgaattctatttgtaataacattacttgggagatatggcttcaatagctttcttactggttccctagcactaattttcccacctgcgtttgttgtttctatctggattattgtagagcccttgtttggagctattgaaggtgtgagtgctggtctgtttttaattggcatgctagtggctgttgttgccttattgatctgcagacagaaagtgaggtaagtacaaagatccttttggtgattggacccacaactttaaaaatgcaactgaaaattccctttaggctgaaaactaagaagggaaaataatttaatttttccaggttaaattgtcactgttttctcaataaaaacaagtcaaactctaaagccatgactcacttttctcagctcttttatatcccattgatgaattcagcccttaccaaaggactgaggggccatctatagctttatttaaagatgaagtgactccttttgcacaggaaaaaaatattttgtgtgtgtgtgtggttcatatcctcatgaagacagagatgtttgcaaattgcatgcccaagtgcttttctgaaatatcctgaaaagtgtggttgacatcaccattttgtagttcatatctgccatcctaatttaagaagggaccaaaaagaaccaaatagcatgtggccccaagtgtcgtgccttcttctcttagtgaattttttttcttaatttggcacatgttcctctttattgaagtcgtgtctggcatctgaaatttactggatttttttaaagcaaagttttattgagaatgtgggaagtgattataacctgtagccaaaaaccaggagacaaatcttcagtttttgcagagatccgtttctgggtgggaatgatctactttattctctttcctttccctccctcagagatgttggctgagtgcaaatctatatgaatactgaaaaatccatatttgcacaaacatccacagccttaccataaatggaaaaatttgttcaagccaagtatcataatcagaataaaagttatctcccttatgtttcagccatggtcgagaaagaccctctgcccgtctgagcattcgtagggatcgaccattatctgtccacttaaacctgggccagaaagggtaagcaccacatttgccttcgtataatttgttgaaagatggtattatgtgaaatttgctaacaaagtcttcctcttttggcttctcttcacagtaaccggaaaacttcttggtaagagagagaacacattaattactatattatctgcctttgaaatatgagtcagaatagttatggcactttcccttttctgcagtaactcttttctgtttgtttcatttttaattacagtccaataaaaataaatcagtttgaagggcatttcatgaagctacaggctgactccaactaccttctatccaaggaatacgaggtacaactcaggcagaatgaagcttcagcatccctagttcttagcagaatttccttcctaatgtttactgtgtcatcataggctgattgagctcagaagttaggaggctgcttagaatctcagctgagcactcttttatgcctaaactatgccctgaatagaatataccatctaatcttagaggccagcttgagctccagaataacacagcaaaccaagggctacctggatcagatagtaaggaagaattaacaaatctcaaatgcagacctaatgctgtcagatattcagcctggccatttgcttggctggaagatgccgtggtttcgcaaaaagcacgtagcttttggaactgattctcaggtttgccacttgggtgacctggggcacatcagttatcctgactgagcctcacctgtaaaatagtgagaccaccacctcccttgtggggctgttgtggggatcagggctaatgcatgttgagtactaggcattcataaacaatagctagtgtatatattttcatgttattatgttatctccaggactgtatgatttgctttattctatttcatattctccacttacaaactcatatttgacctaacaggagttaaaagacgtgggccgaaaccagtcatgtgacattgcactcttgccggagaatagagggaaaaatcgatacaacaatatattgccctgtaagttttgtgtcaaaatttgtaatactgtcttcctctagccatttctgcatttttctccaaaaatgaaatgaggctaaagaaatataatatagctcgatatggacaatctcaagctctgaatgcctttaataagaaatagcttgtatattcctgcacttccctccagagggataatagccagtttaaattctgattatgaaagtcctcttatgctgttgacatttccccatgtgatgctattgcttctctttggaggctaagcagtaaatggggttaacagcaagggctctgacatcaagcagacctgggtttgcttagcaaagtcttcggttagcaatttctacttaaatttccttaccccattaggtaaagcaatagaaggtaggttttctggattgtattcattccagcagtgaaagggagctggccactccatcaggcaaatgtggtaatgttagaaagggaagcacagatggggcttcatgttgtctcctgtgtctgactggttataggccacctatgcaacatggggcaagttagttatcctgcctgagcctcatctgcaaaatggagataagatcacttcccatctgtggctgttgtggggatcagagctaaggcacatcacacacatcacataaactgtagaaaagtcactccaagactcagcagcaaatctctccttccagatgatgccacgcgagtgaagctctccaatgtagatgatgatccttgctctgactacatcaatgccagctacatccctgtaagtgacccactaggccatagtgttcaggatgaggctttggtgggtggctacactggagatgccactcctccatgttcctgttattcttaggtctggaaacacctgtagatttcagaagagcacatctgaatgccataaaaaaaatggggtatccaattcagttcctgctacgccacatttttcacaatggctatagtcaaatgaaattatgagcccaagatgcattttcatagatcatctactctctgcagtccttaaccaagatgagagcttcctaaggaagatggacctcccctgctaaagctgcctagctagagaagctgatcccatgttatttggaatcttcacaaccacagacacaactcaaaggttatatcaaatctttgggctctggttttggttagcatcttgccaccttcctatggcatactgcagtggaaaaagctttcgggtcaaacaaatctaggtttgaatcccacttctgccccttgttgattctgtgaccttgggcacattatgtcacctttttgggcctccattttcttttccaaaaactgatgataataatatttacctcatacctcaagcaaccatccattcactcaataaacacttagaaattaagtgctaactgagctgtttacaggcatgggataagatggaatcctgaccctaaaggaactctcagaagagttgaggcaagaaaaggcaatggcatgggaaacctgccacagcagtgcctctcctacattgaaagatgtctgcgccatctgaggatcttgtgaaaaggcagattctgatccatcagggctgaggcagggcctgggaatctgtatttctttcttttttttttttttttttttttgagatggtcttgctctgtctgccaggctgtagtgcagtggcgcgatctctgctcactgcaagctccgcctcccgggttcacgccattctcctgcctcagccgcccgagtagctgagactacaggcacctgccaccacgcctggctaatatttttttgtatttttagtagagacggggtttcaccgtgttagccaggaagatctccatctcctgacctcatgatccgcccgccttggcctcccaaagtgctgggattacaggggtgagccactgcgcccggccgagtctgcatttctgacaagcctcttggtgatttcagtgctgctggtctgagaacggcactcagtagcgagaggctagagattgccatggggcatcttggagaatatcccccagcagagagaaagataaaagaaggctcagccaagcaggcaccatgctgaggataagtaaggattggtcagatgagaagcagtgtttgggtgggcgggggtggcgatggcagaggtgacataatgtggagaccctgaggaaaggcaaagagaaagagcttcgactagaattgacaaggaattgctgtcattgccggagtgcagaaggagtagatgaaaatatcccgctcttggactgtggtttggattaaataagtcctgacctgcgacacattagatggtagacgctcagtcaacagtttctcttccgtgatgcttcctgtggatgatatatcttaccaaattattctgacattgattatccaaaatgactaacactcttctacattaaatagggaaagagcctgattacagtccctccaacagtctacacaaataccccccaacacacacatataattgagggtgaagtgttttctagatcattgcctaagtcccccatttgctttcagaatagacccaggcaagtaaaagggaatgtggctcttaacactagttcaatgttctgacctttgtccttcctgctcccaagcattgacacttgtgttagtatctttttctgaagtcagagacttggcagagacctccctatcatctaatctgaagaactctttgtttatagttctgaagaggcccattgtttctgactctccatattgtaaattcattgcagggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtgagtaaacagccttcctggcatcaaagctttgctttctgccacctggatagaattctgccccatcatcaaagtgaaaccccgcaaaacaacgtagggatcatgtgagagcattgttagtgacttataccactctgttcaaaagactctaatagtaaacccaagtgatgcctgattctgattctgggtctgaagttccagtcaaagctgtttccatttgaggactgggattagtggcagtgcccattacaccaaaaattacctggccacttggctactccattcttcagtgtctggctggaggagagaccctgccagagtcactggacctgcccctcatcccaggaaaggagaagtgagttgtagactgtgttggcagacacaaagtaaaataataatccagacaaatcaaccaaacccccttgtaatgcacttaccatcctctactttatatggttattttgaggattaaaagattgaggattaaaagagagattacgtataaagtgcctagtatctgcgctcagtaaacatatgcttacattcctcttccccttgtctgtatacatgtaaaggcgagcttagctaaacgttctaacttctcaaagatctcttggcacacggcccacgttaggacagtgacataaaaatatgaacgaagaagggccaggaagacagtgccttcctctacccaactagatatttctttctttagaaagaacaatacgttgtgaaccacagtttacctgctagtggaactgaaatgctgaggggaaaaaaaaaaaaaaaaaaaaaaaactcaagccatatattactgggcctaaaaaatgagtgaacccaaaggttggagtcaggggtgctccttgtacaggctctccccttcacttggagcagcacctcagcttcagcactggccatgagaaggttaatataaagtagatggtcaaattgctttagcagctgatcccagattcctaactttggaagacatttagaggagggaaaccccaggttcaccaaggagtcacttttccggactcatgttttttctgtctgtcctgttctaggtaaagtgtgaccattactggccagcggaccaggattccctctactatggggacctcatcctgcagatgctctcagagtccgtcctgcctgagtggaccatccgggagtttaagatatgcggtgtatgttagcttgcttgacttaacaaccgagcttggggagatgaatgagatctgtgaaccccactttcgctggttcctctcttgtagtttcagcccataggagttgctccatggctcagctgtcaagtttgaaggtttgcattggacagttcctcttttatcctgctctctgctcttacaggaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcaggtactaggaaacctagcagccaataaaatggcagccataagggggttgtgcctgggagtctggaaaaatacataagcatggggaatttggtgggtggaggatttgtctggaccaaccagcctgcctcgcccccagagggttttataacgttcctccccttctgccaacatcatttctcttccctgacttcttttccactttcttcccctgtagcctctctctcatcctcactctccagccttctctctccctcttgcttttttcctactttctgaaatgcaaagtcctgatgggaattccatgctttccatcatcaggcatatcaccttcaatctaagttcccaataactcccttcacattctagccaggaaagtgagcacacaagcttattcttgcctctggccattcttccattttggaatggctttatctctcttctccacctaagtcctacctatccttcaagatttattttctaatcttccctccaggtctagtagcatgtctttgtctatttgtgctgctaaaacaaaataccacagactggataataaataatagaaatttatctgtcatagtctagaggctggaagtccaaaatcaaggcactggcagcttcagtgtctgttgagagcttagtctctgcttccaagatggtgccttgttactgtgtcctccagagcagacaaaggctgtgtcctcacatagagggagggatggaagggcaaaagaacctagctagttccctccaactgtttcacaaggcaccagtcccgttcatgagggcagagccctcatgacctaatcacctcctccacctcttaatactgttgcattgaagattaagtttcaacatgaatttttggaggggacacaaacattcaaaccacagcacagcaattgccacctgtagcacctaattttttctcttaaatttgttctcttgatttctctttgcttcagtctgtccagaaaatcaacctaacaagtgaaatctctctctctctggcgagcctggtatctagcaaattaatgtttgcagcaacattttgatagccctaactgaatggcactaataaatatggagcagggaactgcagcagtaagagaaatgccaagtgtactcatctcctccctgtcagcccagcaccctaggagccctgctttcctatgtccttggaaccttgacacttttaataggaaggtgaggcactcacctcagagctttctgctttttgaaaaatggcaggcatttttgtccaggaccactggagaactgttatcttataaatgtgtgtatcaaaaatccccagatgacacaaccattttggggaggaatttggcaatccctagtgcagctgaaggtgttcatgcccatgaccaacccaagagttctgcttctaggtgttgacccctgagaaatctccacatatattcatgttctttgcaacacatgttttaatagagaaaaatttaaaatgatctcactgccactggattagcagtggtttatgaagagaattaattaaaagaaattagatcagctgggtgtggtatatcctgcctctaatcccagcactttggaggccaaagtggaaggatcacttgaggccaggagttcaagaccaagctgggcaactattagggagaccttatctctacaagtctttttttttaattagctgggagtagttacacatgcctgtggtcccagctactcaggaggctgaggtgagaggactgcttgaacctgggaggtcgaggctgcagtgagctatgcttgtgccactgcactccagcctgggcaacagagcaagaccctgtgaaggacggaaagagggagggaggaaggaaggagagagaaagaaagaaggaaggaaagaagaaacgagaagatctatatgtagcaatatagataaatctgaaaacataatattgagtaggaaagttgacaaaaagatacctaaagcacatatgttaccatttcagtagatttttcaaacataaatgtttatagatttacctgtatgtaggaaaagtattaaaaacatgcgtggaaatgatacacagtaagtgcagagcagtacttatccctggtagagtggaggagggacaggaagggagtggaaagagatagaaggctgtgggggggtggggttgggggactctaggttaaacttatttgagagaaagaaatattcctatcttctcccataactgggaagggaaaaaaaagattgtgccagagtctctagatgcaatcttgaaaggcaaatttaataaaaaggctcaatcttcctttgccatctcttctagtgctggtgtgggtaggactggaacctttattgcattggaccgaatcctccagcagttagactccaaagactctgtggacatttatggagcagtgcacgacctaagacttcacagggttcacatggtccagactgaggtaagagttatagactgaaagttacaggccaccctcctccccactgtattcccacaaaaaaatatccaggaccttaatctgacaaggggaaataactatgacacattaggaagagaaaaaaagaactgcatgtagatattttctaagacttgttattttaaaacaaatctcactggtcttgaaggtgaccatcttggggatcattttaagataggctggcagatgagcataagaacttcacttaggaaagaagaagatcccaatctcttctctcccccagccccactccctccacctacacccccatttcaggagaccccaagggagtgtatgtagatggtaaagaccacgtgcttccatttgtgcagcactttgacatttgcagggcatttttgaacatgttatctcattaaattttcacaataaccaagcgagacatattatattctacttccagactagaaaatgaaggtccaaaagcttaagggctttgcacaaagcccacagccatgaagtggctgaggtggcttggccactattctagagaaacctgggcccttgattgtgctataagcgtactagcctcagggtcagatctcttcctcaatagagaccaagcattcactcctctgcatcaatgccttctaaggctcaaattctcttaccctcgtgtttcacaagtttttctccaagtaactaagcaaaatcctctgtattaaaaaaaaaaaatccatggttggaaaagtaaaaagttctacatgcttctgtgtcccctcttagagccacagtacccaaggacaatgcacagacagcaatgctccataaaaagagagcttcctgcagccaaggccccctttgagctttattgaacccactaatcccaaaaccaccttgacccctgaattcttttcttgtgcagcacatattaatatcctgcattcaagccagtaacaattgaaccagagaaatgaaaataaaaattaaaaatattctgcagaactcacatttgacaaaacaatggcatcattgcctcctgcaggcaggaacctctgccaccactattgtcctgggctgggagtactttcattataacaatgattctaccatattttgaatgttttattatgaaattgttttgaaaaaatatacaaaacatggctgggtacagtggctcatgcctgtaatcctggtgctttgggaggcctggagaggggcagatcacttgaggccaggagtttgacaccagcctaggccacatagcaagagcccatctccacaaaaaatttttaaaaagaaaatacacaaaactaggaaaaatagtatagtgagtttccatgtacccaaacccctgcttctacaattatcagtattctgtgttcttttcccatctgtatcccacatttaatgttcccctaccccatgaccttatcccactgaaatattttaaagcaaatcccacttatcatattatctcatccttaaatacacatatacttatatacacatatgtatgtgtacacgtgtgtatgtatatatgtatgtgtgtaatacatgtcatattgcatatatgtgtacatgtgtatatgtgcatgtgtatatgtatacacctatatgtgtacatttgtatgcatatgtgatattacatatattgcatatatacatatgtacgggtatataagtgtgtacatgtgaacatgtatacatatatatgtatatttgagatactctttaaaactatgaccacaatgtcattatcacatctatgtctttcttaaccgttattcctaaatctcacctaatatccagtcagtatttaaatatccctaattatctcaaaaaattactttttataaaaaactatatttggttttcattagaatccagagtttacatatttcatttggttgaagtgtctctgaaatctttctataatctataatcctccctcccatttgttttccatgatatttatttgttaaagaagccagctgatttcttcggcagattttcccacattctagatgtggctgattgctttttcatggtggtaatatattcctctactccccatggatttttcctctactccccatggattttgtcagctggtggttagatctagaggcctgattaaactcaatgcttcatgggtggtgctgagggctttctgttgcatgacatcagaaggcagatcaccatgtctgtctctctttcagcgctgaggaaactgacagtgagttcaggcagtgtcagcctgaacccttcattatccccatcaacccttcacttaatggttttagcagccactgatgacctctgcctagcgctgttatttcatcaaaggttgcagaattatataaccctgtatcataattattaattattatccttcttattaattattatccttcagctttctccacaagactatgcattcctagagggtgggagcctgttttcctcctcttctatatcctcaatattttttaatcttttaaatgaatgaacaaatatcctacaattatgttgctaaaaagtcagcattaatattttgttagtttattgtcactttcacaaactcaaaccctaattaatttgtaacttgggaaagaggaggttatcatattgtaaatagtctcaaactgtgtgtatttgtgtgctctagtaattgtcaaaggattcttgggccatgtatcacctccatacacctgccccaaactcataatgcattttggcaactaggagggactctactgtcaatatcactggctgactttcagagcagaggtaacacaatgttcctcttcctccttctccttagaaataactccatcttttccctgttctgttctccttttcctcctgcctcactgaggacactgtggcatagttcctcagcttgccttcttaatgtttgagttccccaaggttttgtcctcaaggcaccaccctttctctcagtcttcattctttgtgatattctccattcctgtacatgctcatgttacccaaatctaatctcctgcctccgcatacatgtaaatgcctgcctaccagatggatccccccaaaagccttatagccatctaacttcaaaaagatcaaagtcaaactcattctctttctttcaaaacacaaaacaacaacaaaaaccttcctcctgcttttgcaccttccagtttcatttaatagtattgccatccatgtgtttgcccaagccagggagctgacttcttatattttttaagggatgcagtctcattatgttgcccagactggactcaaactctgtgctcaagcaatcttctacagatgtgcaccaccacacctggcatgcttacatgcatggatatgtgcatttatttattatttctattttttgtttgtttatttacgtggggagataagatctcactatgttgaccaggctagactcaaactcctgggctcaatggagtggatttcttttcctccagttcccacatccaagcagtcacgaagtcctttccttcccttggagctagcccctcatcccactgccactgcccttgatcaactctcattagccctgctaatgagtagcctcctaatgggtctcctgcctccagctctgccctaatgatccttcgccaccactgccaccatcaaagttcccttgctgactctgccagctccctgcaaaaaaatcgtgaaaagctcaccactgcttgtaaaatgaagttcaaacctcatcctgggtacaagcttctttataacctggcccctacttactcctccagcttcatgtcatcgtactagccaccaccagtgtttagggtctgccagattaaggaaggtttacccacctgggccagaatccactttcagtctttccatcataatgaaataaacattgcagtaagataaaattttctctctcccttttttctcaaacaaaattccaaatgctatccaggtattaggttggtgcaaaagtagtcacggtttttgccattacttttaatggcattaattgcattttaatggcatttaaatgcattacttttaatggcaaaaaccgtgattacttttgcatcaacctagtatcatctgccttgctttaagcctctgctgaagttgagttgtttctacaggctcagaaaccctggtgctagagctggcatttggtaatgggagtgggtgcagaggggtgtgatctgtggctgagcccctgtgggtgactatttcagcaaaagacagaggacatttggaccccttgtattatttttctgggtccatggtgacagtgaacttcaacttacctctgtctttatttgagatacaaagggatgcaggtcttcacaagtttccaaacagcaagcatttctaaacaaagaggcattggtcaggggatttgtgagtgtcccttcttcttttatgctgctttgagggaaatttgcagcctgaccctgagagacacattaagggagcaataacctgttaaagaacaatagatgatagtcacagtctcaatctcatttgcttctcctgggaaggaaacactgagatgttgtaggactaaggacctcaggttgcatttggggcattgttcgaggggtttcccatgacccatgcaaccagcattttagctgcactagacttctcatggtttccagaatatatgtgaaattgtatgttatgttgccttacttctttgcttgaattcttataaatatcaccttttctctttagcttgatagtttcctcccctcaaagtgagcctaatggctttctctcctgtatgaaaccttatacacaattgtatctgatgtttagcatcttataggtatttgttcactaaatactaagccatgcactcagggatcacaaagagactgtaatactataaataatatctaatactccaaatattgatgaaattgaatggaactgaatgtgtgaacactaagccaagccttcaccagttaacaaaaaattatcttttgtgatctgagattcatatattttgtctacttttcattaagaataaagtgagaagcacattaacaatctcaccgttttagtagtaatcattttcaaagggacgttctattgggaaaggaagaatttgtatttaaggcaaggcaaattaatagatattaacttgtttcaaagcccacggtgaatcattgttaaagaatttattaataggccatagcacagatgcactagagttcattcacagcttacctctaaagtcccaaagtaatgtaatatcccagtagaactgaaaagatgaattatgctttgggtgggaggaaacagggaggtgtcagcctataatttggtggatcctttttaaggtagcaaaaagagactgctttatactaacaaccattctcagattgtacctttctcagattttcaagattgagattgcatgtaacattcataataaatgacaaaggtctgtgagcagaaaagcagagaatagttatcaatattattgcaggcctcacttcttattgatttgtttaaaatgtccttttctaggctgggtacagtggcacacacctgtaatcctagcagtgtgggaggccaaggcaggaggatggcttgaggccaggagtttcagaccagcctgggcaacagagcaagatcctgtcgctaaaaaaatttttttttaatttatccaggcctgatggtccatacctataatcccaactactcaggagactgaggtgtgagaatcacttaagaccaggagttcaaagctgcagtgagctatgattgtgtcactgtactccagcttaggcgacagaacaagaccctgtttcttaaaaaataaataaattaattaaattaaatgttcttatctattgattataccagacctaccttatatagtcccatggatagctggccaagctaggttccaatcagggacagtatctagtgccaacccataaaaataagtacctgtttacttggaaagattgttagtgaggaaagagctaattgttctactttgtatctcaaacctctaaaatacttttaagactgactacactgattgccttaaacacaaggtctggaaatatttttcaatatctatctgtctgacatcaatctatatcctttaatagacaaaggatgttagctataaaagagacctttgcctccttgtttaataagtggggaaactgggatccccagaagcctgatggctcagcctggcctggctggaggctgctgagagcccagtctccttcactgctcacaactccctctgagcagttgctcagcaagggaagttatcagcaagggaaggttccgcagaaatcaatttccttataagagaactcagggagtataaggaagggggcccaatgcacaagcttggctgcctgtggctgagacacagtggcagtggaggtctttatggtcaccaaagcactgactcttctatatctatttatatttcaaaagtagtaaattcttaaatagccaacagatgggtctgtcctcgctatgtaacccttgtagttctctgcagttagccaacatctttgagattcttccacgtggcagacccagatgctgagagaacagaggtggataagacactgaccttgcactcaaagaactaacagtccagcggggcttattgtacacacctcctttttttcactatcttcctagaataaagggaacaaaccagcagagtatgcagtgaaatgattttctcattcagtaatgcaatgaaattgggattcatctaagaaaactggtgtagtgaaaaagacatgaactttgaggtcacatctccaagatcaaaccctagggccccatttcttagctgtgtgaccttggagaagttacttttgagtctcactttgtactgataattgtatttacttcacaaggtttttgaaatcattaaatgaggtaatttacgtaagctacataggagtgtccggcatttgttcatctactcaatttgtaaaggacctactacgtactagacacagttgtaggctctcacagaatattttatatatatatatacacacacacacacacacatatatacacatacatatatacacatatatatacatacatatacacacatatatacatacatatatacacatatatacacatatatacatatatacacacatatatacacacatatacacacatatatacacacatatatgcacacacacatatatatataaaaagaatgaaaaatgccacctctctgcccattaccattgttctcttttcagtggtaataaaagacagtcactcttttatttaccagagaccattagtgaagcgatgttcaagaaatttgctaactatataatcccatcattgtcaacagtttgtgagtttctcatctttcttatgcatgagaacaggccctcctctgacatgtttctgcttttccacagtgtcagtatgtctacctacatcagtgtgtaagagatgtcctcagagcaagaaagctacggagtgaacaagaaaaccccttgtttccaatctatgaaaatgtgaatccagagtatcacagaggtgggcacttacttcacttacttccccaagtttcttcatcaagatatggtcaatctggccaggcatagaggcttacacctgtaatcccagcactttgggaggctgaggcaggaggatcacttgagcctaagagtttgaaaccagcctgggcaacatagggagatcctatctctacaaaaaactaaaaaaaaaaaaaatagccagacatcatggtgcatgcccgtagtcccaattacttgggaggctgagggggaggatcacttgggcttgggaggtcaaggctacagtgagctgagatcgtaccactgcactccagcctgggtgacaaagcaagatcctgcctctaagaaaaaagaaagaaagaaaagattctagctgagtgcagtggctcatgcctgtaataccagcactttgggaggccaaggcgggcagatcacctcgagaccagcctggccaacatgatgaaaccccatctctactaaaagtacaaaagagccaggcatggtggctcacgcctgtaatcccagctactcgggaggctgaggcagaactgcttgaacctgggaggtagaagttgcagtgggccgagatcccaccactgcactccagactgggcaacaagagcgagactctgtctcaaaaaaaagaaaagaaaagaagaggagaggggaggggagaagaaaagagaaaaaagaaaaagattctggaaaccattaataacctaaagctcttccaatgtacaccacccatttcttctcctacccataaagagtggcaacggggaagagagggagggtagggagggggttcctgcagctgagcagcagtttcacaaggtatctcttccagcctagctgaggatgcctgctatgaaggactctgcttaacctttcttttccaagcaataagctttactacttggggaggattctttgaaatcacaactagttcaaattgtaaaatccctttggaaaataatttgtcaatcaaggtatcagggtccttcatatgttcttatcttgtgaccctgtatttctcctaccacactatatacaaaacaaaaaaaaaattatgcatgaagctttttgtagctaaaagtttgacaagcctgggcagcaaagtgagaccccttctctacaataaatttaaaaattaaccaggcatggtgtgcacctgtagtcccagctacttgggaggctgaggcaggagaatcacttgagcccaggagttgaaggctacagtgagctgtaattgtgccactgcactccacctgggtgatagagcaagattgtatctcaaaaaacaaacaggttgggcatagtggctcaagactgtaatcccagcactttgggaggccaaggtgggtgatcagctgaggtcaggagctcaagaccagcctggccaacatgacgaaaccccatctctactaaaaatacaaaaattagccgggcatggtgacgtgtgcctgtagttccagctacttgggaggctgaggcaggagaactgcttgaacccgagaggcgaaggttgcagtgagccaagatcatgccactgcactccagcatgggccacaaagcaagagtccatctcaaaaaaaaaaaaaaaaaaagaaaaaacaaacaaaagaatgctatttttgaggatgttataatagctaaataaagaaaagcaggatgtaaaacaaaaacaacgcataaggaaaaagactggagaaaatataaatttccctgaacattagaaaaattattatttttccttctatttttttgtattttataaatgttctagaataagcacataacacttttcaagtgggaaattcaatagaaaaaaaacacaaaccttacaaggcacagttctggtcaagcaataattaaatgactagaagggtcctcctgcgtcgtcttactctgggccatcgtgaagacctaagttatcacataggcaaactgcaaatgtgaaggaggattgtattagttatctattactgcctaacaaattaccccaacatttagcagtttaaatcagcatttattgtctcactggtggctctggcccagagtctttcaggaggttgcagtcaagacttagactggggctgccattatctgaaggtttgactggggctggaggactcgcttcataatggcttgttcacatggctgtgggcagatgcagccacaattccttgccatgtggactggtatctctctataaatcagataatctttctttgacaaacattatttcataccctcttatctccattctaaatgatcttcaacaggtagtgtctcctaaccttttacttagttctctctaccacccagcctagccagtatgttaatgagttagcatctgtaaagcacaaataaagagctactatttagaggagtcctttgtaaatcagataattattttgtattatgaataattacaaattacaccctaatttatctgtatagtaaattaaggtttttgcatgggagattccttaagaggcttcagtatgagcaagttctgagggatcttggaggttcctttgtcttgttttgacttaagaatctttttttagagtaatcttgagcactcctgaaagaagctaactatggtatagaaaaggataaccaccacgtagctgaaggctaagattcaggtccgaactctcgaactaactagctgtaacaagctgtgtaaccctgagtaagttactctgcctctctgggcctatggcttcatccataaaaacagaggcgatgggctagaatcactagtcccttccaagtctaataatctgtctttctaaatggaattacctggtcccaataggaatggtctcatcttaaactaggttgagctatatgtttctgctggtctttcacattggtaattttcataaacagcgcaaacaattatgacacaccctgcggcagtctctaattacagtgttcttcctttcagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaatctggaaatttttccaaggttatttgaagtttacaaaaatgtgaagcataatcataagcttcaaagattcacagtttcattgtgctcaatgctcttgtgaaatgacagtcttaagctctgattctgtatcaaggaactaagtgaatcttctggaaatgaaaaggaacaacatatgtgtaagtgcagtagatgtaccaccagcgagaaaatagaggtcagagatctacaacgtgtggcatccattagaaatcacctttcctacattgaaaagaaaaaagagaaaaagcagaattttacactaatgttgcttgatgcaaagcacattaatgcttggaaggatacattcattttcgacttttcattcactcagaaaacttctagtaagtatctgcaacctgctaggcactgttccagaatctacacatttctactcacataaagagaatcctcataaagttaggat

SEQ ID NO: 13921 - DNA, 24922 bp, Human
gaatgctgaattctatcaaaaacttcttacacatcttttgatatgattttctttaatcttttaatattgttaattatatcaattacattaacctgtcttctaatattaaattgaccttgaagcctacccaattggtcataatacacaatactcttagaactcagaatccaaatgagcaggaaataatacattctttagagccaagtatgtaccataacttaccaattatattcttatctacacacaatgagcaataaatgaacatgtatcagtatctgaccacttgtgtcattttgagtgggtcttttatttacctccatcagtaatgcaacaatctatttaatcagtaaacagtcatgctgagtattcactaaatgccattcacttttctggcactagagtacaaatgacaaagccataaccattgccattaaggagttcataaatgtgtgagtggtgcgtatgtgtgagacaaaagggagaggatggcacaaaggaggagtcgaacaagataaaatgaaaaacatatatagtaagtgctttaccgtaagtgaatgaacgagagtactaaggaaaaagaatggagacgtatttcaagttctcacgttgtttgactcgaatcttgtagacggtgtttgctgcaaaaagatgaagaaaacattcacagacatttatgttgattacatatttattgctatgtgcccagacgttttgaccttggggataaagtagcaaagaaaacacaaaaatctctgttgtattgggtttacattctatcaataaagatacaacttgcccagagaaaagccctctcctggttaggaaacagtatcaacaattaacagctctggtggtttcacagagccacagtgggctgcctgctgcagacaatatcagagtttgtttatatttaaatattattttaatatttctatttttgtccatgtattataatgcacatctatgtaatttgcaaatcatcactcatatatacatcatatcaaaaggtgtaaaagtttttgatagaattcagcattcattcgcttataaaatgagtgaaggctcactttacggatgagagtatttcatcaaaaaaattggggatctacgactctagagttctccgaagtccaccaaggaaaaagtaacttgaatttaatcgcatttaaaactatatagtatccactcctaaaacattagcaacataggaaaacttacacagcggaagaaatgactggggattttttttttttttttaatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacgtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaaggtgagcaaggccgcaatcctggtcctcgacggctgggactgggctgaaagggatcgggacccgcacgctccagtgccgaagcggtggtgtggtgaggggggagggggcgatattaacatctgagatgagagccaacactggtccggtggagaaaggagtgtgttagggaatccgcagctggagccgagaggacgcttttgtagaaactattacctccaactaagacctctctccttattttatttttattgctatttttgaaggagctggtcagcatttgcctagactctcgggacaacacggtaaatagctttcaaggatttggggaaaggagaaattaggccaggccgtgcaataccttacaaagacgttcgctcttgtctcactggatattcctttgtggtattagcctcatttttcaaatgggaaactgagattcaggctaagatgtctgtccaaaataagactaaaatctagattgttttgacgcagatcagtattcccagcgaattacagatgcttttcagagagaatgatctgttcagctcttcagttaatttattactgcacattccttagtgccttcagtgggtggtggtagttaaatagctgaaacaatttttccactttgtcattgaacatcattgtatatttacatttgaatcttagactttaagtaatctgaacttataaattacatgttttaaaaaatattttctagatggtaaacctatgctacgccagggagatacaggagactggattggaacatttttgggtcataaaggtgctgtttggggtgcaacactgaataaggatgccaccaaagcagctacagcagctgcagatttcacagcgtaagtgtagccaagatggctaactttggtgttctctgtagcttgtgtcctgaaataatcaaaaacttcagtgtcagatattcataaaattctgactcactggctgccatacagaacgcatgtttgatcccaccaaaattccatcgtggtccatcgtggtcctgtgtgcttctttgtcttcagtggttctcaaaattttcagaggcctaaatgacttattccgtatattttgattgagactcaggaatctgcattaacaaacgcaccagataatgaatgttgatctcctttacgaatgctgctctgtgtgtactccttagtgatatcctacattgatggccctaggtttttatttcaatcccggtttttgttaactggctttaggcatcattaaaactcattgtgtcaaaaacaaacaaacaaaaaaacaacaaaaaaacaaaactcagctgctcgtcatttcctaagtttttaaaggttgaaatctaaagcattcttgattttcccttatatctagattatcatcatcttttttgattctgccagcgggatgtctcctgactccaatgttccttcatgtagtaactgtggctgccttagttcaggatcatttttaactttcagtagtttcttttcctcctattcattttccatattgttgccagttgtcttcctaaaaacatacttgatcatgtcacttctctactaatgatcttcctgtcttccctttgccattttagtagttcatgacctttgatgtacattagaatatctggagagcttttcaaatattcaaatggtatgagtcccagaaattcggatttttaaaacttttttttttttttacttttttactatatatttatattttatactttttactacatttaaaaatattttttaatactttttactatacagacagtatctagctatgttgtccaggctgtcttaaactcttggcctccatgcctcagcctctcaaagagctggggttacgggggtgaactactgtgcctggtacagaaattctggtttgattggtctggggatggagtactggtcatactgattattggtgtttttttatttttctttcttccttttctttcctgatgtgcagtcatagaattgctgacctaaaggacacatttcaattgttggccctttacagtttgcttcatcctagttcatcagcatcatcctctgccattgcacaccataaacctacaatctaattatactaatcttattgttgccagaatataccttacctgttctgacttttggcggttaattatgttattaaactgacttgcagtggccctcgttgcctttttgggaatgtatcatattttataaatcttgttatctccagttcctacttggtatttgtaacttaggaatttgacacttcattgtttaaactgatgaaggcaatatcaagaactgttgtgcatacacagatttattagacttaagaggctagagagtacaagtggtgtttttttttttttttttttttttttaaagacagagtcttgctatgtccccaaggctggagtgcggtggcacagtctcggctcactgcaacctccacctcccgggttcaagtgattctcccacctcagcttcctgagaggctgggactacaggtgcacgccaccacgcctggctaatttttgtatatttagtagagacggggtttcgccatgttggccaggccggtctcgaactcctgacctcaagtgatctgcccgccttggcctcccaaagtgctgggattacaggtgtgagccaccgtgcctggcctttttttttttttttttttaacaacctcacactaaggagcaattgtaaatctgctgcctccttcattttaagtacattaaacataccaattttagaatgaaaaaatgaaggctgattgactgtggtggcagataagtgactgtatgctcttgtttattgaaacagtgttgtttttatgctttcttaacatttcaagtctcaatgtctgtgtttacaagtggtgtattaagagcatgaaggctggagccagatgacctgaatttgaattggtggcctcatgcactttatttaaccatttttttttctgtcatggtacctaattcataggttggttttgaatattaaataagttaatatgtttcgaatacttacaacattgcctgaagtctattacacctatgaaagtgttacatatgtaaagtaacgatgatagctaccatgtaaactatcaccacccgcacttgatcaaaatcacatattattttgaaactaatatggctaaagccttcaaactatttggcctcatataaggaagattgaatagatttaaatgtcaagaaggaagatttttgtgatttttttttccccctcctcagttaaggctttaggtgctgtgttagagtggaaaataataacaagcattggcactaggtgggcttgcattcgtgtgctaactatgctgtgtatttccagtttgatcatcataggatttttttttttttttgaaacagggtcttaggtgcctaggctagagtgcagtggcgtgatcatagctcactgcagcctctatctcccagtctcaagcagttctccaacctcagcctcctgaatagtgaccacaggcgtgtactaccatgcttggctaatctttgtgttttttgtagagatgggcttcaccatgttgtccaggttggtcttgaactcttgggctcaagcgatctgcccaccatggcaggatgtttcttaaatgtcggctttcatatctgtaaaatgggactaagacccatgagattattggaggaacagagagatctttctccaccatatatccctgaagtccaatatgatctctgtcacatagtaggtgctcaataaatgctagttgagatttatccctcatttcctctatgtcttgtctgtggggtgtaggagcgtgttttcatgtgcgtgtttgtgtgtgtgtgtattctctccaagaagttactccccacagcctacctgattagtcatggttggtataaagcatttttagaaacaatttttttttccctccattcttacgtttcttggaaaactcatttatggtgtggtcatttagaagtggaatttggtcccgtttcttgtggagaaatttagcagaataggtctgtggactagtgtagaatgttatcttggagtaattcgggcaattgagtccagtgttgagtacagtgtccctaaaacaccatctctttgtatctatttgggaagagtgccaaagtaaagacaattctgtgctgtgctcccaagagggcttaagtagatctgggattgggtccaggaatttataggtaatcacaatgtatcactctttctttcttgtaaagccaatagaaatatctaattttagttttaataaggttcttgataaatcgaaaatggtattatctcctagatgacttggtcaacatgttaaggtatttgggcaattttttaaaaatcttaaactggcctgttttgttgaaggtttaaataagtaagttaagcagctcctattatgagacttacggtaagttcattctgaggatatggaaagtatcaggcagcattattatttgcaagaaactggggtataagaggtaacagtagtttaaggagatgacaagtacttcgtgggatgtgaagaaaatgttggagggttagctgctgaaagggtattgttaatagcgctttactgtcttgatttgagccctgtggccaactaatatatgtcaatttcttgcctggagattgaataatacattaggaaacatttagattagatccattttagggctcttactgtgaataatggaaatctgccagagttagtacatgccctgtcagaaaatgtcatgcctctattttagtactgtttctaaataggaggaaaaactacagacacattacctctctggttaatattactactttggtcactccaactctcttctcacctttgaatagacacagtctaagcagaatcttaagattttagagctgccatgttggcgttagcctgtagctacttaggaggctgaggtggaaggatcttgaggccaggagttcaagtatagcttgggcaatataccaagatcctgtctcaaaaaaaaaaagagagagaggttttaagtttatgggagattatttaataaacttgaaattagcgtatcaaaggacattgcccgggtttctttggagacttgtgaataattagaatagtaattttagatacatttgttgttttcttcacttttgatgctttctgtcattctaatacttgtgaacccttaccacaaccatgaaatgcatttcactgtgattaaggatatatgtaaacaaaaaacaaagcaaatttaagcaccgtaataagtggagttctgtgggagaacagaaaggaatggttaattattggagttgaggataaatagtttcaaagaaaagatagcatttgaaatgagccctaagggtgagtagaactttaatagctaagaatgtaaaatacagacttaagagaataatataaacaagaacataggagcctggaagaaaatacgtaagttatttgaggagtggtttataatctagtgttgctagattcagagaaacaatacaaaatgaggttgggaaagtagattggggccagagagttgcattggaatgacagagagaggagcaagtttcctgggcaaagagaaatgaatactagggagtttagcagcaaggctacttatagttgacattatttctttcagaacatatttattcagccactcacatgacccacattattaaatattgcaagctttggtagtgtatcatgagcattcctgttagatggtctttcatattcattaaccacattgcacatgctattaatgcttatctagaatagccttcccttctttttcccctgatatatttctctttgcttcttccgacggctagctctgttacttacattttctggacaatatctaggtgcttttttctgagtttttatagccatatatatgtcttttaattatatttcttaaatgtgatatttaatgcatgtttttctcctcagctaaagctctactatggcaagaacctactgtggggtattttttgtctcccatttgtgccttagcactaagtatagaatgatatatatttaatatattttattatgtattggggtaagcaaaagaaaagatacatcttgcttttctctgatttttttccctctaccattttattgcccactgtgttcctgaaaataaatagcagttgcattaaaatggaaatctctatggaacatagctttttcactcttagcaattcttttccctgtctgcaaagttttcttgtttatttttcactgacctgttctgatctaaaatcaacttttttttcccccttccttaagcttttttatttgggggaacccttttagagtaattttgtaaagtattgctcaactattacccgcccagaatatacatacacatataaatgtatgtatacctataaccaacttgtattttggggtggggtgggacagaaaaaacaatgtaaagattaaaatagtcagtgttagcattatataatcaaaggctgatagtttgggggaagttaactgtactagagtttgaaattttaagtcagctttgaagaagagatgaagtggacattgtctctccactatcttaatttaaaattttacttagcctgtaccaaggcttttcattcccttgtaacatttttaaggatttctggtttttttatttatttttattttttattgtgcatctgagtggagaatagagaaaaaattggcatggtgaaactaaaaattggttaaaatgtatgacaggcttgctaaagggatattatggctgtcagctaaaataaaagtaaggaggatgggttggttcatgaatcttacttgcttaaattgttcatatcttttccactgtcaaagaaaattagattggttataaagtttttacagagaaatttcttttcccttaagcttatttaaatattttatcaaatgaagtctgtgagggatattagagataaaggagatttataatacatttatgtaacatttcacatatctaacttatttggtactcatcaatattataattgtatttatccttttaatatattgggtaatatttatcctactaattttctcttttttacttttagcaaagtgtgggatgctgtctcaggagatgaattgatgaccctggctcataaacacattgtcaagactgtggatttcacgcaggtatcagaaaatggaatttattttagcgagttaagttgctggtacatagtgtgataatgcttttatacttgattggtgtgtatatttgattgatatgttttgtgtggaatatttgttatttcttggttcatatttgatttgattgtgtattaagctctatgaatttgtttcatagttaatcctgtcaagcttttaagatactgtggaacgagtaccagtccttcaacatgtaaaaaacatctgaaaagctcaagtagccttccccaactactaatagaagggagaagataaatttgagataatcagaaaagggcctctcacaagggagaggagtaggatcaggggagaatgggagagttcatgtatatgtagtgtagtgtaacgcttttgaagtggaaagcttacaagtcttggcagttatgagaggtcagctgttccacagtatcttctcagaagtaattggttatgtcttggcatctctttgtgatgtctgtgagctagattttgattttatttggtgttgaaatttgaaagagaaataactattaaaatggttaatctattcacattttactttgtgttttcaggatagtaattatttgttaaccgggggacaggataaactgttacgcatatatgacttgaacaaacctgaagcaggtaagcataatttaaacatcagcttctagttttattttcttttaatttaaataactgattaaagaatttcatgctcagtactcaaatttggaaaataaagatagtcatggccgggcacggtggctcatacctgtaatcctagcactttgggagactgaggcgggtggatcacttgaggtcaggagttcgagaccagcctggccaacatggcaaaaccccgtctctattaaaaatagaaaaattagccaggcatggtggcaggcgcttgtaatcccagctacttgggaggctgaggcaggagaatcgcttgaacccgggaggtggaggttgcagtgagccgagattgcgccactgcactccagcctgggcaataagagtgaaactcagtttcaaaaaaaaaaaaatagtcaacaaagaagaaaattaaaacgtaattcatcagtttttggtttataaactttcagtctttttttctgcacagtttttaaaaaataagtttatttgctatgttgctattgtataaccttcttccaaactgaaaatttattatggcaaatttttatcattaagttttaaaacagtgcagaacagtgttactattttttggtaagaaagattggttatttatagaagttggtgatggtgagaattctcagttgtgtgcacatattgcttagatttttgaaccatgtaaatatattagctattcgaaagaattttaaaaaatctgcagttacagttttttcatttcactaaatagtctatgaactgtttgtaatgactttctggttttccatcctgtggttatatcataagtgaattaactagtttcctgttttggcccgtttgggctacttacagattttaaatatgaaaagcagtattatgctaaacatccttacagttgcaaatattttcacaatgatttccttaagataactaagcaaaagtagaattggtgggacaaagaggagtggaattgttggaaggtggccgggcgcagtggctcacgcctgtaatcccagtgctttgggaggccaaggtgagtggatcacctgaggtcaggagttcaataccagcctggccaacatggtgaaaccccatctctactaaaagtacaaaaaaattagctgggcatggtggcaggcgcctgtaattcccaggtactcaggagggtgaggcaggagaatcgcttgaacccgggaggtagaggttgcagtgagccgagattgcataccagcctgggggacaagagcaaaactccttctcaaaaagaaaaaaaaaaaatgaattgttggaagccattgatagatactaccaaagtgtcttccaacaaagtatgggtatatatgtatgtatctatacccaacatgttctagtgagcactgataactaactttctctttgtcaatttaagaaaataattctgttgtattaatgtgaatattcatgagattaaaatgctattgaataccattttaatatattcccttttttatggaataattgcctgtctaccttttgtccatttatctgttgtgttattcatgtttttcttactggtttttaaaggttctttattgaattctaatttatcatttgcttttaaattttgttaaggtggttttatggtatatatgtttttaacattttggtggtgaaattctttatgcattctctcattttacagaagttataggtgtcttccccagtctacatgtttattttataatattttaataatttccctcaccatatatatacttagctaccaaaacatgacaaacataattttgttttattatatatttggtatctttcagattttattatgtggacatttatgtagtcataaatctataaaattttaaagagtaataagagagtcagaaccacattggaaattaagcggttattctcttgagataccttccatttctgagaactttttaaaatattttacattttaatgttacagtaatttgttatgaaaacatttttaaggtgaggaaacaaagcgcatttgcagatttttttattctccattgcatgtagaagtttttttctcctttcttttttgataaatctatgccaaaacatagcaaaggactctgacctcacttcttctatgaacccattcaacaaagcaaggtagttcagggattgggtcaaagcaaggtagttcagggattgggttgacatttttcatgctctttacctttcccaaagctgttttatgaaagttgctctttcgctgtgctggcagcagaaaataaaatgaggttttactgtgtatcgggtatctgttaagccctattcgcatttgtaaccattgttatctcattttacagatgaggaaataaagttaaaaagttaagtaacatgcccaaaggtgaaaatagtgttgaatggcattgcctccagtgtctgcttttgcccctagagacagcagtgagggttttttgaagttcttcgaaaggataatctcctacagatttaagctcccttcctttttttttatgttttcctcacagtgtagaaacattcttgggaattgctgtcccactttctatttcccttttttccttccaacccttatttctcattatttactatcaatagctgcttggataaacgtcccagagttagccatagtactgcaatcagattcaactgttttgttcctgagtccgtgttcttattaaattatgccacgttaattattttattaataatataataaatactttttattatatataaaatactttttatttattatacatataataaatatatactttttattatatataaaattctttttattatacatataataaatatatactttttatttattatacaataatgcttttatatttattatacttatacaattatacaataatgcttttatattatacaataatatttgtattattgtacaaataaatattgtatattatacaataatgcttttatatttattatacttatacaattatacaataatgcttttatatttattatacatataataaatataaaatactttttatttattatacaataatgcttttgaatattatcagttgtgcagaaatttagcctagagggagtgagtggtgcattcactcagctacatatagcaagcatggtagttccttgggtccctgtcatgcagataaatttatgttccaatatagaaaaactaactgtattctatataaacatcaagtttgaattgggctgggctttgaaaagttgcagtctaatttaaaatgtgtgtttttaaaaatatataattgttccgatattgttcagtttaaaaaatcatatattaacaaatgtactttaaattgttttatctcaagaacctaaggaaattagtggtcatacttctggtataaaaaaagctctgtggtgcagtgaggataaacagattctttctgctgatgacaaaactgttcggtaagtaatttttctttaataatttacaatttaaggccgggcatggtggctcacgcctataatctcagcactttgggaggcgagccgggtggatcattagaggtcaggagtactagaccagcctggccgacatggcgaaatactgtctctatgaaaattacaaaacttagccaagcgcggtggcacacacctataatcccagctactcgggaggccgaggcaggagaatcacttgaacctgcgaggcagaggttgcggtgagtcgagatcgtgccattgcactctagcctgggcgacagagctagactgtctcaaaagaaaaacaaacttaaaatttgcaaaatattttaccttagagcttatattttaaatacatttaatattatgtgtgaaaaatgttctgaacattaaaatttaagttgcacccaggtcacatttatctggagctatctatttactaatacaggttgagtatccctaacctgaaaatctgaaatttgaaacgctctgaaatctgagactttgagtgccgacttgatgcttaaaggaaatgctcattggagcattttgaatttcctattttcaggttaggaattctcagttggtaagtgtctaatgcaaatattccaaaatccgaaaaagtttgaaatccaacttttttctggtcccaagtattttcaattaagggatgctcaccttgtgtatacagacagcaaaattcagaagaaaattaaattgctgataccttataagcaggtgtttttaacctgggtctgtgggcagaatggttaaagggagggaccatgaagcctctgaaattctatacaaaatcttgtgtgctgacacctgatgtatatttctttggaaagatgtgtagctattactagattcacaaaaacagagtgtaagaaccactatttatagcaatgctgaaattgactagattagaacttgtcttaataatgtagttttgccaaattgggaagtgtatgtaggtattaaagttgattttacttacaagctatcatgcataatttgacattgtatatagaaacccagaattttttttaatcatctgtaatttgtgacttggaatgaatgttgtttttctgtaattgtgattgttctttcgttggctaatctgcagatgtaattagaatttataaacttttttcttacatgagtaaacatcatatttttatctttattttgcagactttgggatcatgctactatgacagaagtgaaatctctaaattttaatatgtctgttagtagtatggaatatattcctgagggagagattttggttataacttatggacgatctattgcttttcatagtgcagtaaggtatgtccaagaaatactttcattttcttttttaggtaacaaaagacattttggctacttaaaaatgggaaggtatttactttttttaaaagtaaagaggccaggagtggtggcttatgcctataatcgcagtaccttgggaagctgaggtgggaggatggcttgagatcagcctgggcaacacagtgagacccccatctctacaaaaaataaaattagctgggtgtggtggcacacgcctgtagtccagctgcttgggaggctgaggtgagtattctattgctggagcctgggaggttgaggctgcattttgctgtgatcttgacactgcactccagtctggatgacaaagcaaaacctcctctgaaaaaaaaaaaaaaaaaaaagcaaaaactactgaaatggtgctgtcattaatgttttttactatataaaaccagtgtgggctgggcgtggtggctcacgtctgtaatcctagcaccttgggaggctgaggtgggcggaccacttgaggttaggggattgagaccagcctggccaacatggtgaaaccccgtctctaaaataaaaatacaaagagaagaaaaattagctgggtgtggtggtgagtacctgtaatcccagctacttgggaggctgaggcaggagaattgcttaatcccaggaggtggaggttgttttgagctgtggtcacaccactgcattccagcctgggtaacagagtgagactctgtctcaaaaaaaacaaaaaacaaaaaaacagtgtgatcttgattctactatttattttcaccttaaagttttagagaaggaataatcttatttctgttcctgagtatttgcagacttaatgaattttttaaacagatttgaattttgcgactttaaatgtagtaaatactcttggagaaagactggaatatataacataattgaaaaaaatgtacccacaatattatacccataggtgcaagagtgataatggtagttatattttctgctagtccatttttctatgttatatatgtgggtgtacagtatttgtgtttttttttttaattactaggaccataatgaataccattttgatttgtttaaaaatattgttagccatttaaaacttctttgaaaacatttttacttgatacactgtatttgcatcataggttgtactaaattatgggttagtttccctgttttagcaccacggtgaatgttctagcacatctctgagtgtttctttacagtagataggatcctgtaagtagaattatcagttcaaaggctagaaatgagtttaaagttcttagttatacatgacacttaattgatttccataaggattataccacattacactttgatatttgaccagtgtcttaaccttgtgtctaaagggctaactgggagaaagaaaaggcggtaaaattggaggagagcaattaagcaatgtcaaggagtttatacacatacagtaaactgatagtagtagaatactatggcctggagccatcaattggtttattaatgctcttcactcactcctgcagttaggcaaatcccatgttggtggcagaaattttctggaccattgaatattctagcatttgagccagcaagttgctatgtagtgatcctgcataagtcatgactaactttaattaacatgctttaaagtatatgatgatgggaagtatttaggagctgggatactataatgttttgtattggaggcctttcatgatttttagggttaaactgaaaaagctaatgtccaaactgtaattgaatttcagatgaagctgttattatgcattgatttttattatataactatagccccaaattttgttagtcttttactgccttatagtagaaactgttttcagcagtttatattttatgacatagaaagtttatcttgctgaggagcttaaaccttcagcaattaataataatatataaataatcctttatgttaattacctactgtgaaaactttttctgtttacaaagataatatgtggttgtagaaaaatgaaacaatacaggtgaagtttatttaagagcaaaaatcccagtgtattattcatactgttttaattagccaacacactcatttccgggaagacatccactgcataaactggatatccctccatcaagatgtctttgtattgctgagatgagctccacttgggcatagtatccatttgatttttttttttttttttttgctaacagctttttttacatcagtgtttatgtttgagtaaatgagtatttaattgttccttgggtttcagaatttaagaacagttcaaatgtaactcgttatttataccatattcaagatttgtaaatactacttaaatttattttcagtttggacccaattaaatcctttgaagctcctgcaaccatcaattctgcatctcttcatcctgagaaagaatttcttgttgcaggcggtgaagattttaaactttataagtatgattataatagtggagaagaattaggtgagttgtccccttacagtgatgtggttacctttatcatatgttaagtcccagtaattaacacctcatttatatatatatatatgttacatatatatgttgaaagtaaatttttcagctaacttaagcttggtgcttacaagtgaaaaagtaaaggagttttaaccatttgggtcagatgcttttatagatctgtaaacaaagtatgcagaaatttatccttttaactaaagttcatcattatgctgatgttatgtattatggtacagtgagttttaggctttattggctgggagggaggggggaatcttatgtcaaagtcatatgctaaacacatgcaaggagatccgttctttctgaactatgttgtgggtgtataaccccatctacttggcccgtcttcctttttgccaacttaggaattcctaagactccgtaaagaacagtgtgtgggggaaaaatcagtatagcatattacagggatacctttaggaatctgaattggatagttatttttatcagctttttatttattctattttggagtttgagttttgctttcattttcatgataacagtccttagtaagggaaagggaaaggcatggggattaatttgaagttaatgtatatttatctgatggaccaggtatttcacatagttacatgtggttctcagtatctacttttagcctttccaaatagtttttgcttttaggtcaaaaatatgtttagtttttataaatatatatttttatctataagctgtctcttcttgttcttgtctgtttctagctgccctgctttaccaaagaacgaagcttgctagattacacccaaagaacaaaagacaattttacgttttgtttcttggggaacattgatgcatctgggttgcacaaatggaaccttggtgatggaccatgtagaatctattttaattgcttatggttcagtttttattacttgaatacaagtgatttataaataagatattcttttctgttacttttatttaatgctagttttcaaagttttagaatgtttttggtttcatattttattctttttcaagattgagagaactgaattatttgcccaagatctgaagtcacagtgaataccagatctgcctagcctttctctttccaaaaccttgtgttctttgtactcttacaacttttctattctctggtgggacacagatgggagacagaataggaacattggtctagtaaagggctttgagaactaataaggtgatgaggcattagaaagtaaatgagaaaggttcatacttaaaggtactacttgaatataacagtgctcctaatctatacattttctcattaggttccatggattaaaatatttatggatcattgttgatctatatctcacctttctgtgtgacagaataattagtggactgtaggaaattaagaggcaaagtgtgtaaaagagctccacctggtggctctctatagtcataataaaaattgattccctgagaaataggcagtgagttttaggatatggaaattggaggttgaactggtaagactttaaatctactttctatagaattaatggggttttcatttacctctttttctccatccttaatgagacatgaagcctcatttgctttttttagagggacagtttgaaactagaatgtgtgctagatttggaaaggaataatcttacagagaaagggtcaatgatataccacttttgtgatgagaaattaattaagtacaggttttaatgtttgccttaagaatttttcatctccccagtaacacagacagtattttttttttttagcatatcaatatttaacctaatagttaaaattatctaatagccctcttctttttcagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctggtaagaatttttattcagaataataaaatttttaaaatgcatgattttatgtcatttttaatcattaattttatttcagggttcctgttttctataaattttaaattatatattatggtttaagcagcgagaagcccaggattataaattggccagagaaagggtcatgttcctttgtttaaattttttttggtatggctgggcacggtggctcacgcctgtaatcccagcactttgggaggctgaggcgggcggatcacaaggtcaggagttcgagaccagcctggccaacatggtgaaaccccatctctactaaaaatacaaaaattagccaggtgtggtggtacatgcctgtaatcccagctactcaggaggctgaggcacgagaattgcatgaacccaggagccatgcattgagctgagatcacgccactgcactccagcctgggcaagagtgactcagtctcaaaaaaaaaaaaaagaaaaatttgttgtacaatctagtctgttcctaaatttttatactagcacattttgtggctggaatagatctaattcaaaatttgctggaaggcaatataaagaatttacaagtaaatgtatctaatctctgaatagtattactcactgatccacaccaataaagatagacatgttcttaataaaaaatacctagttactaatccctaagtagttgcagtatgaacctaaaagtaattttaaagaaagacatactatttttagaatcacagttatttaaaaaggagttgtttttattatattttgtagccattttcctggaatagtcttatgttgctcttcttgcttattgaacactggaaattactttaatagtgtaagtcatataatcgtcattgcttttctttttacagaagaagatagtggtgagctggcaaagccaaagattggttttccagagacaacagaagaggagctaggtaaatgctatggaattgacttttgtaagagtcttgggggatttaaaattgaactgtaacagaagttttactcattggcagaagaaatttattaaatatgaacatatttaaataatggaaactttaaatatttatgcatgtatatatacatatttataagctaaatatttaaatacctactgcatagtagtaataggcacagagatgtagtatggacacaaccgatgtggttactctttcagagctagagtctaacttaggagacatgccaaaacacaaattattgtaagggggattaaaaaaagcttcctagagaagtgacatttaaactgggaactaaggatgagcagaaatgatttaggtgaggtcatgagagggggtgttggtagggacaggatggaaaagttcatagcaggaaaactatgttaactaaaagttcagaaccaaaaaggagcatagcatatgaggaactaaaagaacttctccatgcctccaggttaaagagcaaaggcaaagtgaagctggagaagctagatcatctgagggcctcatttgctgtattaggacttggagagttttatactaagagcaatgagaaacctttgaattttaagaagaggactttaaaagattgccttggtagttcaagaccaacctggccaacatggtgaaaccctgtctctactaaaaatacaaaaattagccggtcatggtggcagatacctgtaatcccagctatttaggaggctgaagcaggagagtagcttgaacccaggaggtagaggttgcagcgagccgagattgcgccactgcactccagcttgggtgtcagagagagactctgtctcaaaaaaaaaaaaaaaaaaaggttgccttggctgttgcacgtacaaagaattggactgggaacaagagtgaacataaaccagttagggggcattgtagtctagatgagtgatcatgtaggttttgttttgttttgagatggagtcttgctctgttgcccaggctggagtgcagtggcatgatctcgactcactgcagcctccgcctctggtttcaagcaattctcctgcgtaagcctcctgggtagttgggattacaggtgcaccaccacgcctggctaatttttgtatttttagtagagatggggtttcaccatgttgatcaggctggtcttgaactcctgacctcatgatctgcccacctcggcctcccaaagtgctgggattacaggcgtgagccactgcacccggcctatcatgtagtttttaataagggtattgcaatgagaacagaaaaaggtagatggagttgagagtcttttgttagacttgttagaattgtgagattgatgagtgggggtatcatgaggaagaaatatgcagattgctgccatgagaaactgggtatgatgattttgggggaggttgggaaggtgtttaccatttacccaatagagttttccttaaattttttattgttaagcaccttcttgctaaaacaatgttgatggttaatgttttgctttaaatagcactaaatattaggatttgaatcactaaaagagagggccagatccttcgaagacatgactttaattccgggtttgttatatagctggagtctttgaaaatttaggccagaaagggacccttggaggttgagttatggtgtaagagaatctagtggataaaacacatgaactctttcttctttgccttttcaatgacatgagtctagttgttagtggcatgtgcagttgctctcttctttcccttaccacagtatgctttacaaacactttttcattccttcattacacagaaatgtagatttgcttctttctttcattaagttgactaatgtgactttttttttttttttttttttttacttatagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaacaatgtttggtttttttggggaaaaactactaatgtgagttttataagtggaaatagccagaaggtttttctgtatcataaccatagcaaaaggtaagccaattaatctgtagtaaacattattttataatattgagattcagttacttgtcctgaatttttgaaattcttatgtcctttactagtgtttcatttaccttctctattcccagattggatagaagtgcttgacatgcctttttaaacaattatttaaataatacatgctagttataagaaaaaaaaaatcaactgaaatttagcagtaagctgaaagatcacttaaaatcctaccactcctcaaaaaactattaaaatcaaatgaccatgaatgcatgttagggcatctctgtatgtatatacagatagatagaatggattttataaaaatgggattactatagtcctgcagtggtttaagaagtatggaattttacctcattctttaaatttgggtggcattcagaaagcccttctaaaaccttctaataaattggatcagctgagtttagacttgtaatttattttttaaaacaaagagggcatattaaatgagtaatttggaaatacttcagatgaataaataacatctctgcaacttcctttttctcctgatcagtcctgtgagtgacccttgataacttttcttaaaagcaatatgagtcaaccaaagaataagattaatttttgaggatttgtgataaccagaagaaagcactgtaggctgtgacaacctgtgagggccgagagaaatacaggggagccaactggtgatccatattggctttcatagagtggtagtatttttgtgtcagcttgttacatgcctgaacctctggattgcagcagtgttgtcattgtaccagcagttgctcagactctaatcagagtctgatttaccctcaataaagttctgtacgcatcagattggaatcatgaagttgcttgttatttatgaaccaagggaatttctccttaggtttcataaaagtctaatgaccctgtacaggtacagtcctttgtgtattggtttcctgctgctgctgtaacaagtgaccacaaatgtgtaccttaagacaacacaaatttattatcttacggttagggaggtcagaagtccacagtaggtcttgctgggcttaaattaaggtgtcagcagagctgcaagccttctagaggctctacaggacaatctgttcccttgccttttctagcttctagaagccagctgcattccctggctcatggttccttcctctttctttacgtccagcagtgtccgttttttaatctcttattctgaatgtgactctatctcctgctgccttcttttatttataaggaggtttgtaattatatcgggctcacctgaataatccaggataatctttccaattcaagatcttcaatttaatcacatctgcaaaagtcccttttgccatataggatgacatattcacaggttctggggattgggaagtagacatctttgtgggggccattagttattagtctgcttaccacacttggtaatggtagaatcctacagtagaatttaacaaaactttcaagagtagtggtcacttttctgttctcatcttaactaaaccttcagcagcattcaataatcatccacttcctggtttttgatttttttttttagcttctatgaaactacactcctgggtctttttttttttttttttgagatggagtctcgctctgtcacccaggctggagtgcaatggtgcgatctcagcttactgcaacctctgcctcccaggttcaagcgattctcctgcctcagcctcctgagtagctgggactacaggcatacaccaccacgcccagctaatttttgtatttttagtagagacggggttttgccatgttggccaggatggtcttgatctcctgacctcgtgatccacccgcctcggcttcccgaagtgctgggattacaga

SEQ ID NO: 13922 - DNA, 278866 bp, Human
  misc_feature (1)...(278866): n = A,T,C or G
tgagggacctgaagagagcatgtgatgggaatgtgaaaacaaaagaagcttctaaaagaagacaccaaggataatattctcacaaaaattcagaccatcattctatattttcatgcatatgaattttggtacatatttcatgcatatgaaatttggtacatatatacatatatgtaccatgcatatacatatgcgtacatatacatatacgtatgcatacacatatgtatctatgtacacacatacacatatgtgtacacacatatgtacatgcacacacatatgtgtacacatatgtacatgcacacacatgtgtgtacacatatgtacatgtacacatatgtgtatatgtacacatgtgtatatatacatattcacacttatgtaaacatattcaatctaaagcttccttaagacacatacaaacaacaaccaaatgattagtgtttggccattgctcatgcagcaaaagctgagtaaacacagctctggatccttttctcaggccaccactccctagctgtgtgactgacaaagtctatgcctgaacacctacattcatgaccagggtggcctttcctgtctcctgttgcccaagcatgtctcaggtataaataagttccaatactgacagggcacagcaagggtaatttacatgacaataagaaatgatttctatctgaacagtgcataccagagttgatttcgacagacttatctttaaaaaaatacacataacaaaaaaggagacaagtagtagattggggacccacagcttgaaagtcgttgcttgtgattctaaaacatcccagtaaaattattcacagataattgtttaaaaatataactgtacataccgttgacacttggacaacacagagaatcacgtagttgaaaatccacatataactttgaactcatcaaaaccttaactactaatagcctactcttgaccggaaaccttactgataacataataaacagttgattaacacacattttgtgttgtatgtattgtatactgtattcttacaataaagtacgctagagaacagaaaatattattaagaaaaccataaagaggagaaaatacatttatattcattgagtggaagtgaattatcataaaagtctttaacgtcatccttttcaggctgagcaggcagaggaggaggaagagggtttggtcttgctgtctcaaggctggcaaaggtggaagaaaatctgcatataactggacccaacagttcaaacccgtgttgttcaagggtcatacatgtaaaatactgtgatttttcccccttctatattcagcttcaggtgacccgacacactttggtatcaaaagagaatctgaaatgtacaagaactgcggatttcaaatggaaaaggtgcataattgtgctatttgttcctgggtgagtgtgggacggagacggtgagagtgttgaaatgggatggagataatggaagcagtggggaaggagagaaaatacccttcctatcacacacactcacacactcacactacacactatttctacagtcacaactacccaactgttattgatcctttataactgcaattgagtacagatgtaggaagattgagagggaactgggatctggcgcctggattgctcaagagaggtcagggaaacccctcagaactcctgagacccagagattgagggaggggttgaggcggagtctgcaatgggggctgtccagcagtagcaagcagcgggccgatcctggtggagggttgggaggctgctgtcattttatgggtcggcagccagagtgagagtgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaaggtaggggagctcctccacccctttttcccagcggtccgggcggcagccgcgctccggcgccctcgctctgccgttgggagcggcgcgccccagggcacgatggcccagccgcgggaagcgcctgccgtgcagcctgggcgcacgctttgttgtcctcgcgtgtgcgtgttcctggtggtcttgagaggtagggggcggggggaagaataagggaagtttgctccctccggctttcgccctttgtgctcttttatcgctgctgaaatccacatcaaaggtgggcttgttggatcgtgctttctcaggcaaaatgaggtcactttcttttctggtttccactgcaccccaacgctgcttaacctttccgccctccctcgcacagaatgctttgtcttaattttccttactgctggaattatacactggagagtggagggggactgagctccctggacacaaatggactgccagggctacgttagggcagaattttctttgaataaggagtgtcaggtagagagcttggtaaggattcctctccccaactcctatcaacatctttacaattccttttaaaaagtctccagactttctccactatatttacagatgatattacccctagatttaatggtggaaaaatatataataataaactttttcgtatcttctttggaatgtgctaccctgaggttttactttgagaaaaatgaaaagcaaaggagttgcttttgaaaaatcagtttgacaactatactgtacataaatttttttgaagaaatgtcagctagatgttttcttggacggcgatgtgaagttctgaagtgattgtctatcactcatgtcttcagtggatctactttagttctgttgttagtcttttcctctctccgcaaagcaaactcaagaatgtcgacaggtgacttggagctatcctttcaggaccacagtgataccttccctagaaatggatgccaggttaatggatccaaaggttttcttattatagagtcacttcttgcttatatgcaccattaattatgaatgcctaaaaagaatataatggaacaggaccaatggattaagaacagcattacttttaaatactccatattttcatttatcttaatgaaaaatataaaaaaaattcagggagaaacagcaacagaatgcctaagtaagaccttaaaatatatttaatatgttttaacattttttcttaaattatcaataatcattaattttaaagtatggtaaataataagctcagttatatgtttttactgtaggaggttgttctttcatacacatcataaatgcattagacttattaggttgtctattagtcgttttctaactatttatcaaactgtcacaactattttacctatgcaataattgtcatgaaccaaaaattagaaaccaagtcactatgcattttacgagcaacagctaagagttatatgtatgacatctgatccaaacctaacgtttagcacaactgcaggtttttgcgtgagttcttcataatgagataattccagaaataagagaatgacttggttgggagtgggggtaaggttttgcaattaaaataaaataaatgtggccattgtttgacttaaaactcgatattggaatgagaaaatgcagttagtgatggtgtaatgaaaatgttagtgattgtcatagaggtccagcctgcttcacataataggtatattcctgaacattgcaggtaaatgtaaattatggcaaactgcttccatagtaaatacattggcaaagtttgccatttaaataataattattgtagtgggacacataattttgtaagaaaaatcattttcctttattttatgtgaatgtaatatttttgtcacctgaatataaactatatcagaggaaagaagaaaaaactgtatatattaaataccttctatgtgctggttttttaggcattttacatacgttatttcatttaatcctattttgctgcagttgacaagagttgttcaaaaaaaatggtaaattgggcacacagtgtaatatcttacatttagaggatagtatattacatggtgcgttgggcacatggtataatctctttataatttggagatatttttgaattaaaggtcctgattaagtgccagtaaaacagatctactcaagcaggttgtgactggaggatgagaaaaaattcattattaaataccaaactgctaactgtatctcaataataaaatccaaaatgttccacgtgtgccgagtcagaaatgaaacattctctcaactctcccttgccaaaataatttccatagttttcactatagttaatacatttttcactactccatatgtgtatcctttatataagagtgaaaattctgaaggaaaataagacagagaaattcaagtatgaggcttaatttacagctttacattttccacaactcaaaaataagcagctggatatcagtggtggaaaagtaggaaagtttgaatgtgtatgaatggctataatcagttccattgagggagactaaatgtgactggccaagaaggtctttgtgccatcgttccttatccatggagcagtgatgagcacatataatcgggcatctcagactgtctaaatcattcactgcacattatgaagctaatatctgcataatttatcttgcctaaacacaatgttggttatgaaaatttttatttttatatcaatattgatggtgtatataaaatagaagaaaaaatggaactctgttattatattgaaggctactaatttcaaagtcttctatggatgaatgcaagtgaggtatttatctggcgagcctcgctgttgtgtgtcttcccataattcccagtgaaagaaatgtaacttcctacacttgtcctatctttactaaagccctcctagaaaatgtcttcctgtatcagtttactcagtataagtactttgtctactaaggtgcaaatcgtggaatatgacatcataggaatttgaagttggccttccctgaaatgttgctttttagtagtcagctggaatatattcctaaactcaagtgcttggcgtgtgtccttcttttttaaccccttctctctatttctttctatttctgcttttaccagagatatcatcaaagaatatcaaatttaaaaagggtcttaatattgtactttctgaaacaggtttatatttaattctataatacatgagtgttatgatactggccattctactcttatccaggggaaatatctgttttccacggtctgtctgcctttcctttcctatgtctcccctcgcaaccccatacacacacacaaagaagtttcacttttcgtggttgaggtttcatccataaattgcacagtgttggcaggtgaaccataatcctttcattttgctggagcagcttagatcctttccatcacaatgaagtttgctgcccttaactcccatgtcatctgactcctttaataaatcatattgccaaccttttggagaaacctttttacatgtgacatccccagtaggttggcaaaggctccctgggccatgcttctacagatgatcgagtaataatccttcccactgtgaacatatgtttccttttgttctttgttttgtgagagactatcgttgtgtgaaggaatgaaaaattcacattacacctctgcctcattttggcccaaaagaaaatgcacatttatgtggataactgattaaaaacaatatgagttgtactttattttaaaatgtaacactatttctactatctaaatatccaacttaaaggtatttaaacgtataagcagatttactcctgaaccttataaatataattctaacttgaggggttgtaaaagaatgtttgatgtcagatacagttgatgcacttaagtaaaacattgtaattggtagcagtgtggcacaatagaaggcttaacaacaatgaccacaagttttcattttcccctaatttaatgcctctccgtacacagtttcagtgatgttgcattttcagaaacatatcccagtgcagtgatgagctttactgtaaagcacttaatgttttcatttaattactccaaatatgttgtaaatatttttgaaataaaggaatgtctactgtaatatttctatctttcatggtgctagtatgtggtgttaggaatttaatagaaggttaataaacagatttaaattttctgcattatataaaagctctgactgagaattatgaaatattgtaatattgacttgtgaacacatctttaaggaaaatataggaaaattatcattatgggagttaaataatcataactacaatgcactcattacattcaaatagtaaaaattttaccaatcacttatattagaatcttattaaaaccataaattaaaatatcagttatttttcccagaaatgtaatattctcagttgctcatttattcattaatgttacctcacctctgtttaatgttattaattaaaaagtagcaaatgacatactaggggaaattgatttttttaacctgtatgggtgacctacaatttcagctagtacccagatatacaggtaatatttttgcctcctcttccacatcaccactccgctatgaccacaaccaaccagaactgaccaagatttctgtgttcctagtagaaatcctcctaatgttttgtcagacatcacccttaagagatgaagtattttctacaccctggtcttggttatccctatggtagtgtttaatccaaggtcgtataacccaatttcttacagaactcttctatagtcatcttaaatacccattatatcagctctttttgctcaaataaatatgtaagttttttttgtgcgctggtgtcattgatttgaggaacccaaacaaggttaatgtggctcaagtaaagtgagcaagagtgtgaatggattgggatgagtgtgaatgggttccttctctcctggtgctgttgactccagcaggtcccatagggtttctatcagccaataagaggtggctcacgcctgtaatcccagcactttgggagcctgaagcaggtggatcacctgaggtcaggaattcgataccagcctggcaaacatggtgaaaccccgtctctactaaaaatacaaaaaacagccaggtgtggtggcaggcacctgtaatcccagttactcgggaggctgaggcaggagaatcgcttgaacccagaaggcggaggttgcagtgagcaaagatcacaccattgcactccagcctgggcgacaagagtgaaacttgtctcaaaaaaaaaaaaaaagtatatgtgaataacctccttaattaaatacctctcatgtaatctgctatcaccaattactcctaatgtttcccttttccaagcttgttctaggtcttcagaacaccaatccttagattttttttcctctgcacattgtacctttgaatttatttctatgagtaagatcatatcttagccttgtgccagaaaagcgttcgcaagtctttcagcatctaattcccgaatgaaagatttcttctttccttagacattctagttacttaaaggccagctcctttttcttctgaatattttaaaaccaccaaacaaacagaagatgtttgaaacaaggttgcggggatttcctgataaaaggtttttttctttcctttttttcaggaaattgagatgaaagggagaaaagtgatatatgcttggaaaaatatttcagaaacagagaatcagaaatggaaataggacttcaagcttgagagcggtattgcaaattatgagtatgaatggtaatttctgtaagaaaatgaatataggggaaattagagaatgaaatgaagaacatttgatgaaaacaaatacactgcaattctatttatatgcaaataaatgtattttcttatcaaatactctttatctatttggtttttcactctttataaataggaatgctgcacagttcatttttctaacaaaactatttctatcttaatgaaaatttaaactaaataaacctatttttaaatgtgatttttggtatatttactagcaaattaaaagaataggaatgcaatttatctacaagtagtggtgcaagatcagaattatattaatagtaatctatatgagatttaaatgatgaatgtttcccttttttgtgctatttcattttactgttttcagataactgagactttgttttattttcctctttctgcctactaagtttttaatatcagtgatttatataacgggtgaggaaaggcgtcatatgactctaccatgctctcaatactgttccttcattattacccgccattgaccaaattaagtgcagaggaatttctgaccctggttctctctacctttaacccgtatcagagaccaattatgagcctgctgtgctgatatgtgtcttgtgattctctcttggttccacgcataggaatttgtgattggcatgtacaaaccagatgtcagagaattcaaaagaattttcagtgccctttgtatcttcggtcctatctgaagcctgattcccacctccctatacttactttctgaatcaatattgtattttgataaactctagtattcctgcttttggatcctggcattaattataattaaccactccttgtcttttagtttccttgaaagagcatcctataaacattttttggctggccaatctttccccaatgccaaaatggaaagattgagaagctccctttcttcttcaatactgtcttttgtattccagaataaagactcactgcccaattccatttagttaatcaaacatccattaagcatctaatatgtgccaggaattttactagatattataggtacagaagtggataatactcagttgagtccctggcagtggcatattgggaacatggacacagatgatggtcattagaatatggtgttttgttttacggatgaaaatgtgggctgctagaggagagacacttaactatttagtggtttgggaaattatttattttaagatgattcctgagctgagtcctgaagcataggtacgagttaggtttaaatatatacacacaaaggcagagaaaactgcacgagcaaaggcccagtgttgtgaaaagcatggcagagtttaggaaaatgcagatatatatcaaaggcaatgaagccacaggagccagatcagggagacttctacatgctgagccagaaagaaggatctctgtattctctaggggaagaggccttatcgaagggtttaatcaaggcattagtgagataagagttgcatttcagatagagcgctttgcctgcaagaaaggctatcccaaaggtagagccagcctggaagaattaaactagtagcaggttgttgaaattatccaattaagagacgacaaacactggcattagggtgacagacagtcaaagagtggcaatgttgaaaaatagctacattggcaagactgattagatgtgggaaattggagagagcaagatgtagggtaatttcttggtaaccaaccctcttgcctggaagagtagcggtctcaagataacatgtgtgctggacagtctactctcgagatcaactgtgctggatagtctgctcttgagatcaactcacctctccactgtgcccagtgccaggaagtgtccctctatggaccatttcttcctgttcccttgccctttggttcctagtgagtttggccaatagaaggcactagccaaagattactgctagaaggagggagaaatcaaatcatttattctcctagcctccaccctggccagcccccattaggcagtggcttcattctctcttccagttctatagtcagcccctcttacaaggctgatgttctggccaaattcctgaaacagttctctgtctttatcccttgagagcaatagcttctccctgcttctagaccctaagtatgttttctccatgcttaatacattatttctgctccaaaccttgatcgctttggctagtccatcccttcatttcattctctgggattttctttttgagtgtcctgctgggaccatgactgatataagacatggtaggtttggtggtagacctttgagtttgaagcagttgaaaacaaataaataaacaaaaacaggtacttgatatgagtctgaagggtagaggagatggaaggcctggagatgtgaatgggatcccctagcagagagaaagggagtgaagggcagtgggccggaagggggtcttgagaggcaccgattgttaatttcaggcaaataaggaatttaagaagttgaaggcacagccagagaggtacagaaggaaagcaaaatcaaggaaacccaagatctaggaaatttcaagtggaggacttggcaaacagcatctaatgcaacagagaggccctataagctaaggtctggaaaatatctttatattaggaaataggtaggctattggactctctggagactgggaggtataaatgcttccgggaattgaagaataaaaaagcagccccttatctgataagagcataggtgccaggtgagatcagagagacctgaagtcaatatcaattctccactatgctatttactggcagtaggatgctgggaaagttatttcacctctctggattcccttttgttcatctcttatacatatgtcttagaattattgtcaggaataaataagaaaatgaccacaaagtactgggaacagtgcctagaatacagtgagcactcaattaatgttatgtataacaataaactaaagagaaaaatagtaaaaataggcaaagtgaagtcaaagaggtagggcaataaaaatgtgtacagagcagcatttcccaaaatgtgctccacagtacactggagaggctggcaatactcttgtattgaatgttattaaaaatgaatacctttgtggtgacatgaatttgggaaattattagtttaactttgtttaaactagtattaacttgtttttgtgtgccagaatttcttagaacttttaatatgttaacacgtattgtatcttccacaggagaaatatgatgtataacattttcaaacttgtttgattatagtatcctttttgtttctctttctttcttttttttttttttttttttgacagagtcttgttgctctgccaccaaggctggaatgcagtgacatgatctaggctcactgcaacctctgccttccaggttcaagcaattctcctgcctcagcctcccaagtggctgcgattacaggcatgcaccagcctgctcagctaattttttgtatttttagtagagacagaatttcaccatgttggccaggttggtcttgaacttctgacctcaggagaataatgaatatgctctaagaaacaatatttatgcttatatgatagatgctttgtttatctttcctttgtttaaaaaattataaatgtaaccttaaggataaagaaaacatagcagcaagatcaactgtaatttaaatctcagaatcaggagaatttgcttggaaagcaatcatcccaactttcttataaaacactgatgttcaggaaaatgcttttggaggaaaatacgtagatatcttccttactttatggactgtactaattctggcttcagtaattgtacatgtaaaatgtttctttgagttttgaatcaaaaaatgaaccatacattttaacatcattttccaatgtaattatcttaatatatagcttaacagaccaatcaactttgttcagtatatatcattgaatcataaagccatattttttcaaagaccatctagttcaaaatttaagctgatgcttagatattgtctctaatatcactgctaattaatcataaatggtgacattaccaacagctgtaaagtagccattccaccttcagacaacagttttgttgttttgttgatttggtttggtcttgagattaactacttctggttgtagcattcacatgttacttccatctctgtttgactttagtagagcactatatagtaactgctcttgctctcatgcatgttatgaataactgctttgccaacagacctgatggcttataaagataaaatgtgagaagcttgtcatctcactgttctgtcctcatcctccatcacacaactttaagctatttacaccagcctgagttttctgcctattgccatttttttcttttttatagccccaataacaaattgagtagaaaacagtttttattcttcccgagggtgttccacgatgaaccatggtaaggagttgggaatgctagtgtgagaaaaatgcatggcacatagtaagcattctatacatgcagattttatattattccaatctctgctcaagaaacatttttattcagcacttctttctgaacagcctatctaaaatcatccctatcactctaatattttaccactcttacctaagcttctttttcttcagagaatgtatcattcactaaatgacattacattgcatattttatgataacttagctcctctatgggaatatttataggtttcatgacagcaaggactttgtccattgtgttcactgttgtatcctcagctcctggaagagtgcctggcctatggtaatgtccagtgaacatttgttgaacgagtgaatgaatgagtgttgaataaataaatggagtgagggaggtcaaatggaaggtatgggacagactcgagacagaggaatagcaggatgcaggtgtgcaagcacagggagtagagaagctgcacagtgagatgagctaggagggagggtctatcaggcaggcgccactgagtcgggctggggaggcagtggcaccagggtggaggatgacctggagatgccattttgctctggtggagggaatagaggttttattaccacaggtgaaaatgagctcatttagacatcaagataatgttcctgacccttttttttctctttattttatcaggttagagtaaaccactgaggaccaaatgatgggtgcccaagtcataaataggttcccttgtgtaatgaagcaaaagcatagcttttctgatcatttattctccatcgtattcattgactgtgcctataatttacttacttataaaaagtaagtttttaaaatgtaaaactttgtttttatcttggctctacggtttgaaaatgtcaaatagaaacttaatgtgtaaatctttttttctctcaccatgcacgtcatataaccagattgtctctagacctcaaaaggcatttctggaaactcacacaactaactgaagctctgatgataaattattgtttttcttcaaaacttaaaacttttatgatttcctttacttttggaaattttattgtttatttttttaaatgcacatagatacctcacggaaattttaaaaatgactttttgaaaatgattgtcttttcctggataaaattccattacgtaacttcttatagaaacaactggtaatttttatactcagttgaaatactaggtgataaatattttattatgcaacacagacagtgagttaaacatgctgattcatgagtgctacataaagtgttagtacatatagaccaaaaacctgaattgtccagattttcaagtgactaacatacaaaatatatgcttaagacaactgctattacttaaataattcagtatttctctggtaagttgaaaggtattacataatcttgtaatgcactgatctatatccatagtctattaactgtactgaaaaagtactgaagtttgggttagctgtaatttttattctacaactttaattttgtttctgtttgttggcaaatcaatatatcatccaaagccaaaaatagaaggaaaattgtgatcaaattatttacactctcacatacatgactgaaaggagtttttgctcctgcctttataaatttatgatcaggagactcacttctggagtataaaaatagcattaataattctttaatgaattgttttccttaaaattaataatcttctttactcaatatcaaatcaaaatttctggaaacatttgaaaacacatttacacaagtctctttctgtctctggagtggctacactagaattaagctaattgtcacacatcatcctgtctctgagataagccaggaatttccaattttagtcaagttggtgatccataaaatagatatcctagtaaaattactatgagctttctacttactttgatattgtgctgataactaaagtgtaattataaaaattgaagtgttgttactgccaaataccacaaagtataagcatcacacttataataatacatattgacaccatcaccttaagaaatatcttctcatttgaatgtacttaaaattcttagatttttatctaggaaaaaaaattggcttctaaagttcgtgaatgttaagttgattaataagataaatagtaaaagaccgagggaatggtatattgtctccatgtattattaaacattgagtcatgtggtcatctcttaaaggattatagaaaaaaaaggtttttatgaaatgcattggtgtaatagccttatttacatataaacatagtgaggagatgtgcccaagtttattctgcattgccatgggggaatttcctctgcaattttccctaactaaattatactttttaattagtcttttagaactgactataggccttattcaaagtggttagatacttgagatttgtaatatggaaattgtggtattgacaaagctttgctaaaataatcacaaggacttagaactaaatactttggaattcattctaaaaacttagtttatgaggttttgttatttttttttaattagcgaaatttgctaaaactgagccacccttataatgtgtctcagattgcttccttggatttacattttatttatttgcaacaaataaaatacagttgcatctttaaaccctttttccatctctatgctattaccttggttcatttctactgctagattgatgtaacatctttcttttctgaaggatagttgagaaactaatgagaatctttccattgaaattcttgctgctacactgaggccttcaattagcctctttactatatggctgcttatggttttgaagtaaggtattcttaatttgatatctttaagcctgaatcaggtgtgcatcatcatgcacgagaattctgtaataacatacaaagaactggaaaactgacagatgttcacagcggaaaatgtataaaatacaacaggcagaaaaagaatatcatcattcctaaacactgcattccaaaatagctaccatctggagacatatctttccaaatcttttcctgtatctgtgcatttgagtgtgtatgttaaaaaaaaaaaaggtataaaacttccctactatacatgcttttttcacttaaaggtattgtgataatttttttcaagacctgaacattttcactcttctgcaatttaggacattaacccatatgtcaaggtcaattgcatgcaattcccaagtgtatttgcattgttaaagacgtagatgatcatagatacagattgtaaccatgaagtggggaaaaggaatttgttgagcaaagagattgttgtctatgtatgtgcccaccattagtgtaactactgaagaattacacacatagcaaaacttcagaggctatattggcaggcatttattttccattttttcacaactaaacactgtgcataaggaacttaagaataaaggcatgctggttaaaaaaaaagatataggattgaattctggctgtattctttactagctatggcatttggcagtgtactgatctcttcatagaagacaaatcacagtggctgcacagatcactattcctccagcagcccagtctgccatcccaccaggtcagcctacgcccagccttgctaatatcttgctaatcttggaggaaaatttcttttcctctttgatccacatagtctgaagttgggataccattctcctacttgacctcactgctctgggcagaatgaacagccaagaggtgaacacctgacctaagcccatgtggggactgcacctcgctgaccactgtctttggaattggcatgtgatctaagccagaacaatcagaacctagtcctacaattgttttcaaactggcaatggcaggggaggtgaaagaatattttcctttccagttgtggagctaaggcatgagcttggacagtgtcctcaaccataaaactgactcaagaagaaacgttttgtaggaagaaatattttatagcagaaaagaagccagcaggaatagtagagacttcagcaagactatcattcattgcaggaagatgatctcattcctcagactccagtgagtcactccacaggcacttagaaaaattacaaatttactaaaattcaactccatcataaccaagcaggcataatagtgatacttgggatccttatgtaaactgaatcagagtgattatgtaatttatcataccaaccggaacacttccgagagtgaagggatccttatgccaggacagaagacgcaaatcagcctgttctgggaaaaccgtgatggatggttacctcttcctgaaaacacaaacaaacacgttttgtgcagtatgcagtcactagttcctcgcccatctcactcatccatgaaaatctctgctctaagatgaactaaccatagaaaaggaattgcaattatcttaaatcaaaaactaaaacctgtacacacatattcctagaaacttcctactagcccagaactgagaataaccaaaatgtccttcaacaagtaaaaagtttaaaaactgtggtgcatccataccatataatattattcagcaatgaaaaggaatgaaccattgatacacatagccacttaaatgaacttcaggaaaataatgctgagtggaaaaagtccatctcaaaaggtctcattctgtatgattccattatataacattatgatgaaggaaagtttcatggttgccaaagactagggattaggggaatggggaatagctgcatgtggctaaaaggggctaacatgaggaagccttgaaataatgaaacagttatatatcttgattgtggtggtaattacataaagttatacatgtgataaatttgtaagatctggacatacactcacaaatgagcacatatgtaactggtgaaatctgtatatgctctatgagatgtactaatatcaatttcaccttttggatttttcttgttttaatatgtaagatatcaacattgggggaggcaggatcaaaagtacctggaactttcctgtatatttccttgcaacttcgtataaatctgtagttatctccaggaaaaatgtttttaaaaactttattaggtttttcaaagcttgctttgttttgttttttgtatgtgtgtgtggcactctgctatgtattttaacagtggatagatatagtctttgtcctacagggactgtttcagaaaaacaataactacaattgcagggaaagtaagttatcgaagcaaatttgaagcacctaggaacatacacaaaatacacaaagacctcaataaaacaccattagctgcaaactcaaatttattatgaagcacgttgtatattggactatattcttaccaggtttatctagaaagttcttgaaaggaccaatcattaaggcattccccttcataattcccacaacattgttaaaggcaacattttaatgactcttcagagaatcagataaaaaaggaaattaccactgtaagaggtaagggcaaaatattaattgataaagtaatattcttccattcttttagtaattattaagtagcatatctggaaatggtataaataagtctgaacaaaatagaaagtataagataagcttacaaggtttgagtaaaacaggagcggagtagaggaaaagaatggatgaagtattaatgtgaagatgaatacatgttcagatatttccaccagtcaatcatcaaacatgtattaaggtaaacatgtaaggaaggcactgtgttcctcattttaagagtacaaaacaaagttattttgctaagaagtctgtaatacaagtgaaaataacaaacatgtaagaagctaaagggcaatatatgagttaatactataatagaagctttgaagtattaacgtattagtttataaatgaatgagaaagagaactgtattgaaataaatgtccttgcattcagataaaggaaaaagctcttgggctggagggagcactgatttcatgaaggaagacaaaaatttaatataagtccaatagagtttaaacagttaagagcaggttaaggaaaacatttcacattggagaaagagaagaacagaagtagaaacacgagaaaatgtaagttatgtttaggaggcttgaataaaacagtggggacagattcaggtcctgaggaggatgagtagttggaaatgaggttgaaaaggtggttttgcccagccatgaacttctattcataataatctattcaataatgctgcaaagggaaacattaaaatgagctttagttcagcagtggtgtgcaggaaaaaaattatcatacctcattttagctttaattgattttataattccaaatttgctgttaaatgcaaatgcttaattctaaatacgtgtgctctgtcttaattagataaaataatcctctgttgcttgggtagttcagtaaattagtccctagacttaaactcccctggatcatgttgtttatgcattaatcggtatgcactcttagagataaatgaaaaataaatggattttttcagagacaagttgtaactgtcagcatactttcaaatttatatcctctgcatgtgactaaaaatttgccatcgtttactgtagtaattacaattcatatatatatgctcccatacttgtagaatttcttctacatgtttgtattttatttaaaactacatgttgctagccaaagctaagtagagaatctaaacctcaccattatgtacataaccatgccaccaactcaacaatgtaggttctatctgcatttgtatataagatatgtcccaaaggaactaatcaatgtaggtaactgaagcagaaattaaatgatttagttcttccaagcctcactgccttattgataatgatggagatgatactgatgatccctaccattgactgagtgactgctgtttattggggacattcctaggaactttatgtacattatctcatcgaatccttatacactcctatatattataatcatttcagtaatgggcaaactgagtttcagggagaaactaaaggagttaggagtgaaaccttggtccatttgaccacagaactctacacacactgtaacataccatactactttgtgtgaaaactatgacacggcttgtatttcccctttattggtctaccacttcttcctcttcctcttactacggaaatatctcgagacacaggtgactgaatcagtccttggttgggactgccttttggacagaaatggggtagggatcactcctggagacagctgattcctgcccatccaaaatcattcttgcggtttcttttttctgtccgtcaatctgtcaggcacatgttcccagaaaaaagtctgtatatcagtggattcctatatattcgtaaacgtcaggcttattcttttgttttttatcttcttcagtgtaatagatttgatgcttctgtactctgtaagataattacacagagctgaatgtaatgttacgtgctgatggggagaactggtgttttaaattcttttaaatctggagcttttatggtcaacgttagaagcaccatggcagacttatgccctggctttagaagcctgtatgagattttgtgacttgctggctttatgagacttttacacctcagattggcctttccctccaagaaagataccaccagacaacaacaattttaacactaatgtcttccttttgattacattagatttgcaaattaaacagattaatagtagtgttctgtgttcctctcagctcttctgtttaatactcttatctgacaaagtgtaaatagaagacataattaattactcattacttgcatgtcaagttgcataaaaaattacatccccaggaggcctattattacatatctgactgttcagtgaaattagttttgcaaagaaaaagcataccttaaggtaagggttttgtttgtttttcttttctttttatttaatttattagagtatctgcaaaaaattgtggaagaacaacattaactcttaatacacaattaaagagattaattcatttgcccaaggatatgttatttttccttttttattttttagtttgtccatgagatattaaactttgcatttgaaagttataagctaatgatgcttctacaaaaggaagaccccagaatatgcctattgtctctttagtatatatcccacagagaaagttattagttaagcaggctatgtcataccccctcctctgtaaattgtctcaaccttgagctgggaagtgtactgccatgactgaaaaaaatagaataattttccagccatttcttgtcttatctgtctagagttgatctgaatgaaatgaggtctctgcttcaactggagagctcagcatttcatatttagctctcaatctgtttcatgataatttttgaaggaacagactgcttatgacaaaatgtgctgtactattattaaaggcatactgcctttatagagttccatcacttgaaacaaagtgctggctgggaagaattcttgaatgtgcatatcttctgaggttttttaacagctattaaataaaatatagtatgtgcctcaggtaagagaaaaccaagtacctgattaaaaacaaaacaaaacaaaaaggtcgtagcattgtcaatagagcaaagcagcataaagcaaagattacctgcctgcaatcacttagtcacttcacctctctgtaaaaatgacaatcataatcacctctacctcgcaggattactgtgaggtctaaatgagctaatctgtgaaagcactttgtaaactgtaaagcacaatttaaatacatattatcttattaaaaatgtctgcatcacctgtttcattgactctgggacagagatgttttcttttccacatttatgtgtatttgtgcatgtgtgtagtgtgtttcgtggaagcctttaattaacacggtagtactttctttttctttttataaactaaagtttgccatacccaagtgcactttctgtcacctgaagtcacagcttaattatgtgtctggaatgacttaatatataaaagtcataaaaatttctgtctaatggcaactatttttatgttagccctgtcttttatatactgaccagatcattctcattaaaaattgttgtttatctaatttcatacccataccacccagcattctatttgtacagtgttttatgtctatgatcaccaatcatctttcatatgttatatttgagcataatttattctttctttctatgaacatttatagagcatcaattgtgtgccaaatactgtgctaatcattcagtgtctccttggatttcacttatctgtaggtaaaagtgattacatatttatagtaataactccaattacagtgcagttggctcaaccagtacacacccaatatcagcctttttcctatgaagagccctcacaggtgttgctcagtgcccagtggggctttgctgtggaaccctagttctctgcccttccagcctcgaagttttcctgttagacatctgccctgctcgaccaggtgctaccactgccaatcccagcaccttccttgatgtacccaaaatcttcccatgccttgaaaactaagcctttcttagtatgtcaagctgttgctttggggttttctttgttagtttggttttcccattgcagtttgtcagctgtgggccgataggtttctggaatttcagtgtcaccaattattcaggtatgtgtacctattcaggtatgtgtaccagaataattgtgtgtgaaggtgtgtgaagtccatttaggcacaagctgggatctccactcccgaccccatcacattaaaaatagcaaaaattacttatctaattttatcttcctctcatttgccttgtccatcttctagttgagttgaataaactagtggacagtgaaataatcaaatgcaggatagcatacaggaagatgaaaaacataaatataatctaattttttaaagcctgtgttaaatttcttctgcttgtaaacgttttgaaatcttaattgaatatgaaaatagatacaaggtaaaaagtttatttttgtttgatactgtgctccatgtatttatttctaatttccacagtggatggaatattagaaattattgaaagtcctaattatctcaaacatttgcattttacgttaaatgtcctaaataagcaaccatttaatatgaatttaaaattaaaatttaaaggctggacgcggtggtccatgtctataatctcagcattttgggaggccaaggcgggaggatcacttaagtccaggaattccagaatagtttgggcagtatggcgagacccctatctctacaaaaaatttcaaaattacctgggcatggtggctcgcacctgtagttccagctacttcagaggctgagatgggagaatcgcttgagcacaggaagtcggggttgcagtgaacatgattgtgccagtgcactccagacaagatgaaacagcaagaccctgtctcaaaaataaatatatatatattttttgagacagagtctggagtctcgctctgtcgcccaggctggagtgcagtggcgccatctccgcttactggaagctccgcctcccgggttcgcgccattctcctgcctcagaccagaggcgcctgccaccacgcccagctaattttttgtattttttagtagagacggggtttcactgtgtgagccaggatggtctcgatctcctgacctcgtgatccgcccgcctcggcctcccaaagtgctgggattacaggcgtgagccaccgcgcccggccataaataaacaatctttttaagaaaagtttcattctttatagaaacatatcctacgttgaacgagagttttaatgtgagtctacataatcattgtcaggttctaactaaaaagaaggcaaatataaaaaccggctttgtcacttgaagaacacaagaaataataatgagaactatgcaccatttcacaattctcacacttgaacattgttaatgttgaagccccaggattatggaaacactggaaatatgccacactgtgatcacattcatttttagaattaatagtaggtatcatccaaatggttctaaaatacattttttaagtgtgaaatgtctttcacaaatatggccatgacttttcagagcactcttttgcaaataaataattctggatagccaaattctactagacctccctatacagaaatctcataaaactcagataaatgcaaataagtcaatgaaaagaatagctctctatcttcctcctaactcagccacttaagactaatattgcctctattaaagagatgaaagcagatgtggtatacattattgatattgctccacattgaaagttaaaacttttatatatgttctctcagattatataaaactcatataaaatttacttaatgaagttttcaaaatagtgtatgggaaaaagggtaagtttgtgatttcatggctgttttcatatgctgatctgaattcaatgtcgtctctctcttttcacaaaccatctgggagattgacaagttgcatctcaccagatggcctaccataccaacctcacacttccatggcaccatccctccatgataaatcctgaaatgctttaatacaatgttcctgctcgggaagaactccacagctcatgccttacgaaccagttcatcgtcacccacttcatttcccaaggttgaaatgggatatgatttccactgggtgctaaattattctatggctcagaggaattaagtgatcccagctgaatacaccaccaagctcctatcatcctatctttctacaatctcttttcttattctctgtttcccttactactccctggcctattcttttataacttacactttacagagagattccattcttttttcctctccttttccatatacataaatcactggaatgtatactttaaagtgtcagaaagcaatgacagttttgagctgtggttcatgtcttcctgaacctagcatgcagatagttgatactatacaatacaaaactgaattgtctgtgtcaattattttatagtatcactacatatttaaaagatactataaagacacatgcacacgtgtgtttattgtggcactgctcacaacagcaaagacttggaaccaacctaaatgcccatcaatgatagactggatgaagaaaatgtggcacatatgcaccatggtatactatgcagccataaaaaaggatgaattcatgtcctttgcagggacatggatgaagctggaaaccatcattctcaacaaactgacacaagaacagaaaaccaaacaccacatgtttgcgttcataagtgggagtggaacaatgagaacatatggacacaaggagggaaacatcacacaccggggcctgtcggggggtggggggttagcattaggagaaatacctaatgttgatgattggttgatggatgcagcaaaccaccatggcacgtttatacctatgtaacaaacctgcatgttctgcacatgtatcccagaacttaaagtataataataataataaaagatactgtctgggaagagattcttaagaccactcattcttccttttgcctttacaaatgtcagagaggcactaaagaacaaactgtgaaggaaaaagacctgaaaaaatatcttttttcccctagcttacagatcaaatctgacctcaatatcttcccccactccctcccctacttttcccctctgagcctctctcataagttttataaattcttccagtcatttagtgttcaagaagagagtccaaatcagaaactttgcttaatatgataggtctcatttctctggtgccttgatcatctttctttaaatagagtgaattttagcttccaagttattttttcttctctttcttgacttttagactttactgtgtctgtattctctgacaaacatataaactgcttatatcttcaccctcatgttttgcatatcaaatccaactatctgctaaatttttcttttcatttagcagtaactgactaccataaatatactatcactgtaagaacaaaccatgtcatagagaagtttgcctccaggaactttatttcaaatctttttacttaagttttcaaaatgctactttatatgttattttatttctcccattgcatccccaggttgggtcagatgacagtatacctgcatcatctttatatgtggatatcagtttccatttcctattctcccacatgcagagctgcaagaagttgtctgcagcttgttgggcacataaagatctttatggaacaggctctgcacaatccaacataatattgacctcagagaagtttggtgctttccttgggtgtgactttgtcgactagaagattagccagtgtttctcaagaataccgaatggtctatttggtgtagataaaaagagaaattgtgatgattaatgaaagaggaatttttgatacggaaagaataagattagttctgtcatgaggatagggagaccaacagctaactcagttagttaaaggataatggaatagagtaacatgaaaatctgtcatcttacttccctgcttaaaacatacaaatagattttcatggttcttcagataatgcccacacttcttcaggggtttaaagtctttcatgatctgatttattatcactttgttagtgtcatctcttgtcaattcctcacctttttatgctgtaatctttctgaatttttctctgttcctcacacttgatactcattctcaccttcctctaatcctttgcatataccattctctctgcctggaaaattcctaactctacactctccccttaacccaacaagtggctcctcatcctccaggtctcagctaagatgatactccattcacaaatgcattcctgacctcctctcctttaaaaatgggaggagtactcagttttttcctcctcctcagaaaccttccatactccatccttaattggctatctggaaaagtcctgtttatttatcaagacacaacttaaaacagttttctattctttgaaaccatcccagcctcactcaagtgtagttgattcttttccttcttaatacatcactataacttgaagatatgtctattattaattaaattacactgctatgacaagatttccctgtatatttatattcccaaccaggcaataaatatgatctccttaaagaaagagactgtcttatattcactattatcattttacccccaaatatactctttcctcacctgcttatcttacagatgtaattaatttttagttacctatctgttactctgtaagccttctaagggagggaccatgtttaattcaccactctttacctaccacgtttcacaaaccttggcacatacagacactcagatagttttagaatgaatgtatgagcttgtatttgtatacaaaagataaatttttctgcaagtattaacaaaaaaggactgaaccagagactcttagtagttttctgtagcctttactaatgttgataatatatgataaattggaggtcatagaaaattcatctggtctatttagttacaattcatttgcatggccccatgcagggcagagatctagaaaaaataacacttatgaaaagttatgacaaataaatcagatgagaataccagattatacaatttacctatggccctaaacatagtctaatatacttaaaagacagacatacttaatatcatctgcatacattttttttcaacaagcattatttatagatcatctaaaatatgctaggctctgctgataggaaaaataatgcatcccaaaagatgaccataccctaaccctaaccgtaactgtggaagctgtaaatgtgttttcttatatgacaaaagagactttgctgatcggattaagattaaggaccttacaacagcaagattattctggaatttctagctgggctctccaatcacctagttccttaaaactagaagaggaaggtaaaagactaggtcagggaaacggccacagagagactcaccctaccattgctggcttggaagatgcaggagaaagggcataagccaaggtatgcaggcagtggaaggtgataagccaaggtatgcaggcagtctctagaatctgggaacagtcctcaggtgactaccagcaaggaaatggcgacctcaatccttgtaacaggaagaaactaaattctgccaacaacagtgaaggagttaaaaaaaaaaattataggccgggcgcggtggctgacgcctgtaatcccagcactttgggaggccgaggcgggcggatcacgaggtcaggagatcgagaccatcctggctaacacagtgaaaccccgtctctactaaaaacacagtgaaaccccgtctctactaaaaatacaaaaaaattaaccgggcgtggtggcgggcgcccgtagtcccagatactcgggaggctgacgcaggagaatgacgtgaaccccggggggcggagcctgccgtgagccgagctcgcgccactgcattccaccctgggcgacagcgagactccgtctcaaaaaaaaaaaaaaattatagagcccctagaaaggaacacaactcttcttctgacaccttgattttagcccagtgagacccatgccagacttctgacctatagaattgtaggataatacatctgtttcaagtcattatatttgtataaatttgttggagcagcagtagaaaactaatgcagcactgggctaaatgcttgggagagaacaataaagagctattcttaattaatgtctcttttttatggcatttttaaagaccatagaatagtctgacctgcaaaacagatttatggaacaagtaataccgatacagtataataaaacttatagtagatgtatataagttttatacttcaagaaatagtgatggaattaaggaaggtgttaaatctatttggagtgggatcagggaaaatttcagagaacaaaccattttaagatgggtccttaagtaataaatactagttttccaattggctagatgggggtacgatttagtaccatgttaagctaagaaggagtgcaattggagatggatgagtgatagaagaatgagtgacatgaggacttgtttgtcccacaaaatgtatttggatgtataatatggaataatttgcatctagaaagtttgctccagctgcaaatggggaatggaagaggggcaacactgtatgcagagactactaccataggctgagtaagaaaggatgaggtctctgttttataatagcccccatttattggaacttggctatgtgtcagcaactataacaacactttacatatataattccatttagtctctgttagttagctctgcaaagcagatgccattccatctcacaaagaaaccaaagtttacacaaatgtgcccttaaaaaagaaataccccacaaaaagctaacaaaagtaggattcaaacccagttgttaatcacattaaagcctgtgctttaattcactctaccatggcaggaacagggaatcaatataagaagacagaaagagagagatttaataggtaaaattaactaagcttattattgattacacgtaggacaagggaaagagaggaattgtagcttactgatagtttttggatttgagttctaggggaaaggagttccagctaagatagggaccaaagtagaagacactttctgagtcaggaataaaagttaagcttcggatgaatttaaggtgtgtattggatagccaggtagagatgcccagaagccagtctggaatttagaattgggacatggactgaagagaaggatttgaaaatcatctacctgtaggtaactttcatggtctggaacccttcatatataaatgttggagaaatctcctgtttctaatgaatagtgaaagaatctatccttatctgtgctctgaaagaaactttcatctgagactccctgaaaagatggctcagcctaacaccaacgctgactaccagactgggggtgctggcaaaatggcaaactgacagtgccaagggctttgtctgtgtcctgcttgatgaggtcagaaccttgttcccgtggaagacctactatgtcatacagctctgctgcattaacagccagtctgaaagtaaatactttgctttagacactgtttttaactgcttaatgagcatactgacttcccaccctaccccccaattagctgcatatcaatcagtcaattagcagatagacagctcagccaaggaacagtgaaggctggtgttgcaactgattgttaaatctgtcttgaatttgctattggaaaatgagagaagtttagggcaaatactgctccctgtacccctgactgaaatcttctagacaaaataattgctatcaaatattctgatacaggaattcttgaaactgcctggttactttactagaaagggaagcagccactaactgcaaaagactacctctgttgtaccagatgcacaagaagagattttcaccattgcagagctatttatacacagccaacttctgtcctcagttcacatatacacacaactcccattgatatcagtggaagctgcggacatgtggctgagaacagaatttggcccactgagctgcaaggcttggcattcttttgctcactatgacaacttcagaactggatctcttagcacatgtgcttttagaagaagagttcttgatttattttcttttttttccctcccctctttatcttggccttgaaaaacaaaatggaaacttgagaaactactggcagcaatgggtttttcttgcatagaatcaactgtatggcggacttggagaaacagagaccatacaagtttttggattcaaaaacttgacaaaatagttttctgtaagtgtgctgccgttcccaggatgccgactaacagcttggcttcacagtcgtccttgaaataaaagcaaaagatgccatgaaacaacttttacacacgtaaaattattaagtccaatatttaatttacagatgacatattccagagaatatttgaaacctgtcattaatatgtacttttattcttcttataggaattgctctttctctagtttaagtgattttagtggggctgtcagcaagactcctgcctccctgtaagtgtacatgtcaggctaggcaatcagtgtatccagtcctcttgaaaacaaaaggcctattaaccaaggagagacaaccagcatatgatatttcaaagattatatggaacagggaaacagactctccttccgaggtcaggagattaaaggatacaaagtcttttagctttgggggccagttttgtaccacttagagaaaaactgcaggtaatgaagccaacagggaggaaagtaaagaaggtagaggagaaaacatttttataatatttaaatccctggatctagccatgccttactgaattttcccactatgaacaaaaaattaatccctttattcttaaactggttggagttgaatctctaataactggtaacctatagggatttaacaaaaaaacattgctccttcattcactctagagattttctctgccaaaatgtatttttttattgcgtgcaaacactcagatttcaccatctttgtatatactgaaactttcctaaataaataacctcaggaaaaacatgtgatttgcaataactgtggatgctcttcacaccaagaagataggcaggaagattatactagacaatgcaaacacataatgtctccatgtctctgctctgttgggaaagaggaagccagtggaggaccctctttgtggatgcactttgaggaagcacctcattatcttgactcttggctgttgcccagtgtggtgccctgatggagtctgcgcccagcatgtagctctggtaatggatccagtgacaggcagactgtgttacaaggtgcattacacttgaccagccatcattacatcggttctgcccaaattatttgattgacatttttagagaaagtcaggaactgttcataattggtagccaggaaggcactattttcaaataagtgaataccaagaatgaaagtgtaaaggaagagacttaaagaaatgggaaggttttcagccaggcgtggtggctcaagcctgtaaccccagtactttgggaggccaaggtgggcggatcacgaggtcaggagatctagaccatcttggctaacacggtgaaaccccatctctactaaaaaatacaaagaattagccgggtgtggtggcaggcgcctgtagtcccagctactcaggaggctgaggcaggagaatggtgtgaactcgggaggcgagcttgcagtgagccgggatcgcaccactgcactccagcctgggcgacagagcaagactctgtctcaaaaaaaaaaaaaaaaaagaaagaaagaaagaaatgggaaagttctagggaaatgggtcttctgccattgtgaaatttggatttcacaatttaggatgtgtgggccatcctaaaattaggagaatgtgattcagccttgatacacacgaattggaagaatagcttacataaacagcctttagttacatctatttggcatagcaatgaatctatgcaaaaccttaacagtttattgtacagtacattcccatcaattacccagaaaatacatgtcttatatgtcaatatatcatgcagtagattcccattaatcatccggaaaatatgtcttaggaataagttatctactgcctgaggaatttaatttaattgttgaagaaattgccttcagcagggactgatttcttgcatcattaccagtgagtgtttcctcacatgtaataactgattttccagacattcaccttataactcccatttatgtgcaggttacaatatccattagacatagaagtcccccttaccacacatgaaaacacatacacccacctacccactcatctaccccaccctacccaccacacacacgtaagaggacttcaaaaagttcaaggacaaatggaattaaagataaaaattaaaaagatgaacttgtttttcaacatatcatcaagttcaagacacttattataaattatgataccagccatttagtctgtccctaaagaactgaggctcctaagaatttaaccatgttgatgcagtttttttttttacattattaagtgaggaacaatggataccctttacagatttttttaacattcagaaacaaaaagaagtcagaatgagccaaatcaggacgataagttggatgtctaacgaattcccactgatattctcacaatattgcccttgtttgatgagaggcatgagcagaagcattgttgtggtggagaagcattgtcatgatgaagctttcctgggcatttttcctcaaaggctttggttaactctcaaaacactcataataggcagatgctattgttctttggctatctggtatgtcaacaagcaacatgctctgagcattccaaaaaattgttgccatgaccattgcctttgactagtccacttttgctttgattgtaccatttccacctcttggtagccattactttgattctgctttgttttcaggatcatactagtaaagccatgtttcatctccggttacaattcttcaaaggaatgcttcagggtcttcatcccactcgtttccataaaagctatgctcttgtctgcagctgatctgggctcactggttttggcatccatcaagtggaaagtttgttcaatttttttcagtcagagctgtgtaagctgaacaaactaagatgtctatggtgttggctattgtttgtgctgttaactgttggtcctcctcaaatagggcactaaatttttttttaaaaaagggcattaacaaggttaaatttttctacacaaattgatgtagatggtctgccacaatgggctgcatcttaaacattgtctcattccttcttaaaatgagtcatccatttgtaaactgatttctttgtggcattgtccccataaactttttataaagcatcagtgatttcaccgttcttccactgaagcttcaccataaatgtgatgtttgttcttgccttaattttagcagaattcatgttgctttcacagggggtcttttcaaatggatgccttatctttcttagtgcttcaaactagattgtatttatacacattataataagttagtaagagtttattttggtgcaaaaagtttttgaaatccatctatagttttctcataaatgcattttccatgaacttttcaaagacctcttttccatcataaatctaaaaaatgttaagatttaagtagcttcactcatctaagagaatcactaagcatttatttgactgcttgtttttcttctactttaaggtgtgcatttgtttcttactgcatgtaataaaaggagccatataaaaaaggtttgttatatggtataataagcaccgtatatacatggtctttctggatactcacaacagccttgtgagacaaagacaaccccgttttacaaatgacaaaaacaaggcttagggctatgaaataaccaagcaaatgagtttgattccaaagctcattctaataaccactaagtaaatgtcagtgcactgttgtatatttttaccgtattttataaaaggtccctaaagacccaaatcctctgtgcatttagttacaagcaccattctgcatttccccccaatacattttcccctggtttatacctatcttctttgttctattatttttgaaattttgagtagtaaaggaatttgggagagggaggatgaagagagagagaaaggaagacagaatcacaccgattaagatgaatttagaaagtaagaccactacggctcacattggtggcatttccctatgtgtctttgcaatgctcttatctgacacaggtctcttaaaggttgggttgaatatctgttcctcagttattgctcttttactccccaaaatcttcccctacaaaggactaaaaatagtgatcagaaatgacctttccctccttagtcccaggtttgtttgggatttcatgtaataaactagagcatgggtgtcctcttccactgattgccatgttcatttcatggccttagtcaggtgccttggctgcaaattttccctctctacactgaaaaacccagttttgctgggcaattttagttcccactatgaagaaaacccttccagcatgtaaatgcaatgcttggtgaggcctttcctgaaaagcagtgttggccttcacacacaagatgagacatgtggagattaactttaatatctaatctattgcagaggtgaaactaaattctatttctttctcctcatctgaaatgaaaaggaaatgcttgaaattttgccccccaaaatagagcactttaatcaaaccattttaatgtgatattcctgtgtcttcattaagtttccagacagttttaatgtttattgaactaaattgatagggttaaacatctttgtaagtataaactaaagtttttatggctatttctattattgtgtaaaagaaaaataacaaaaaagtatctattcgtttgaggaggtagctggtatttgctagcaaaggagaacagccatataattaactgtgtcaaaatgttttctttgttcacagttaatctaactgcagctgctaggaggcagaatgcataaatatgactgtgtacttttaattacagaaaatgacaggcgtaagttgtgactggagtgttgcctgagattgttgtgggcaaaaatgttgctcagagactcattgaattaataagtagccttttattttttggtgtccaaattgtatagatgttactagcaactaaaataaaattaaatttcagaattttaatcagccaaagaaaatttaaatataatcctgcaacatatttagagaaatcatggcacataataaccatttgatattgaacattatatacaataatacttcatacatgtgatttttgtcttggagcaagaaatgctctacataagtgaattttctagagatacctttaagaattaaattatttctcccaattttcctctccattctgtgcaaagaagtcactcccaattctgatttttttccctagatgctctaataataatgaagacaaaatatctcatatttgctgatttttctgttttgataacacatagtaatgcctataaatggaggggtgggtagctctgagtcctggggttcattcccctctaggtgttgatacttatgacatagtatgaaagagaaatggagcagcacttcattatttgggacattgttctcttcttcttccccttttctcttctacctttaatggctgaatagtatagcagaatgttcattgggctttccatcaaacatattttatattcattgtaactctgagcagagaacttaacctttctgaaaatcagttcatttctttatatggatgaaataggatcatcaatgtttaaattttaaatatagtgattgctcagaaatgttattccttttctttttatttttctcctctataactattttttaatcacctttttattatacatcttttctcctttctgtgctatggtagacaggtagggggtgtggtattggctagggaggcttaaggggtcacggtcaatgctgtagataattgctgttttcagctgccttgttgccttcattctattgtctatccctgcacgcagccactgtgggggtggctgtcaccttggtgacagcagttttgtgccatgcatgtggtgtgaacactggcttagagcagggtataaacaggtcctgctgcttcaagtaattcggtataagcagacagactattgcctttgttctcttagcagctctgctgctgaaatacactaataatagaacatgttagttgaaattatgcctctccatctctaattactgcatgccaaagtattctgactgctactgtcatttcccagcaactgatggctgcaggtgattgtttcagattgtgctcaagggacttcttccactcattctactcattctccctttgccccactacgtcatgtgttcaataacttgactgattcatttcagtatgctgaatggtttgaatgaaatagaaatgaactttaagaaaatattttcaaatcagcagatgttcattgtgggttttctctgtgtaaaggaaagtggaacagtcatagaaattgtttagttatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacagtgagataccatctcacaccacttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcgtcactattcacaatagcaaagacttggaaccaacccaaatgtccaacaatgatagactggattaagaaaatgtggcacatatacaccatggaatactatgctggcataaaaaatgatgagttcatttcctttgtagggacatggatgaaattggaaatcatcattctcagtaaactatcgcaaggacaaaaaaccaaacactctcatgttctcataggtgggaattgaccaatgagaacacatggacacaggaaggagaacatcacactctggggcctgtcatggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtatgataataataataaaaaagatgatctatgcattcctgagcctaattttccggattttgatgaagacaactattcaattccatccctactcctacctaactcccccacgtctctatgcatttcaggcagaccttcaaccacgacctgatattcttcctgctgcagacagccagctctgttcagtcaggctttggatcctggagactctctaatctagtttctaagttttacagatgaagaaattctgtgttacatgaagtgtccaagatctcacagtagcttaagcaaagatagaagacaaacccagcattcccaactgttgatattgtatgctctgtgcctcacttcattgtatgttttacctgttatttaatgtaacagatgttgctgataaaatgtgaacagaagttgtcagtggcaggtacaaatcccaggccaacatcgaaagtttgtcactgtcagaacttctgttcagttttagttacatctgctaaggattctaagcacagtgtacatgaaccttccaaaagatccttggcatttttacatcacttttgtttcctcctgctttttatattttatggaatgagtccaaaatgatcaaggcatgtacagtttacataattgtgcactcaaacttgaattttacatgcatccagaatttggtctaattctgtaaaataaaacctcagttggaactgggctatgctgaaaagcaagtttgatataagtgacattcaagatcaccttgtattttccagatgatcagacctgctgtttctaaaagagtacctcactttgtagaccactaaatgcaaattgtattttaaactatagatttgggggaggaggggtaattaagagttatagtaatattgattcttacccatgtatgagtacagatgatatccccatttattcagacattgttttatacctttcattattgttttattgattttaatgcccttattagattcattttcagatattataaaggtttgtttactcttgtgcattggtctacttttctttctctttccttttttttttttttttttttgagatggagtctcactctgtcggcagggctggagtgcagtggcgtgatctcctgggatcaagtgattctcctaccttggcctcccaagtagctggaactacaggcacccaccaccacgcctagctaattttatttatttatttatttagtatttttagtagagatggagtttcaccatattggccaggctggtcttgaacaaactcttgtgtgcggatcaagtgatccacctgcctgggcctcccaaagtgctggaattacaggcaagagccaccgcaccaggccattggatctatttttctgtcatgtttttcaagtttgtttttgttgacttactaaagaaaaattggttttttaatgttaattatgtgttcagcatctctctaggactttcttctcagttcatgtagtttgtctttctatctttctaatcttatcttgaacagcccactcagctttgttccaacaacagggaccttcagatagttcctaaaattccccaagcattttcctcacccagagcctttgcttttcctatgtctcaagtgttcttcagcccaagtggttagctctattttctttatctttcaagccaccatttaaaaatcaacttatcgcagagattattcctaattataccatcaaatgtgggcccttccctctattgtgcttttcaaattccccagcatcacgtttttacccttcttaaaatgtatcgcaagctggaattgttttacttacttgcatttttacattaaaatatgagtttcatcaggaaaggagcttatcagtgtggctcactattatcttcttagcacctaaagctgtgtctgacaaattgtaggtgttcagaaaatataagaacacaagaagagtgacctgagactaatgatctaacatctctgattataagtagaaaatacattttcaaagcatatagtgatacactctgtctccgctgtaaaagaataaaaataaaatataatcataatgaatatccatgacaataaaacatagtgaaattttctggtctaagtcctgtccccaagtgccatgcaggaacaacaacaaaaagccaagaataatgcatagggactcagcacccaagtacggtttgagccacctgaatttaaacagtctgtgattgatttagtatctctctttctctctctctctctatatatatatgtgtgtgtgtatatatatacatatagagatactaaatcaaatatacaaattttctcttatatttatatgtgtttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataccagtataagagaaattatgataaatatttaataaatagctcaagaatcacttgctgcagaaattcagaacatgggtcgggcgtggtggctcacgtctgtaatcccagcactttgggaggccaaggcaggcagatcacgaggttaggagatcaagaccagcctggccagcatggtgaaaacccatctttactaaaaatacaacaaaaattagcctggcgtagtggctcatgcctgtaatctcaactactcgggaagctgagacaggagaatcgcttgaacctgggaggcgaaggttgcagtgagccgagatttcactactgcactccagcctgggcgacagagtgagactcagtctcaaaaaaaaaaaaaaaaaaaagaaagaaaaagaaaaaacaaagaaattcagaacatgtatccaacacctagtgtatcaatagaagaatagggcttatttgaccaagggtcattaacagtgttctgttaatgaaccttgaattggccacagaaaacaatatcctgatctgtcaaataaatgttaccaagtgcttactacattcagcagtgcgtttagtttgcggaagagcagaatgactaaatgaatgaatgaattttaaaattgagttagttatgtggacgtttggcaaatgtacaaaaagaatcagcaaagttttattacaatgcaaatgttatgctgcattttaatttctatttagcctctaatatgcaacattaaatcaaactattgtgtacaagaaccttaaagttcatttaatgtgattttaattcatgttataaattaaattatttgcaatggaaatggagaaatgtcttatatcttagtttagacttgtcagctttccaggctaattttgtgcacagtaatactaactgtagacagacactgtacatgaactacagtgtccaaatcatagatcggacctacaataaatttctgtgtggaggagaataaattctcctccttctctccattctcatatcaaactcctccggtattgcattgctggttagcacaaactaacccataaacagcatttaaggggatgttgccattgctgaagcacatactgctattgaatcccattcttcaagcttctcatgcatcactgaaagtcattcaggactctggattcaccaggaactataaaagccaccagcaactactgagaaggcaatgcaattgaagtgtaactctggttggaaaataagtagggaattgggtgttgagtccctgcgtgttattcctggccaaatacatcagagctacatgtcaggttttgtccaaaagtgttgtatttgctttgattttcagaagttcaatataattccattattacaagttcatctatttcttaatgttttaaatacattttatctaagtattgttttgtattggatttactctgaatatgtcaggtctttatagagaaaacagtaaataggaaatatgatacaatatttacagaaaatattctccagttaatgtatcttattattatatgctcttccttatatggtagagtttatgaagttattgagttcattagaaagtgaattaagaacatgaaataggtccagtaaaatatgaacccacacatcaaaaaaaaagatctaatctccaagtggcttgaagtgtagtgtaaatccagtaaagctccaaaataaataaaataaaataaaacgatattatagtatgcatattcaaatgtattaataaaattgtgtgaaacctttttttaaagaaatgtaaatctaagttaagtgttcttgctgttacagattaatagatccacaactttctaatttcaaatttgaaaagctaaacttgtgcaccaaaatattttcagctgaaatatttttaaacattatattttttctattattacttgagctttttaaacttagtaattcaaactaatcttggaacacttgcaaaatgtgatggaaatgaagaagaaataagctgtaaattcaagatggctgaagtttaatttctgtgccgaccttgggtatgtctagggaggaaaattggcactctcttaacaaaacaaaccagagcttagtttctacatagaacaaggtttgaaatgaatatggaatgaaggtaaatatttagaagattaattctttgagcttcctcaataccttagttttgcaagactttgaaaccatcttctccagggacaaaagaaagtaattacctctcctccacatgacgtttaatcatgctctatttttcgaagaacagctgtgcaacactggctgggctacaaattaaacatacctccttcaacttgcttagatttaaaagataatgaatatgttgggtgacagaatctgaattcaaaaagactttaataggccagagctataagctgaaaacaagatgaaagtaatcaaggataaatgtaaggtcctatacttgagtccaagaaaccaagtgagtaaatacagggtggggaagataggacttaatggcaacagactgaattaagcaccagagaatttagaagctatatttgataagaagctaaatatgagttggtggtttcatctaactaaaaaaaaaaatagaatgtggcacatggtacataagtaaaagcattcatcattgaagacctaacctagtttgatacaacataatatgaattcgagggacttacagctctttgcaaaaaaacgctatcactgttattttaatatttgttcaagcagagatcaaaggatctacgctgacataatcttccttttactagttgtactaaaactccaacagtttctgttattatagaatttgtaaaagcttagatactagctggcatcagaatattatgtatattaaaaattagcatatataccacacatgaataagtgaaacaagatgtagcttaatgaaattatgttgtggaactatccatttaacttatgtcacatttgttaaatctagattactttcataattctgacaaagattaacaactgaccattgtgtaatagagaaagaaaataggacctatgtaaaaatcacagagggtctaggaatatgatgtataaaatattttgaggcttcagtctaggaatatgatgtacgagacattttgaggcttcagttcaaagcataaagagtgaaacatgatacatttaccagaaaataaactaaacttctaaacacatgtaaaggagagaggtcattattatctttgtgaatattcattattacagaattggtaaatttcccaggttttcttggcttctctctctacaaataaatcactgtagtaaaaactctcacaggactgtcaggtgggttttctggaaatatttactgtaattgatttttgtggtttcctaaatgctgtaatccaaaacctcatttatcaactttctgtctgctttattgtaattgcagagttttctattcctatatcatgacaggtcagagcagcgctgtgacaagcagcctctgtattagtaaagatgtgcattccacacaccagcccagcaatccagattattgactgtaattaaactcacaggggagttaaacttgtttgacaagaaagggggtgggatgatttgcaggatttaagtcatagcaacagtgacacatgcctgccccaaaactttctctgaattttgcagggcctgtacacatttagaaaagatcaaataattttgttctgcaagagagtagtacatatttataaagcactgaatcccggaatcactggtcccattaattgaacaacacaagcatgcttcttgaagaaattcatataccaaattttgttattctaatatcagttcattacagtcagacttctggcctgggtccagaaacaatgccatttttaatgggttgattgctaaatctcttgctttctttagtttgactcattctttatcgtttcttcttctgattttgactcatttttcttttcacaattaggctttgtcccccttctgcatcacttctccagctttgaccatgttcttctaatttttgccaagaatgcggaatctaattttgatgacactgattttgctatgctggacatatcccctgaccattcagtggaggtccttaggaaccctacattctgggtgtctggatctcttcccacttcttccacctaccttcctgcctctttctcccatatttggccagtccacatgatcgtccaatgtatgtaagtgagactcaaacaaaagcatagaaaactttgttttcaaaaagtaaaaaccattcactcttttgaatattactgtttgaaatgtgtttaggtcctttgggggaatggctatatatgtttatatatatatatatctccacagtagtagcaaagaaaatcaataaagggtatattttatgactcccttttattacaggataagaccaagaaacattagaatcatttaaacctacaacacagagattgaaatacttgttttatgtaggcccagtctctattgtctgaatttttcattagctatagaaactttactggatattggatatggatatagataatcctctctggatatataaaacatctttttatttatctgacataatgtatttaaaaactagttcttctttcttcattctgtctacaaggaaaatccttttcactccccattagttttcttgcaagttcatgcttgtgataaaagaaaggcagaatcagagtctaaagatgggtcagtgaacacccatccctgcactaaagggctatgaagggcagtgcttgctgttattgggtaggcaatataaaaaatatgtaaggaataatattaattctgaatcctggcccattagagattggagcaatcattgctagcaaacatattttctgccttcaagtaatttatagctaattgacagagtgtagaatatcacaattaggtacatcagaaaaatgactttagtaacttggcaggaccaaaaccagccaggtgcaatataacacaagataataatgagtaggtcatgctcatcttcaaagcagaagtcacagctcctaggcgacaaatatcacaaaaaaacttattcatgtttttctgttttgttccttgtgatatttccatatggtatccctgaagataagttgtatctaattagagtgtagaaatactttcggttgctagttgttagcctaatctttactatagaagctgttgtttgtctttttctgaacttttacaatgacatttaatacttaagttaccagtggtatatggtgccctagctgagtgagggggggaaaattgtaatggcagattctaagttaggattttgattcataatgtttaaactttgacactttttaataatgaattctaaatttaaagttttgattgcttgttgaaaagcatagttcaaacttgcaaattccatttttcttaatgcataccaacatttagtaaaatacctgtaggaatttcaatgaagattttagttagacaaaagctgtaaataaatattgttaaaaagaaatgggtagtatagttgagataatatctaatccatattaatacttatttttgagtttgaggtgtacttgtttttattaatacttagagaaaaaataattgtttgttggctgaaatgtttcatcttcacctgttggaatgtgtgtttgtgtgtaggttctgtaaataactatgcagtgaccaataaactgatgaaggagatggtataaacaaataaatgtcaaatctacatcaggtataagactacatgctgaattcaggtagtgtcatttgactattttaattaatcaattaactatttatttcaagtcaaccaaggattttgcaattaaaaaatacaggtactcaagggaaaaaaatgaaaggtcactcattagtaacaaaatttaatgaaggagacaataaaataactctggaacacaaacaagataaacactattgcagtaaacagaaggaagttatgatcatttattaaagtatagtacaatgtcatcacagctacagttaatacatatttttgagcatctactttagacaaagcaatgttccaagctcctgaaagatgaaaatacatacaatctttagtctcatccttcaaagtaagaaaatttataggcaaacgtttctgaagcaagaatcaaatagcagtgcaagataataagaagcactacaaaaaggtacaaacaaatccccagtctaggatgactgagggaacccttacataaaggaaagagtttaaaaattggcatgagcctgatgaatggaaaaaagagggaagaagatttcagaacaatgtgagcaaaatttcagatgcagcaaaatagaatcttgagaagaataaataaagcaaattagctagtagagtcatggactttagctaaggctaaagtgggaccacagtgagggtaatatctatttttttcagactcctaaattaatatcttcaacctgagcttcccatggaactccagattcacatatacaactgtatacttatgttctccacttaaatgtctaatagatgtctcaaatgtaacagacctgaaactgggcttctcaaattctcttgccaagcctgttctccagtagtcttccccatctcagttggtaacaactccaccctcccagttgatcaggtcaaaaagtgtgaatcatctttgacatctctctttctgtcacaccccacaatgcccaccccaaaggaaatgaagtggacagactgctccatggacctgacgggctgttgttgggataaccaccatgctcgtaactttcatcctgcaccaagcctcacctggagtgaagggagtcatagctctactctgccctgggcaatagtgccttctcttcatgcctttctgggtctcagagtgactaaagaggccataaagactgcttactttactcatttaatcaattcatggatcaatcatctaaacatttctcaataaaaccgtttagtagcttcgcttcccattcaggggaaatgtcactacaataagctgcaaaactcgccagggtctggactcctccgtgttctcctacttaacacctggttcactccattcctgccaagcctttagctgttcccccaacatgccaggcttgctctggcccatggctttgccctggctcttccctctatctggcattcccatcctcaccaccaccacaccatgctccatattgtttccttaccatatatggcaattgacgcaaattcaatattaggaagccttgtctagccactttatataaaggtgtaattaaaccatctccatatcacctgcagcaacttctagcaccattcctgtatttattttccttgttagcacttttgccactgaatcactgcataattgattgattgattgatttttattgattgtcttcctttctacaatgtaggcaagggttttttcctgttcccagaatggctacatccacagcagttagaacattcacagtcccaagtagaactcaaaaaatggagttgaatgaatgttgcatttgaaaggaatgaatccatgttaagaatatagataaatatgaagtttattcatgagctctggatttatcctctagataaatttctccaaactgtttattctctgcccatcatatttgtttcttttaaaatatatctccttaattgttatattagatttcacattgagaatgttatatcacataattcctgtttacggctgaaactttaattgttggaagtgcttaagtggacctgttatatttttaagatgacatagagggttgtcccttagttgaaaataaaggatgcttgctgcaggggctggaaagcatagagataacaacttctcattctatgagcaactcccgtgggggctgtgaaatcttagggcagagaaccactgaggtggcaaatcctgctctcactgaggaagcctgttagatggatggtgcttagtttgccaatgtgctgcttcattaattctctaaccatcgtgagggtgtgagggagactgctgaatgttttgaaaggagttttaattggaccttcagtcgatacagttttctaaaactaaaatttaaaaaaaacgtccccagtggatagggtcagtgacacataatctggaacaagaaggaacgatttctttgagttagtgtgttttagggaaacataccctatgattaaaagcaattctaaacttaaaaggtgaagcaggaaaggaaagcagccatttttttctcttgaccttagggtcttcaaccagtttctcattcacctgctcttacagatgcatcaacaatcaaaggtacagagctcagtctgaacctagcaggtaggatgcgaaaccttctcagtcatatcgtcatggtttgtttaagctaaacaatccatccaattttactttctttgtaagtctgcctaaattcaaaataattgatgggccattaattcaaatatgcaattggaattactagattctcaatttgatacctaacgtaaactacaagtttgtcattgcattaactcatgtctctttcctcatatgctcaagctttttatggaactaaaaatgattttcagcctctaaattctcccttcatatatattgattatatatcctagaatacggaaaattcttaaaaatgaaaactgaggcatatcaatcaacaacaaaaaacgtatttctggctgggcatggtggctcatgcctgtaattccaacactttgagaggccaaggagggtggatcacctgaggtcaggagtgcaagaccagcctaaccaacaaagtgaaaccccatctctactacaaatacaaaacttagccaggcgtggtggcaggcacctgtagtcccagctactcaggaggctgagacaggagaattgcttgaacccgggaagtggaggttgcagtgagacgagatcgccccactccactccagcctgggcaacagagcaagactccatctcaaaaaaaattttaaaaatgtgtttcctcctcaaggaagtgtatgttatctcaattatatgacacatattttaacagaaggtttttgagtaaaattcttgcagacagtctttgtatgaactctagatattcacagaaactagtacgtgcctttagaatttttaaagaaaaaattataatgctttcctccctgttgctctgcattcttaaaatcccagcctcctttatgtctgaattaatcagtgaaatataccaaaaaaaggtagtaaatacagctgttaataccaatttcacatctgtcataaccaattcagtgaaaacaaatctgtaacccccaaataaattccaaagtgattaaagtcataattgcaaattaaaactgtaaaataattaaaaggaactatgtgtgaatattaatttaattatagcatatagaaaacttctcaaagcataagtctaaaggcatagaattttaatctcctgtatgtcaaatttcattataaatatctaggaaggctaaaacaattcaggcaaggggacgatggtaatatatgtatgagaggtgtcataatttttgtattgttgatattcttaatccataaaacatttttgcaaatcaatagagaagaggaatatttcaataaaaaaacacaaacaatttgttaaaaatcaaaagccttgaaaatatgcatatatttaatctaataattccactaaggaatctaacctgaagaactaatcaaagataatacaaagcttttgttaaaagcaaatgcaattgtacctatgaaaaaaagttcattgaaacactacttaggatatcaaaagactaaaacagcttaaatttccaacaatcagagattgtaagttatggcatattcatactttgcaaagcagaacagtaaccctgcataaaatatccaacaacatggataatgtacataatgtattgctaaacaaaaaaaatggattatgtaatactataatgcaagttataatctggatcttcagcaaactattcagatcagctttttctagttagtgagttaatgattttccaagttttccacaataagcaagtattgtatttacaattagaaaagatgatatcttgtaaaacttgtagtactttataaccagcaaatattcttctaatgttaaataaagaacataacctcaagctcacttttttttttttttttagaccgagtctcgctctgtcgcccaggctggagtgcagtggtgcaatctcggctcattgcaacctctgcttcctgggttcaagcaattctctgcttcagcctcctgagtaactgagattacaggcacccgccaccacgccaggctaatattttgtatttttagtagcaacggggtttcactatcttggccaggttggtcttgaactcctgacctcaggtgatccacctgcctcggcctcccaaaatgctgggattacaggcatgagccaccacacccagcaagctcacattgttattttaagcactgattacaataagatgatcagccctacccattcactaaggctgacataatattgtatgtgtgtgtgtgtttgtgattttattacgtgtatatacaatcttttttatttcttattaatataattaggctttgttccccacccaaatctcatcttgaattgtaatccccataatccccatgtgttaagagagagaccaggtggaggtaattgaatcatgggggtggtttcccccatgctgttctgacagtgaatgagttctcatgaaatctgatggttttataaggggctcttcccccttcactcggcacttctcctcctggccgccttgtgaagaaggtgccttatttccacttcaccttctgctgtgatcgtaagtttcctgaggcctctccagtcatgctgaactgtgagtcaactaaacctctttcctatataaattgcccagtctcaggcagttatttctagcagtgtaaaaccaaactaatacacttatattttgcaaattgaaattgtctttgaaggcaattttactttgcaaaattctttaaattgtgaacttctctaaaagaaaatgtgggtcaagaattcttatatgtgtcaagcgtttgtggcatattagtgattgtatatacccctaatgaatcatttatataccctgaaaatattttctgccctcttagcatgtaggggtgcagttcaaaacttgagatatttgattaccatgaatcttggtgcctgaggagaataagctagaaagagctttcctctttactgtctatagcaggaaccacttatatggtatctctctctaattccataattcctttcatcaaaaagatccctaaagtccattatgaagctaattaggagactcacttattttcaaaacccagtccctcttgtttgcccacagctaatatgtggcagcgaaaatgcaatttgatagtttcttgtttcagaaaggagtgaaagaataacttctctaattaaaaccactatgattttgtgggattttttctttaagtgggaggacagtgtaattacacagattggaatgcagccaaaacagtaaagtaaagttaactgcctgcaagtgaaataccacgcaagacattgcctatattagtaaattgttgtgggtggagtggaggtacatgaggatacacaggacactctctattggcctgtgaattgaatctaccactaaaaataagctaaataattattattatgaaatgtgataatcatactcatttttcccctatagtagactgagaataaatagactatcttagtcagtgtccataatttatgtaggcaatgctgcagaggatattattttgtgctggatttggactaaaactggtgtaggcaggtggaccatctatttttgtcagttgattaattggaagttggttctgagtcagtcaacggcatgactgtcacaagggcaaattggagtgtaagtttataggacaggcagcaattagtgtttccagatgttttacatggaatcaagtgaaaatacatggaaaaattaaagtagaagtaattacagtaccgatgagatgctgttaccatatttagagccataactaaaatgctaggtaaagtggtataggggctttacagaaacaaacataaatatgagatcaccaagttgattgtaggctttgctgctctgtaccattaatgctagcatgatggtgacagcaaattgtcttgtgagcagcatactataggacaggaaaacaaagcaatttgggtgctaagattggcatcataactgaaggccctgagaacaaatcttcgtcagttgttttatggagtttcatactgaaagattttttgaagaagcagatcctaggtgtggtggagatggagagatttcttaagttttcagaagtctatatgaatctattattaatttcaccagtactttttcatctttcctccccacccactctgctgtttcttgaatgtaagatatcatcaagctattccagttttttatggacggaagtgtttaactggcaaaagctgaggaaacaggaaagctgaaggaatatattttgagtagcatttattcaaaatataattattaaacacctactatgtgcaaatcattttatataacatagaaattgacaatgaacactcaataaatattgacttcatccttcttgtttactagcaaggatacattttctcagatacaaagatggtagaatatataagaacaaagattatcaaaaaatgtaatacaaaattctaagacaggaattcataacctgtgttccagaggcttgtttgggatttgggcctatgaccttattttaaaatgggtcattttgtactcacaaatgtatattttgcgtggtatgggtctctatcttggaggtaagttcatcatattttttcaagactcggtcacctcaaaaattcaaagaacaattggtttaagaaaaggaatgaacatgcctaataagtagagagcatgatgattagtacagacatttgctaacaacggctttgaaaatgtttaaacataacatatttattacctagttttagaatggcacagaaaaatttcaaggcaagagtaatatccataggaagcacttaacttctctaaaacggaaactgggtcactgaaatactgggaaggaaagaaggaaggtaaaaataacagttaagattcagtcaaggggcttgaaacttctgagacttcagagtgaggatttccataaatccacttcttcatgaaaacactgaaaaaattttcaaattaactttttcagaactctgaaaattagccaaatacatgtaacaatttgaggagtgttttatttattaaaaaaactgctgaacttgagtaagaacaagaaagtttatggctttttaacttgaccttaaacccttgcccctctccccagttttgagtagccttaaaaaacaacagtcttggagcactggagggggcagtccaattttggaactcctcaaatagtagcatccccagagtagcaccactatttaatctgtcttgaagctctctggaaaagctgtattcacagggcattgtcactatttgacctgattcagaaaccaaaagccctatctgcagggcattgttgaaagcaattacaacagcaattgtttaacatcacagatgacacagtaccagttggggtgaacaagagcctgaacaaaaacataaaaggaagacctgccaatgagatatccatagaggtctttgtaaagccctgacatattgtgagggatttagaagccacatgtataagtagggctgtgtgcatgctgaagaaagaccaaagagtgccccagtccctcatctctgactgatgttgagcccctgtaccaggaggaagtgaaggcaaaggcagaatttaaaacttcctgagcattactgaagttccccaacacacacaaagcctcttggcaaagggttgacttactggttcacagtattctaaaaaatatctgagcaatcactagctgaccacttagctaatcagagacttcagttgttgcccaatagagtaagtacagactttacagaattagccctagaaaatctctaaacaacaaacagcaacaataacaaaaatcaacaacaaaccctggggaaaacatctgactttcagatttgccacattttatgatttgcaatgtccaatttttaagagaaaaattgtggtgcatacacaggggaaaagaaattgtcaatagaaaatctgttacctgaggggacccagattttagacttactagacagactttaattaagctattataaatgtgtttaaagaactaacaggaatccttttcaaagaattaaaggacagtatgacaataattcacccaataaagattatcagtaaagaaacagaaattaggtcagttgctgtgactcacgcctgtaatcccagcactctgggaggccaaggtgggtggatcacgaggtcagcagtttgagaccagcctggccaagatggtgaaaccccatctttactaaaaatacaaaaattagccaggcacggtggtgggtgcctgtaatcccagctacttgggaagctgaggtaggagaatcacttgaacctgggaggcagaggttgcaatgagctgagatcatgccactgcattccagcctgggcaacagagcaagactctgtcccccaccaaaaaaaaaaaaaaaaaaaggaaacagaaattattttaaaaacacaaacagatattctggagctttaaagcataataactaaaacagaatatttgagtttactcaacagcatatttgagttggcaaaagaaagatcaaaagaaagaaaggttagtgaactttaagacaggtcaactgagattacctagtcagaagaatagaaagaaaaatgtatgaagacaaatgaatacagtctcagggacctgtgggacaccatcaagcatatcaacatacacattatgtgagctccagaaatagaaaatggagtgaacagggcagaaaaaatatttgaagaaaatcatagccataaactccccaaatttgatgaaacacataagataaagtcaaggagacccacacctagtcagactgtcaaaagacaaaggaaaactgttgtaatcaacaagagagaaaaaagactcatcctgaaaaaaaatttaatgagattaatggctgatttctcatcagaaatcagggaggcaaaaatacagtggaactaacattcaatatgttgaaagaacaatactgtcaaccaagaattctatattcagcaaaactatctttcaaaaatgaaggagagattgagatattttcaggtaaacagaaactgagagaatttgttactagcaaatcttccctgcaagatttactaaagggagattttcaaactgaaatgaaaatacactagacagtagctcagattcacgtgatgaaatacagagcctccagaaagataagtatacagtagtcttagttcattcagaatgctataataaaaataccacaaactgggtggcttaaacaacaagtatttgtttctcacagttctggagtctgggaattccaagatcaaggtgccaacaggttcagcatctggtagggtcccacttactagtttatagacagctatcttcttgctgtgtccttacatgacagaatggggtcagagagttgtctagggttcttttaaataaaggcattaataccattaatgtgggctccactctcataacctaatcacctcccaaaagccccacaccctaattctatcacattgggggtatttcaatatataaatgttaagaagacacaaacatttagtccagtgtaataggtaaatagaaaaagtttaactgtaattttatgtaactcttttcttctttcatatgatttaaaagacagttgcagcaattgttaaactgtgttgatgggtttataatgtacaaagatgtaatttctatgaaaataataatacaaagagatggggagagagtagagctatactggagtaaagtctcagtatattattaacttagcgttaatatgaactagattattttaaattaagttgttaagtatagttccagagcaaccactaagaaaatagctaaaaaattatagtaaaagaaacaacaaaataattaaaacggtacactagaaaatatctactgaatacaaaagagagtagttttggaagcatatagaaacaaagacataaaaactgtagagaagagctactataatggcaaatgtaaatcccaccttaaactctctaataaaaaggcaaatgatgtcagaaaagattttaaaagtgattcaactctacactgtctacaagagacacattttagattcaaagaaataaataggttgaaagtagaaaagatgaaaaatacactatacaaacagtaaccaaaattaaaaactgtgagaattaaaggaaaaatataaataatttaaaaattatagttggagaattcagtatctcactatcaaaaatagatagaacacctaagcaaaaggtcaacaaggaactagaagacttgagcaacactacaccaaccagccttaaacatctataagatactccattcaatgacagcagaatacacatttttctcaggtagacacagactattttacaagatagacaatatgctaagtcattagacaagcctcagtaaacttaaaagaatttaaatcatacaaaatatgttctctgaccacaagaaaataaaatcggaaaccaataacagagggaaatttgtggaattcacaaatatgtgaaaattaaaaaacacacttctaaataaccaatgggtcaaaggataaataacaagtgaaattttaaaatactttgaaatgaatgaaaatgagaatgtaacatactaaaacttacaagatatagctaaaatagtgcttagagagaaatttacatctgtgaatgtctattattacaaaacaaagatcttaaaacaatagcctaatcttccaccttaagaacctagaaaaaggagagcaaactaaacctaaagcaagcaaaaagaaggaaattatttcaaaagttagagtaaatgtaaatgaaatggagaattaaaaaaacagagaaaaatcaaagaaaccaaacttggtttttttgaaaagatcaacaaaatgtataaactgaagctagactgaccaagaaatagagcatactcagattactgaaatcaggaatgaaaaaggagacagccctattgtccttataaaagcaaggataagaaaatacactattatagtatatattcttaaaagaaaatacactattatattcttataagaaaatacactattaacaaccccataccaacaaagtggataacttagatgaaaccgataaatttctagaaaaacacaaaataccgaaggtaactaaacaataatggaaactgaatagacctatagcaagtaaaacaattaaattagtaatttaagatattccagtaattaaaaatttccaggcccaatggctttatgatgaattctaccaaacatttatgggagaaataaaaccagttctacacactttacacacacacttctgaaaaatagaagctaagagaacactttctaaatcattccatgaagccagtaataccataataccaaaaccaaataaagatactacaagagtaagaagctacagaaggggagaaaatatgcacaaatcatatatctgagaaagaatctgtatcttgaatatgtaaaagacttaataactcagtaacaaaaagacaaccgtagacaatggattttgatagacatttttcgaaagaagatataaattattaataagcaaataaaaagatactcaaaagcatttgtcagtggagaaatgcaaatcaaaattacaatgagatacaactttatacccactggggacagctatgataaagaaaaatagacaattaaaagccctggtaataaagtagagaatttagaaccctcatacattgctggtgagaaggtaaaatagtatggccacttcagaaaatagtctggcattatctctattcaaaagaaataaaatcatatgacccacacaaaaattgtacagaatattcacagcatatttttcaaaatggtcaaaatcgggaccaatcaaagatgaatggagaggaccaggtgcgctggctcatgcctgtaatcccagcactttggaggcagagatgagtggatcaccttaggtcaggagttcaagaccagccttgccaacatggtgaaacccctgtctctactaaaaatacaaaaaaaaaaaaaaaattacctgggcatgggggcgcacacctgtaattccagctgctagggaagctgaagcaggagaacggcttgaacacaggaggtggagattgcagtgagcccagatcgtgccattgcactccagcctaggtgacagagaaaagctccatctcaaaaaaaaaaaaaaaaaaaaaagatgaatggagagacaaatatgatttggtatatataatggaatatcatttggcaataaaaaatgaattactgatgcatgctcaacatgtatcaaccttgaaaatacaatgtgtcaaggatgccaatcacaaaagtacttatgttatataattcaatttatatgaaataggcaaatttatacaaaccaaaaataaattaatggttgcctagatctgagaggctgaaagaaatgggggatgactggtaatgtaggtaaggtttctttttggggtgatgaaaatattctaaaattaggttgtagtggtggttgcacaacccaggtaatatcctaaaatccactttagtatgtcatttaaagtaattgtgcacttaaaatgaataaatttcatgtaatgtggattatatcttaaaacaactggttttaatttttttaagccaatgaagaaatgaagtgctagtttttatgtttattgcttccatgagaatattatcatctagaataacatgtaatgtattgagtatcaaactccagcatatcacctaataatcacttggccttaaacaagttacttgaatgttctcagatcctggaattttcacttaaaaatggaggaaataatacatcacaggggttttgagagaatgtattaagtaatggcacactttagatccctaatgaatattaatttccttcattccttccatcaggggccatacactcaagagaaaaataatagtcagggacaattcttaaattacgaatagggaattcaataaatacaacaaaccaaagattatatataaattttatgtttttgccaatggaggggaaagataactaaatgaggcaaggagaagaagaaaaggtggatagggaaactgcacgaaaagagagagagaagtcagatgaacaagcacaatgaaatagactcaaagaataacaacttatgtaattttaaaagacatattgggccaaattaaatggtatttggatcattctaattaaaattaaaaccaggctacatttgcttgttcagaaaaattcatctaaaggtggaattttgctagtggcccacagggctttatatctcaatttggtttggaatctgatgaggtgattaagtagaaaaccatagaaacataaatgtcaccaatagaactaagcaaatacgtaacctctactgcactatcaaattttttcttgcactaaaaatttaaagcttttttattgacttttcattgtattaattgtatgctaaagaaacttagaccaaaatatactttcatttgaatgagtttcaatcactggtcttagaaagaacattcaataatatttgataggattttaccgctgtgaatggattttttaaagaaggagacatactatatagaatagcagtataaaagaatataatcactgaaagactaatttgtagttttgaagacatagcataataaagttcttacaatataataacctagtacatcataggctgataccatactagacagtacatcgcaggctgaatactgttctttcatgagatttatctttgaaaataaaagtcatctagtttctacaattaattaatcgtgtatccttacagtttatattagctaaatattctcagaatacaatttttaagattcttgttttatctacatcgcaaagtttattcttcagtttttgcattttcagttgcattaatattatttgaatgtgggatagataggatatgttttaaattcttgctattaagcattgatattggggcttaataatggtttctctcaatgtcctactcagagcaatttaagtcacataatcccgaccagaagcgtatctccatggttgttttctatatccctagtacagcagtgataaagccatgaatgctgaatgtgccgtgttttttcagccaacaatgggcaaatgacatttctaaagctatgtatcagttcctacttctcatcattaatcccctgtcccttccaaacctcaactgttgctttaaaaaaaattaagaagacaacaataatctcttaatgacaccctgcagcagctttatggtggaaagggaaaggggtcatgtttactggcacatattttctttgagtgttttctccctttcgcagctcccatggaaaatttgctaacatatgtacttgcttttgttaatggcaatagtagatttaatgtgtttaattccctgctcccttttcttcctctaagtggaaaagacctctcaagcagtgtttatgtttcaccttcaaagttttagctggaaaaatgtttttccgtatttaatgaaagtttggtgactttctaaatttaagcaatttttaaactctgagtttaaaattcccccatctctaaaatagagatatacctaacaataatagccttttgtggaagattatctgagcaaaataaattagaaacatctaacaatatttcttattatttttataatcttcattctgagcccagattctctagcaaacagagaccaagataaaagcttattggccattattttattcaagagtataatttcagggaagtaggaggaaggaaaaagagagatggcatccaaaaagtgagaaatatatatatatatatatttatatttatatatatgggattgcaaagcctgacgcatcttggtaccaagcaaactgcagacatttttgacaatcttaagctaaagcctagatgaatcactgcatctcagggcaatccatttggggaaataaacagaaggattgatctgctagttcccatctccttaagttcaaagattcacctcgagggacattaacttccccacacttccaggtggcaagtgcctggattctgagatccctggaatctgacatctcaataccaacagggaggccctggaacaggagggaagaatttcaaagcacaggctgtggagacagaatttctgtcagaattgtccatctcgacttctcagagcccatgctggtcacaccgcagtaacagggccctccaagacaggtgaggctgaaagaatggggcaggcacagagaattatctgattcactctcctttaaaacaaaaggcaatatattcatttgtcaagtgacaggaagtcttttgaatcaatgtattcttgttctgtttgggagttaaaggcagtataaagaagcttgattataatcacttacaaaaacctatgaaaaccagattttttaagatgttgcaactaagtacaacttctggcttttattataagtctttttagaattgtatttttaattgacaaataattgtacatatttatggggtacagcgttatggtttgatacacatatacattgtagaatagtcaaatcaggctatttaatgcattcatcactgcacacacttatcatttctttgtggtgagaacattaaaattcactcttttagcaattttaaaatatacaatacaatattattaacaataatcaccacactgtgcaatagatcagcagatcttattcctcctgcctaactgaagcttcgtgttctttgaccaacatctcccctttccttgtccactccaaccatatcccacagcacctgggaaccactactctgctctacttctgagtttgacttctttttgattccacatgtaagtgtgatcacatagtaattgtttatctgtacctggcttacttcactaaaaataaagtcctccatatctatccatgttgtcacaaatggcagaactttcttcttttttaagaccaaatagtattccattgcatatatataccatgttttaaaaaatctatttgtctattgatggatgcactctgttcccctttcttggctatcatgactaatgctgcagggaacatgggaattttacagcgttggcttttttatcaacataaatgacttaatgttgatgataaaaaacaatgctgtaaaatatttgaagaggttgattctaagccaaatatgagaaccagggcttatgatacagcctcgggacatcttgagaacatgtgcccaaggtgattgggttacaccttaattttaaacatgttaggggcacagaagctacaggcaaagacataaatcaacatatgcaaaacatgcattgttttggcctagaaaagtgggacatctcaaagcaagagcttccaggtcataggtggattcaaagattttccgagtggcaattagttcaaagagttaaggtttgctggtaaatatctcttattagatcttaaaaggtgtcagactctctggaaaagacctaataagggaaagagatgctctatagaatgtaaatttcccctacaagagatggctttgcaaaatcacttcaaaatacgtcaaagaaatctattttggggtaaaatactttgatttccttcagagtctgctgtcatgtgatgctatgccaaagtcagggtagaattgggcatcttatttccacacagagtctgtttttcagtcttatgatctctattttaatattaatgctagtcagttgtccctaaacacaaaagataggagagtataataaggcatgtaagacttcccttccagtcatggcctgaactagattttaagttttctttgggatcctcttggccaagggggaggaggtccattcagttggttgggggccagggagctagaattttatttttgatttacaatgctgatttcaattcctttgaatatgtacctagtagtgggattgctggattattataaatttttatgtgtattacaattttgttaattaggtcactgtcttagttagtttgaactgccataacaaaataccatagactgggtggcttaaacaacagaaatgtgttttctcatagttctggaggatggaaaagctaagatcgaggttctggctgatttgattgctagccagagctctcatcctagctggtagtcagccaccttctctctgaattctcacatggcagagatagagacttctctctctcttccttttcttataaggccaccaattttatcaaattaggaaccctccactttataacccttttgactttaattatctccttaaagtcctgtctccaaatgccgttacattgggggttagggcttcaacatatgaatttgagaggaacacaatttagtccacagcatttgcatatcacagaaaacaaatccatagaaatgttaatacaataaagaatttgagtggtttaaaacctttttatttttgtgaatgctacaattaaaatatttctgcgtgcaaaaaattgtgagtttttcttgtatagagtaaaattttctgatcttaaaagcaagacctatgacaagtagaaaatattaatgaacgctgaaagcattatatccttgtcattttcagataagaaaactgtagttagtgatgcttttcaaaattgttacatttgtgaaccagcaaatgtatgcacacaggattatctgagcctaaacatagtgtcataaccttaaattgaataagttagattaaattatttttaccagaaaatttatggctgatttccatacaataatccatttagtcaattcaacaatttacagggctgaaaatatttattgtaacttgaaattcattttatttcaagcaattaaatcacccagaatcctccagatacaaagtgtgttaaatgtaacctttaaaatgaatgaatgagctgaagacaataagggaagtccagggagcagaggaaaaggcaagagcagggtaccaaggagaagtataacgttgatgcttcctcacaacttgagggcaactacggattcagacacctggagtttgatgccagcacaaagcaggaaatcggactggagatcaagtcatacacagctgggacccagaaaggtatacacttggccttggagaggaaggaggttaggagagagtgacttacaagaaaacatgacctgcagtgataaagagtatagaaggatagatgcagccgggcatgttggctcacacctgtaatcccagcactttgggaggccaaggtgggcagatctgaggtcaggagatcgagaccatcctggctaacatggtgaaaccccatctctactaaaaatacaaaaagtagtcagccatggtggcatgtgcctgttgtcccagctactcaggaggctgaggcaggtgaatcccttgaacctgggaggtggaggttgcagtgagcagagatcgcactactgcactccagcctgggtgacagagcaagactccatctcaaaaaaaaaaaaaaaaaaaaaagaagaagaagaaggacagatgctagatagatagatagatgatagatagattaaaaaagagatatagagataaaggtatatttctcagccttggttctgggtggaggtttaaaaataatatttccttgagattttgtaaatgtaaactaagtcatatttagggttatggagccagaaatcacactaacagtagagttcacaaagctgcagagaatattttgtttgtgatgaatctagatctttctagcacccaaagagatatatcccccactcaagtcatccagaactcacaaatatgaactcaagctcaaagacacacaaaaaaataaggaaacaagcctcaaagtgctggagtctacagaaacaacaaggaacataaccagttgcatgagatttcagatatttgccttatcagatgcataattaaaataagaataaatgaatagatgttgtatttaaataaagaagaaataaagaggctaccaaaactgatcactcatatttgaaaaagaacaaaaaataacttctacttctgagaaattttaatgaataatattaaatggagcagttaaccagtagaatacaactgacaaaaagattatgaaataaatataaacaaatatgcatatacatatacatatatctgataacctgaagtatatttattgatatatatattaccttatatgtatgcatgtgtgtatcatgttgaactatatgaaattgccatgttgtatggcaaaaacagtcacatataggcaatttcatatggttaagcctatatatgcatattggattgaagatgcactgtataatataggttttccatataaaggtgaaaaaatattcttttgctctaagaattctcagagttctgtcccacagcagatagcctacatgagagtaatttttttatcagaattgtggaattcacacacaggtcatatgcttagttctgctcatgataatgatgctcaatagttaattggctttgtcaggcactcgtctatatcttcccaccttcctctccaacagtcaagtttctagacccaaggctcttgtttctccaaaactgcttgcagaaatagctatgccttctttgccatttattttaggtcaccacttattagtgacatctgatattagattcttgtgagatgaagattggagactggcttaagtatctgtcaggaagcttctctattttcagattatattgcatacaaaaaccttgcaagccaaatctgtttcagaattaaaataacatgagcaacctcaagaaaaattattccatgtgtgcacacgtatcaagaaaaacactgcttccatcatgccaccccacttcattgcttgcagggatcattgaaattcatttactcagtgatcagaatctcctgaaccctgcctccagacctcatttccaaacatacaccctaacctccaaaacaaatttggtctttagccttgtccaataaaaatagttattgttaaaagtccaaactctttaacatgctattttttaaaagcccggggttggggaggggggtgggtaagggatctccttactccacagaacttctaatttcccagacaatcagttgttcaagaacacaatgccattcctcatgctttctttgcctataagctgttctcacccacttggtgaaatctacttcccccttcataggtcaacccctcagtgaagtcctccttgatgtcttcagcagcatttaatggtttttcctctatgtccccttagtactttcttcatatctctacttgtctctcccactagactgtaaattcacttttgtcaggaccatgccatctgagtaccccagtgtctaaaacataacctggtactatatatttctgctgaataaatgaattaaaaaacaaatgagtgcaagttatttaaatcagaggaatcatgatagaaacattaatattttaatatgtaacagaccacaagaatgttaaaagagtggtcttcaaactcaaaagtgtatcttcccaatgacaccagccttagaagaacagtttctgtgttactattgtcatgctggaattcaaagggtttttcttggttcttatagagactagagcagtacatctccaaggctaattattcttctgatctcatggtttgatttatgtgaattgtgacaccctataaggaaagtaaaaagagatccacctagttataaacaatgctcattatagaacaacctccagccgagccaatgcagaaggcctcagggaatactaaaaaaaagatagtggattttttttccttgcaagcacaaaatattttttaaccataaaaagcaatgtgcaggtttgtcatcctggtgaaaggatgattaatttccatcgtgttagaatataacatacggattaccctagaaagttttaaattttaccaaaaaaaaatcaaggaaaaaatgtaaattgcagaatgattattgcatataaattttatatacttcttttagataatatagaagagatagccactcacccaccctgagttttactgtacaattctgtttttttaattgaaactgcactgaagcttttttcttcccgtgttttaaactgtgctgaaattataagatttgaaaagcctttgttaatagctagagagtcctgccattaccgaatgccaagagaataatgaaacacctaaaatgataaggcactagtgtctgagcagaatagacctttaattggaaaaagttcatgcattaatattcaacattaagtggtgattaatagatacaccatgtgggtattttttattttaggaggatagataacagcatgtccaattttaatgtaaatctagtgacaatttcagtgtgttattctaaaatgctctatctgattagtttcagaggcgtaaaaagaaaatcttttctagtgagcacatcctccgtaagtgttaacagcaaagctccttaaaataattttgttctctgaaattgttgccatagctagctggaagagtttcatgtttaataaccacatgtgatatctggttttttttaaatgaaatccgcataaagtgttcattttttctccattctagaaaaaaaaaatctactcttattgacctctttccttactctcactgactgatcaaggaaaaaggttttattttctctgtctttttatctattttgatggtatttttttttccaacgtgattgtgccagtgcactccagactggatgacagagcaagaccctgtctcgaaaataaataaagaatttttttttttttttttgagacagagtctcactctgtcacccaggctggagtgcagtggcgcgatctcggctcactgcaagctctgcctcccaggttcacgccattctcctgcctcagcctcccgagtagctgggactacaggcgcccgccaccatgcctggctaattttgtttttgtatttttagtagagacggggtttcactgtgttagccaggatggtctcgatctccttacctcatgatccgcccgtctcaggctcccaaaatgctgggattacaggcgagagacaccacacctggcctctccagggaatctttaaatagccaggtaataagaattctcagagtgaatagtacactgaatgtgaaagtgaagaatgacatccaggataacttttctctctttgtattcagggggctcagtctattaataaagagattttgtctaaccatgttccccacatattgctgtcaatagagtaaattgctgttatccatttaatgtgataagctcattatttctcacagcttcatctatcacccaatcccatcctttcaccttaaatctagacttctaatgccaaacaccttctggatagaatttgtgtttaactccacatctgaggttaaattttaatctacccaacgaatgtaggtttccttccaacattgcctgtttcttattaacacaatcagttagttaccctggctcaagaaattgagaagaaaattggacttatttgatccttcacttcatgtttctagagtctccaaatgaaagtttccttaaaaaactttttcaagccttgttttaatctagatcccacaccaaagcagaacaagagaccaagtcttatataaagttagtttatttgagaatataattatagagaacatacatgagaggcagcagttttgaccagggaaggagaaaaaaaaattcaaatcatgctattgatgagcttccccaagagcaagtgttgctcaatctcacaggattttctggggagccttatgaaataagtttgagaactaatagcttagggacaacaggggaaagcatttatccattggtccccatccccattacttaaggttggaatttaagtaatgcacttctgcttgtgcatgaatgaaggccaaatgtggtcccatggtgtattagtctgttttcatgctgctgataaagacataccagagactggataatttataaggaaaaagaaatttaataaactcacaattctgtgtggccggggaggcttcacaatcatggaggaaggtgaaaggcacatctcaaatggcggcagagaagagaagacagcttgtgcagggaaagtcccctttataaaaccatcagatctcatgaggcttattcactatcacgagaatagcatgggaaagacctgccacctcccagtgggtccctcccacaacacgcgggaattatgggagctacaattcaagataagatttgggtggagacacagccaaaccatatcacatgggtatcccacaccatggtaccagagaagtctcgtggcagaaaataagaattatatggtctaggcccaaagtgagataccataaggctggactggggcaaagctaattgaaacatttattggaacttattagcacagcagtggctgggtaagagatggtctgagaggataagaaatggccaatataccctgtcttagtctgctcaggctactataacaaaatgccatagactgagtgatttaaacaacagcaatttatttctcacaagcatgaagtctgggaagtccaaggtcaaggtgccagaccattcagttcctggtaagggtccttttgctggttttcagacagctgtcttcttgctatatactcacatggtgggataaaatgagagtaagctatccagtctcttcttatgaggacactaattccatcaacgaaaaccctacccttatgaccttatctaaagtaccttctaaaggccccagttccaataccattacattgggggctagagttcaacaaggaactgtgggaggatgtaaacattcagtctataacacagcccatcccttgcaccattcagatccaaaatgccttttataaagtgcaagcaatcatagagttccccttcaagttcatttaagtcacaatctctgaaaaggtttagtaccagttattattggaacaaattccagtcttcactattgcagccaatttcaaggtcataattcatatttataatctcccttctttactgtttattctattcatttccctcaccatttgtaacactttggctggcctagggttctttgctagttggacccagacttttacacttgagagatcccagctcttagttgagctgcatttgttatatttgtccactcacattttccctagacctggaaacacagatattcacccctcatgaacactgcgattccacacacactccttcatgtccccattgcatctcaccaatcctagcacttcgtagaaattagggtcagtccctctcttagaatagtcattactcaccttggctaccgcaatggcatgggcagcctaaagtgaccaagtggtagctgtagtttcaacttaaagtgagacagagtaaaggttccactttgtcttctggtcaaaacaatctctttctagaaattaacaccatgaatcctgcaaaacctgtttgtggggatggggagcacagatttcacaagtgggtcactgggaatgatagtgagatgagccaattctacttttgccccttggttctgggaccaatgtattttagctactccagacagcaccatataacagccatcgattgagtgcatgtatcacatccaagagaacagcaacccaacccataaggtattatacccaagtttttgtcttcactggggcctctagtaaccattcaattattctggttctaaatgatgagatatagacagacaagtgggctgtgtgtttatatgcccattcttcagtcttctgtatcataaaactagtctcctagactgagaaaatttagtgtaagaaaccatacaaatatatgtatcagatgtcttataagccctaggacaataatgatattagcagtgaccccagaggaagaaaaggcaaatccgtatgagaaggtgtcaattcatgagaggattaatttctgctcctccagggaaactgagtctaatataatcaacctgccaccaactggctatagccatattcttgaagaatggtgttacaatgagggcttagcatcattttgtgtgctggctagttggcagtagttagataagctttaaagaaggggagcccaggccaggcatggtggctcatccctataatcccagcactttgggaggccaagatgggtggatgatttgagatgaagagttcgagaccagactgaccaatatggtgaaactccatctctactaaaaatacaaaaattagccgggcatagtggcgcacacctgtaatcccagctacttgggaggctgaggtgggagaattgcttgaacctcggaggcggaggtttccatgtgctaagatggagccactgcactccagcttgggtgacagagtgagaccctgtctcaaaaaaaaaaaaaaaaaaaaaagaagaaaaaagaaggggagccctgctgtagaacctgcatagatatctccctattattgtagtcactctgttcatggccccatcctgctagcactggggttgttaaaggaagaggcttgctgacatccacaggacaaatcttatgtatctggttaatgagtgcctcttgtgaggtagatgctccctgatgggcattaaaatgagacacaaatgaacactttgtggtcactttcatagatccaattgcatgtatctttctatgattttgttgtttatttctaattgtctttctttggagtcttaaccaactagccaaaccattaactgcccagaagcccaaaactcagatcatgttttcttgcatgcagagcgaactccctattgttatctttgaagttctgccttccacatgttttcttggagccatccttggatgaacctatagtgtaatgattaaccagtaaaactaacatgaaaaaaaaaatcacaccaacatgtctatgaatcaggctcaaatttctgattcctttgtcatttagtcacagggaagcaaatgatgccatagctatgagtggtgggtaagagactggtacctcacagataccttaggagttttcccacctgtttgtataatttactacatcttctggaacttctcaggcccaatattgaatagcacattcataatggatcattgctcttcctgctcaactttatgacatagtagattcgataatatccagctcagtcccatagtcaatttgtgttccaagattgtgcatgcagcctctaccagaattcagtatcatgtcaggtcaggaattatttttcaaatgttccataattctctgttatagaatgaatggccttgctctagtacactaggattttttttttttttttctgagagtcttctgtttaagtttgtcttctgcaacatacaggcaacttgccaggacatctaaaatcctacccagttcttcctaatcatgtcaaattaccatttatgtcactgtcttagtcagctttctgttgctatgactgaatacctgggactgggttatatatgaagaaaagaaatctatttcttacaattttagaagctaggaagtccaatatcaagagatcccatcttgtgaaggccttcttgcaggtgaagggggactctgcagagcccagaggctatgcagggcatcacatggcaaggaggcttaagaaagagggcctatctggctttttataacagatccgctcttgtgacaaccaaccaactcctgtgataacccaatgatctattaattcattaatatattaagccatgaatggactaatacattcatgaggccagagccctgatgacccaatcatctcttaaaagccccacctcccaatactgttacattggagattatgtttcaatatgagtttcagagggcacaaacactcaaaccacagccaacatagtgagccaacaggatgtgtttcagaatattaaaatgatgaaagtcccaaagactgtttagtgacagaaagcaggagatttaacatagctctgagataaagcaataaatgtatattattcttcatctgtgtaagagtaatctgctttatttctcttactgagagggactgagggatcacatccaccaaaccagtagtgccaagcagcggcataccaagtgccagaggctgagttgatccattcttgaaaagatactaccttcaacttgtaatttgtataatcatttagttactttttagagttcattgtcatatgccccgatctattggttttattcataggctgaacaagaattaattagtgttatgaggggactaataacttatgcaagtcttaagtatttaatagctgtgttaacctctgaaattccttttgccatgcagtacgatttctgattaccatctttgctgaaatgggacaaggtggggatgcagattaaggagattttacttggcctttccaaatataatggctgctgcttcataatcaggtagtcagtgtaaggttcttccgtctatagagtatatttatccaaattatatatttaggtacctagggaattaactacagggcttgtctagtttctgtaagatttatttgagatagacttcaacccaaactctacttatcaactgaagacaacacaggaatgaaagaaatcccacctaacagaacagatgagaactctagtaacactactatttaaaaaggcggcaaagaaaaacactcagcaaaagggacagaggaagagagatcagaacagagaatgaatgagagtaatatgcaacaaacctaggaaagaaaatattttaaagagaaagaagtgctcaccaatgtgaaataccactgagtatcacaatgggataaagaatgaaatgaggcaaatagttgtggaaaacaggaagacattattttcctttgctagagcagttgaagcagaagagcaggagcagatgtaggatcacggcagggtgagaagtgtctggaaactgaggaaatgtaggcaatcgagtttaaatatttcagtaatttggcccttggaaagaggaagggtgaggggatgatggcttgaagaggaggaagaaacaaagcaaggtttttgtggttgttcctgctgctgttgtttaggattgggatggtattaatatgtcttaatcagatcacaaacataagtcaaaatataagagagttcacagagattcttctttatcccaaaagtctccattcttctaattagaagaatgttaatgataaaaaaaaaatcttcctatagtctctttcttgtattagaatcattggtctcttatattggctgttttcatgtcctatatcttaattttattttcttattgctggtggcttaatgtagtaaattttgcaaaactattaaattctagactacagcatgagagaagaaaggaatagtcacaattacctggcctaaattgaagctgttcaaatttgaattattattgcttttgaggagacagcagcctatttcagtttattgttccttaatatatgacagcactggacaattaaagatcacacacacacacacacacacacacacacactgatgatggaaactcttgtattgcaaaatgggatattctggtgtgccagaaaagattgattaagcaatgaacctcagacaaagtgtatggttgtttccaaataatcaggcctttgggattattaaggttataaatgaaagtaggtgtctaatttctgatgaatgcatttaccactgtgaacacagatcaccagtgtgcacaagcatacatctgtgtgtgtagtacactgtttttagaagatcccatattctatagaagttaatttcctttattgctttttattcatagagtgactctgaatgtgttctcatagaaataaatctgaatatatgtgatgtgtgttgtgaagatgtgtgtgaattcatacagaaatacgtaggttcaggtataaatgaacatatttgggcatatatatttgtgtttgcatgtgaaaattaaggtttagtgacaagtgctgaactcaattgtgttgcacttgtgtctttaaatataataaaacattttcttttaaatgttggaaaataattattaggcatgtatcattaactgataaaaacataaatttcttaagaaatgctatagccttaaaagttactaaattacaaaaaaaattaaattggagttattgaaaaaaaattgctctaactcagccctcttttatagtaaagtattaactataaaacatgtgaatccaaaatattattcttaaattgatgtgatattaatgtatgtttaggaaaaatcaaaagggaattcttcattgaacaaggaatctagtaacagcacttcatagagccacatcaggcacctacaggctcattctctattaagtttttcatctaacataggctcgctcttcaacactgtatggacttttatgattctatagaggaagaaaataaaatggaagtcaaggaagcatttttattaggccatttactcctcttaatatagtctttccctttgagcatttacaataaaaatggacttaatcttttgccttcccatgggaagtctaacaaaaaatggaattgtagaaagaccacatatatcaaagtatttttagaaactgctctttcaggaagtggctaagttctatggctgatataattaagtcaatctcagggagcttcaccattttttgacacccagaagcttagctttagcatgagttggaattttttttcttttcttataatgcgccactaaattctaagaccattagataattgtcctcaatagaaagttcctgtaatacattgaaatcatataatattttagccactggcatatcataaaaatttataacccaaagactacatttatttctaattatatttgctttccttagccaccaagatctaagtaacagataatatttatatttctaacaactgtgttttatttatgcaagcgaagaacagaaataagctttcattaagaaacaactatgtgcctgccactgtgaaatatgctttcacatatatttctgactccttgcaataaccctaaaagattaatatcattaactcattttatagacaatacaaccgagaagttagattcagatccagatctttctgattgaaaagcccctactttggactgacagagagaatgaagacttacttcagtttgattgtcttgaatgggcttcagttattcactgttctccaagccagccacacttgcctgaaattggatttcacaggttcattttacctccaactgagaatatggacatccacaaccctcagtgctggcccgtggaagtctcaatgacccacaaggcatagggtttgtggctttggtcctggttcatgtatccatcaaccaaccattattgagcacctagtattttaggggctaggaagaaaacagaaaaagtttcagcctttgtggatcttacattctatcagttctatgtgtttaggtgtagggagatatagataaatgcataaataagtctctgaatactctttgaccaacatcaccaaaaccatacctgcttaaggacttaaatctttttaaggtaggccttatggaagttggggatatgcattattatagcaatggattaccatctgccttgacccatctacaaaccaccccagtttgtagttaccctgaataatttaagagtcaaaggaataaaccccaagtcaaaaccagtgtccccaaaacaggggcatgaggcgaggcaagggttaattgttgctcccaacacagtgctgctcccatctttaatgtgaagataaatatgagagcgaaaaggagaaatctaaagtggtcgtgatgggtctgatttaagtgaatgggagccacttcaaatgctaacaacatcattaggagcacataaataggctgctcattgtgtcggtaaaagcggttgttcacagcagcacaatattgtttgaatgttcgaaacaatctcttaatataactccccaccaatttttgttttggtttagtgtttttaaatcatagttctttggcaccctgaagaaagtcttgttcccatgtgcatttttactttctctcgttatgttttgtctttgaccttctgagcgcagtggagaaaacagacgtgttccaattccagggctactatttatatgctagctatagctatactttttccaaaaaaaaaaaaaacaactctccgaatcttggcttttaggaagttcatttttactatatgaacaataacgcctaccacagagtgttttgagaatcaaatgaaacttaacttgcctaaatgcctaagtaggcatctggtaaatttagctaaatccctggaatatctgttcggtttcaacaccatatgaatgtaatattttacagaaactctttttttttttattttgcgcctgattcaagtagatcttcaatgaatatttatgaattaaatattttcaacataatgcacataatgaaagtaactatgtacaacttgatggttgtcatatttggggcatatcaaatcattgtaccatgagtgtattaattcaggatcaaaacccagttttcttagtactttttctctttagagtgcggctcaacactagaagagctctttaaacatcagagctgctccacaatggaatgaattggatagttaggggtaaactccacatttctgcacatattaacaaaaaggctgaatgaacacctatcaagaaggtggtcggacaggatttccaaattagttgaaattggccccaaatgacttccaagttgtcccctctcaatgatctcataatactaaatacatagtgtttcatttagatgcaagtaagaaaaaagaagctttgatttcctattgcatatttcacaggggtactttgagcactactccattccaaattccctttatagaaaataataatccctcacaataaaattccctgccaaggcactattctgagctttttacatatattaacatatgtagttctcacaaaaaccctaagaggtatgtactggtggtattgctctgtcacacataaagaaagtgaggcacagaaaagctaaattacttgccccaggtaaagtaaaaaagtaattgttggagctaggagttgaatccaggcagtccagctctgaagcccactagcatgcagtaccaagggcctcacataataaaatctggcttctcatagatccagactttgtcccactaatctagaagcactttgaaggcaggggccatttctgttttcatttactactgcacctacagtacctgacatataatcgttaattaatgaataattttgtttcatgtataaagattatcacttatttttcatatcttgtgtcatagaaaaacatattgcttagctttcataccaaggtattatttactatttagaggtaagaagtgtttcagaaatatttgtactgcattcagaatcaaaagacctttggcccggcacagtggctctcacctgtaatcccagcactttgggaggctgagacaggtggatcacttgaggtcaggggttcgagaccaacctggccaacatggtgaaacctcatctctactaaaaatacaaaaattagacgggcgtgttggcgcatacctgtaatcccagttactcaggaggctgaggcaggagaatcgcttgaacccaggaggtggaggttgcagtgagcccagattgcactagtgcactccagcctgggtgacagagcaagactcttgtctcaaaaaaaaaaaaaaaaaagagccaggttcgagggttcaagcgattctcctgcctcagcctcctgagtagctgggattacagacatgcgccaccacgcccagctagttttgtatttttagtagagacagggtttcaccatgttggccatggctattcttgaactcctgacctcaggtgatccacccgccttggcctcccaacgtgctgagattacaggtgtgagccactgtgccaatgtgccccattttcttaggctaaagcctgaagtcctaaacaagacctacaaaaccctgtgtgatgaaacccccagcagcctcacctgctgcaccttgtaccgctgtgcctattgttccctgcctttagtcaatctcaccgtcatttcttcttcatgcctgtgtcattcccatgtcagtggctctgcatgccattccgttggcctagaacatgctctcctttccccactgccatccttacctagttcattcctactccacaaaagctactctctgacaaagacacagtctccaactcctccaactgaggcaccttgcatcatgacaggctttcatcatattctatacatttccattgtgcaaagtaccaatattttaattagcttattcagtttcttattcatttgttcaacagattcttgtaaatgagcacctattttacactgggtacttttctagtcacaaaatatagccatgaacaaaatataccaaaactcctaccttcatgtatcttccattctagtgagtaacactaagtatcctcactaaaatataagttacatatagtctgtgactatttctgtcttattcactgatgcatcccctagcacctagcacgaattgttgcttatggtatatttcagcaaaaatagcttgggtaatgatagggaaacaaagaatcttaacattttagtggcttaaagcaatgaagtgttttcgcttttttgttttgtaagtcattctatatgcccatcaggttgactgggaatgcttcctatatgcccatcaggttgactgggaatgcttcctatcttgccacagtcattcagaaacatgggccagtggtacagacattatctcaaatattgccagtcatgacagaagagagagaaaactattcagagatttaaccagtagttaaatgactccccagggttttagccagaagttaaatactccagcttagacatgtgcaagacacttccacttacgaatcactgctaaaaactagtcatctccccatatgcaactataagtgactgcaaggaaaagccatattttaattgacagctgtactactggctatctcagatggaaaacaagaaatatttgaggaaaagaagactgaataacaatgaacagtagttgtgatatagataaaagccctacctctttgtctaaaatatacctgttcataggatgtgcatagcatggatagattaggctaatgataacataagtttgcattctttcagcttacaaagtctactgatagtttgattaaacacaaccaagaatgacaaatttgctatccacaacatatggagtagacatcctacagacaaataactgagaattcacagtatattaaaaattgtttattcatatgaactacaccatatttcataggtcaatttcattagactggctcacatggctggtctggcttagacacagtctacagagttgattaaaaagtaagattgattgcacatcttgttcttcttgctgactataattttgtattttgcctgaacattcaattttctatgtttaattaaaaattaattaaaatttgttagagtataaattgcatctcatcatttcattgaatcctaactataggtcatgcctcttaaacgcagaaatggtctaacattttatttcaatatgaagtagaagaattgtcaggattattttggtgcccagatggggatttggtattcgtttaactaaattctgctttaatgtagggcatgaaaggaggctttgggacttaatttagaaggtttagcaagagtgataagaaaacccaataggaagccgggcacagtggctcatgcctgtaatcccagcactttgggaggctgaggcaggcggatcatgaggccaggagatcgagaccatcttggtcaacatggtgaaacctcatctctattaaaaatacaaaaattagctgggcatggtggtgtgtgcctgtagtcccagctactggggaggttgaggcaggagaatcccttgaacctgggaggcagagattgcagtgagcagagatcatgccactgtactccaggctggagacagagcaagactccatttcaagaaaaaaaaaaaagaaaacccaataggaattcctcctcaaggtataagatttttgtaaaatctgtttgcttctgcctagtggaatcctcaactacaaaattctgatgattataagaccttctgaaggaacaatccacaatactatgtcttagatcagtgcttcccatctggggtccatggacatacactcaggagcctaagaattctctatgtaaattgttaaacgttatgtttctatttgataacaatatatattgttcaaattttataaattctacataatcagggtgacaaatgacaaatgttgtcatttgcctttatgtttgttatttcactgacaccaagcagtactataatgctttagttattctaactatttaatatagtagagaataataagagaatagtggactcaaaccaagtatcatataaatgataagctaagtaaaggatagttttaaaataagaagattaacgtcaacataactacataaaactaaaaagaacctgtactgtcacagtcagtacaaaaatacacccaccaaatgcactgtagagtcagcaaagatcatctgccatgttaaggcaatgctgacaatttaaatcttgagctttttagttttatttgattggtaaattgtgttatattccatatgtaccataaacatttgatttcttattcatctgagagtttatatctgatttgacttcactaagaataaaattcaaaccccttactatgatatataagtccctgaatggcgtggtctcttcctatctggcttgttgccaccttgccacactaccctttgacatcacactccagcttcatcggcatttctggcagttctttttctactggtgtgtcttctgcctggacaactcttcagactctcaataaaaatacttcttggccaggtgcgatggctcacacctgtaattccaacactttgggaggccgaggcggatggatcacctgaggtcaggagttcgagaccagcctggccaacatggtgaaactccgtctctagtaaaaatacaaaaattagccgggcgtggtggcacacacctgtagtcccagatactctggaggctgagtcaggagaatggcgtgaacccggcaggcggaggttgcagtgagccaagatggcgccactgcactccagcctgggtgagagagcgagactccgtctcaaaaacatacaaacaaaaaatacttctcatttctccaatttcagcttaattatcccctgtttggtgtggccctacttggcttccctatttaaagggaagtccatttactgccctacaatcacttcttaccagtgtcccttgttcatttccttcatggtacttagctcaatttataattttttattttgtttacctgattattgcttgactccccacctaatcaccgaacatagaatagacacacacacacacaccagaatgtgagtttcatgagtacagagatcccatggtcttattatttattttataccaattccttaaaagagtgtttagggccaggcactgtggctcacacctgtaattccagcactttgggaggccaaggcgggcagatcagaggtcaggagatcgagaccatcctggctaacacggtgaaaccccgtctctactaaaaatacaaaaaaatagccgggcgtggtggcgggtgcctgtagtcccagctactcaggaggctgaggcaggagaatgcctgggagatggagcttgcagtgagccgagatctcgccactgcactctagcctgggcaacaaagcaagaccccatctcaaaaaaaaaaaaaaaaaaaaaaaagagtgtttggttgtttggtacataaaataaatagtatttgactaaataacaaaatccatctctcactatgtccagaactatatttcttaaagtctttgctaatttttatgagaggaaaatggcatgttattattttaatttgcctctgtgattactcatggcattggacatttaaatatgtttattggctatacataatttgtcaggcaatttcacatactgtactttgcctagttttctgttgggaatttttttatttatttgtgttatttgtataatcagaggaataatattataatcaacttgtgtattaaaaatgtctccactttgctctttggctttcaatatgttgtgatttctttgggtacccaatgctctccttttatggcatgaaggctgttcagtgtttttccagtggaagttattaatcatacttcatcagtgaataatctgagactaagagaaaaaaaaccttacaaatgactcatgtttggtagaatctgtctaactctaaaatgcatattcttttcactctatgtgtcaactgacttccatacagttggagaagcaccttatctcaacatttggcaacagatagttgtcttagtcaatttgagcttctattccaaaaataccatagactaagtggcagaaattggtttctcacagttttagaggctggaaagtccaagatcaaggtgctggccagtttggttcttggtgagggctgtcttcctgatttgaagatggatgcctccttgctgtgtctcacatgtgcagagagagatcatctctctcatgtctcttcttataaaggtgctaatcccatgcatgagggtttcaccttcatttcctaattaccttccaaaagctccacctccaaatatcatcacatgggggattaaggcttcaacatatgaatttggggtgacataaacatttagtccatagcagatagttaagtaaatctatatttctatgcatatgtttaagggaggaaataagtttcattgctttattgtcatattcacatgaatatgtcatgaatatcatctaacaaaagggatccagggatcctgagttttagaaagcctatcttgatggtttctaatggaaattgcttatttgcctgcattaagtttgtgccagccaactgaaacttttatgtttctgagctttggaccaaacttttatcatttcagtgtggtgacagtgtatctcatattaatcagaaactctaattgatcagaaactctaattgatatgagttctaatcagaactcatagttccatatgcctttggttaatacaaatgggaaaaggcattattttctaattacctattaggtagacaaaaatattttctaacctagaatccatgaggggagaagataacaatattactctttgcacaaaaaattttaagtcattatctaggaccatctttattcccatctgactgtacaaagtattggccgttaagagaatgaaggactttaaaatgactgtttatcatttttaatttattagaagtcagttaattattacatactgaaccacaagcttatttaatactagaagatgagttaataataaactgctccatttcatcgagagtgatggaccaatacagttaccaatgaagcagaaccaagggagaaagacatgaggtacagtgacaaagaagtgggagagagttgtaatacaatattttcaattgtggaatcaagtgcacatttaaatatttttgtgctattgctaaaggaaatgctatttttgattaagttattaaagtcattaaatttaattttttattctttaactaaattattttatattaatctgtggtttggtcaagttgtctttggcctaccatcccacaagaagtcagtgacaatgttgggaccagaattcaggagtcatcagagtccattgttgtattcttataaccatacttcactatctcagaggatgatttgatttgtaattaccacaattacacatgcaatctatcttctgctggccacttctgtgtatgcggccattgcacagggatattgttaaaataaattgcataacacatgtagggatacatgcagagataaatgatttctgtaagcccagaaaagatataaagagccatgaaactttaaatgaaattcgtgtttctggagcagccaaatcaatcatgatccccagcaagaacatgctttgatcagcatcaatttttcttacagtcttacatacaatagtcatcttgaaatactgtcatttaaaaaattaatttccatagtgatttttatccttgttttggtgttatagcccctttatttattcaatttctgattaggctgattatatgcatttttttctctaatggacctccttagttgaacaggcaataatgccataatatgcgattaaatacaattatgactttcttctcaagggcttgaaatagtcacagtaaaaaataaatgctataaatgcaaagtgccctggtagaattgtgcttatagagggaaacagcacaaaatgtcagataaatgatgaggctcagaaaggatccttataacattttgttaactttctgtcagttttcattttacataacaagataaactaaaaaacaacaatacgagaacaattttgggtcaatacgaagtgaaacagaagaacattttgtctttccagattggtttatctcatcactaaagtagcatagacttagcgattaaatagtataatgctgatgaaaataggagctaaaacaaagacatggaagtagtccatggtttggtacataaagtgtgtttctgtcatttgttctttgcaatatttaattcagtcacaatctcagtgatttccttgagcttttggatcacagaaatgagaatgctgctgttcctccactgcagggctctggacccctcgttgtttacctgaagataagcttcatctctcagttaatggcaaaattatattctgacctccaatctagtgcttttgttaactcagcattatttagaaaagtctaaggacaagtgtcggtctggaccctggtgtggctgctatgtgaaattcagtttatctgaaggctcattgaaattcattttgtgcataaacaaaaaactaccaggttccccccacccccaattcatttgatcaccagatctgaaagtattgaataaatccgtaaaacctagtgcagtgtctaattctgaagacacttcaaaatattagtcttggggcaattctgggtactgtgagagaaacagaaaaatcagaagatgtatttcttccttcaggtactttaccatctacttggagtgccaaagcagcagaacaactagagaataaaagctatgtgtgtattgtgtaaccagcttatgtactatataacccacaaccaacatccaacctgcaattacagctagggtttctaacttttctctaaaataacccaaaacatttttactcctcttcttcttcattattctgaaaattgagcaatataaaatttttaaaaagaaggggaaaatgaaaactagaaaggaaaagcatacagatgactatttcttcaaatttttctctgatctttgtgtgagagacttgaaacgaattgtttatttatcaagctcattcactttaccttcctagcaatttcaaagttgactgctcctacaagatgaggaaattaaatgatgagagagaagtaggcactgatgggatgggatgagggatttgatgataaggactgatttgatctccttaaaatcctagactctagcccaagattattgtcttaagtattctcttctgttatcatccaattcagtctctaggattgagatactattgttctaagaaagaatgtatattttatatctactatatgaatctttccctccttcagatatgcctggatgcttctctgtgggggtgggtgatttttaaagatgttagtcattattggtctctactagaatcacctgttctttttttttattatgccacattggaaaaagaaagataaattcagtcatttttcctttatactctatggaaggctgcattatcaagtatctctccccaaataagatcaatcatatcctgttttgataaactggccatagtgttactttaccttctttctttatgtcgtgttgagaaagttttttaacctcaagggaagtcaaagtttttgttttcgttgttgttgttgttgttgtttgagacagagtctcactttgtcgcccaggctggtgtgcagtggcatgatctccctcactgcaaactccgcctcctgggttcaagtcatccttctgcttcagcctcctgagtagctgggactacaggcgcccaccaccacgcttggctaatttttgtatttttagtagagacagggtttcaccatgttggccaggctggtcttgaactcctgacctcaagtgatctgcccgccttgccctcccaaagtgctgggattacaggcgtgagccaccgtgccctgccagaagtcaaagtttctgtgtcaatgttttcacaaacattatctctgaggtgtggaaatatgtcttatttcccattttaaaagtgatatataacaccgttagcttctcttagccttggtatctttaaccgtaaaatgaagtatagatataaacatttgtccaatctctccaactagattataaacctcaagagataatgaataataaataatgccactttgtatctctagtacttaacagagtgcctactgactagtagatgctcaataaaagttgagaataattatatttccatttcttcactttcttgaataaggtggatttctgtattatcctataattattatgtttaaaataatatattattttatagtaataactaagtcagatgatctaagttaaaactttcatcggaatctaagaagagaagaatttgatggaagtcagccaacaaatattatgctgcgtcaaaacagtgtagctgtctctcactgtgccaatttattttacccaaggtgttgcaactttgagatacctgacaaaaaaagaggctcaaaggtattgccagtctacatagaccatcatatgttggtcccgtctgctgagaaacgtgggtttatgtggaagtttttcctgacacttagaaaacagcataagccaagataaaatttgctttcatttgtcaatgcaacatcaattcttctacaagcagtagactggagttttaaagtagtgacaacccacaggacgtattcttccatcgtcttatatataacaagctgtttctctccctgtctattaggctattcttacattgctataaagaaatgcctgatactggataattcataaagaaaagaactttaatgggttcctggttctgtagattgtacaggaagtagggcactgtcatctgcttctggggaggccttgggaagcttttacaatcatggtagaaggggaagcagaagcttacatgtcacttggcgagagcaggtgcaagtgagtgcaaggagaaggtgctacacacttttaaatgaccagatctcacaagaactcactcactatctcaaggacagtaccaagggggagggtgctaaacccttcatgagaaatctacccccatgacccaatcacctcgcaccaggcgctatctccagcattggggattacatttcaatatgagtggggatatatgatttggatgggaacacagatgcaaactatgtcaccgtgttaccctcccagtagggacctctagatttaacaaccttagggcaagggagtaggagagcctcatggtaatgattcctgcctgattaaggtataacaaagagttattagttaaagaaaaatgaaaaaaagagagacagacaaacagaaagcaggaataaaaagttttataaatgcaagaaaaaatgtttgcatgaaatgacacaagaagtatcaaatgaataaacacaatttatgaaacgtgcatgtcatagttaattttatatgtcaacttgacttggccatggatgctcagatacctgattaaatattgtttctaggagtgcctgtgaggatgtttccaggagagataagtattggaattgatggaccaagtaaagcaggtggcatactccaatatggatgggcatgattcaatccattgagggctcgaatagagcaaaaagacagaagaatgctgggttcacctgctctctgctggactacttgggttgggacatctatcttcttctgcctttgatgcttctggttctcaggccttgagatttagcctggaatctacaccattgaccctctagctttcaggcctttaaacttcacttgaccttcctgcatgtccagattgcagacagcagattctgggatttcttagcctccataatcatgtgagccaatatgtgataataaatttctttaaaaatatggattagtaaaatttgcatcctaatgaaaatgtaagcattgtgacagagaatgctttagtcagtctcaaatcctaaatttgagattgaaatttaagatagcttaggatgaggaaaccacagtgtccttattgaaggagtgacttactgacttctacatccaatacagctccttatatttgacaataaaattgaaacaataatagtttaaatcttggcacatagaaattatatgtccctgacctactaattttctgtaatcaggatgctagacaattaacttcctaaagaaaacacatggacaattatgcaatgtttttgataatgaagcaatgttagctcactaaatgaagtaaaatctgaggaagctatgagaagtatgaagttgattattatgaaaaagaagtttgagctgtatcttaaagataatgaatgctccttaggtcagtcagtaagttttaaaattacttaactgaaaaaattaagagaatgtttgataatttaacatgtatctttacttccagagtaaattaattatccagatttttatcccactgctctctaaattgttctattcaggcaactatatatggtcaaagttgtatttgcctgtttttctccatgtttgcttccattgtctacacaaaaaacttaggctattattttatgtgaaaataaaaaatagggagttacatgcagttctttttccgctgaccaaagaaagttttcttcagaaagagcagtcccattttttacttatttaaagaatccacattctttgttcttcctggacatatgccttttgcttagaatgggaacagaaaaggtgagactgcctctagagaagctgaaagcaaagtagtgggtctgtaagatctcaacataatcaacagtagctgtgtattcgtagctgtgatacagaatgctgtcatacgtctcactaccactccaaagctttaccatgctgcttagcacattgaagcttcatctcagatcttgccggacttatttgatatttaagatggagagtctaaaggacaaaactaaatacttccatgatgtttaaattgggcgacagaaatacaacctacttagaaagtggtgtcatgttattccatttttcaagagtttaatcctcacattggttatttgctacgaagactcaaggcatcatttcacttgacttagcctagccctatcacagtgatggcaaaataagttatattagcccagcagcatgcatcagacagtctgaaaacattctaaatgattaccactgaataagagaaaagagagccatcaagcctcattgagagaggcatgtccagtcatctaccaagatcatttaccaccctgttcattgttttactcagcagacaccctcacgcagctctcttcagaccctgtgtcagcgaaattacaaaatgtccttgggatcattcacacgcagttgaaactatgaatctttaatctggaaatgccaaattttctgggaagaaaagcatttgaaaaaatgccttacaatgtcattatttcctgccctaagggctactcctccttttgaaaaccaatttttagaaattagacatttttcaatactttgtaagtccttaaaccaatgtacgatgtcagctgcaatattttatgtgtttcaagacaaataaaattcttttttattaacagttatatgtctggcccttaaaatgctgtaaaataaaatgcttcactgtgtgaaaggctatcatggggtcattggataagttaccaaacatatttttcctgtttttaggacattttaagtttagcttttgctgctgttgaaataaagaaaacccttaattaacatttctgcaacttctcatttttttgtcatcctctgtataactagttgagtcattacatgagggtaactctaataaacaaatctagtaattgttctggataacattttattttgtatcttcttataaatgaatatttgatgatctttacattctgcagaaagatttacactttcaaatgctagccattaattagtgaaagcagtacaacattttataaaacacatttagtatttattttttaaaacattccagtgtatagaggctttttgttgttgttgttttgtttttgtttttgtttttgttttttgagatggactctcactctgtctccaaggctggagtgcagtgacgcaatctcgtctcactacaaacttcacctcccgggttcaagttattctcctgcctcagcctcccaagtagacaggattacaggcatgcacaccatgcccagctaatttttgtatttttagtagagatggggtttccccatgttggccaggctggtctcgacctcctgacctgaggtgatccacccgcctcagcctcccaaagtgttgggatcacaggcgtgagccaccatgcccggccttgtttttgtttttttgagacagggtctcgctctgtcacccaggctggaatgcagtggcaccatcttggctcactgcaacctctgccccccaggttcaagcaattcttgtgcctcagcctcccaagcagctgggactacaggcgcctgccaccacgcccagctaatttttttgtgtgtattttttatagatatggggtttcaccatgttgctcaggctggtctcaaactcctggcctcaaatgaacccacccacctgggtttctcaaagcgctgggattataggcttgaacctggcctgattaaagattcttgatacaattaatgattgggtgtgatttatgtagtgaatgattatatgctttaaataagaatacattcatagatttttaaatcacactttaagatcaaaaaaagattttaagatattttaaaagatggaggccaggcacggtggctcactcctgtaatcccagcacttcaggtggccaaggtaggtggaccatttgaagtcaggagctcaagaccagcctagcaaagatgataaaaccctgtctctactaaaaatacgaaaattagccaggcatggtagcgcacacctgtagtcccagctacttgggagactgaggcaggagaattacttgagcctgagaggcggaggttgcagcgagccaagatcgtgctacggcgctccagcctgggcaacagaccaagactctatctcaataaaaacaaataaataaataaataaaaataaaagattgagacttttttaaggggtgaaaatatttcatttgagcaaagcattcctcagctaaaaaaaacaagttttaaaatttctgatttaggaaccagtaatatattgaaaactgaagtttaagtgtcaatatgctaaataaatatttccatttccctaagtacaaatcataaattgcgaagtaactagaaaggaaactattgatcttcagcttatctgcctttgtgcagatatttatccggttcaatatttgactaacttgtctaaccgtaagaaccttgttaaaatactgatacccagaagtaatttaacatgtcacgacatacgtttagaaaggtctcctgtttgcgttagaggagtgttcttcaactttgaatcacatatgaacaacgttcataacatttaaggggtcttgttaaaatgcagatttcgatttatgtattacaagtttctgggtgatactaacactgctgttctgcagaccacatcttgagtagcaaagcattccagaagcattcaagatcccagaacaggacacctcatctagcaggtcctccacaaatgtttattagtcaatcagaatctagctaggtgcagtggcactaaacgtctttttttcttttctccttttttctcccttgccctagcttaaagctgtgcatagaaagttattttattttatcctggtaaattgagcacttctgtttgttttatagaggtgtgccctttctgttgagtatctttctaagagccattatggtgtgactcatctttctgacagtatttattttaaattttaatttattcagctgcttcaatcacattcataagttatcttttagaataccttctctccttcacacttaccttggccagaaacctgatcatctgaatacttgtaagagaaccaagaaagtatagactaattgtttattttaaaaagcacaatgaaggaagaaatggatgtgatttttttcttggaaacgggaatttaatcacctaatagagtctcttagaaaagtaccattcccaaatctgttcttgattttgaatactaaattgctctaaatccacctaatggttgtttaaacctatgacaccatggagaatgtgagaacaataccgtctatgaacctcttcaagaataagctcaaaaatgaactccaccaattgatgtggaaagtatttcatgcatgggacgttctaaccagggaaatgggaaagagctggcatagcaaaggtggaggggctaaggaagaacactgagagatgggacagagatggcttgccaattcacgcgtcacatgagaacaccaaaagattttggaaaatccataaataacctaaattctcttttttcctggcccgtccagctacctcccccccaaaaaaagaagccctaaacagcctctttgctatgtctcagctaatcagcttatcagcagctcacataagaaaaggtaaataatattcgctatttcaaattgttcctctctccacttttccttacataaatcaggggatttgttaggtgaaatgaattttttttttttttttgagatggagtctcgctctgtcgcccaggctggagtgcagtggtgcagtcttggctcactgcaagctccgcctcccaggttcacgccattctcctgcctcagcctcccgagtagctgggactacaggcacctgccaccacacccggctaattttttgtatttttagtagagacggggtttcactcatgttagccaggatggtctcgatctcccgaccttgtgatccacccaccctggcctcccaaagtgctgggattacaggcgtgagccactgtgcccggcctatgtgaaatgaatttattacacactccattgattgtataagtaaaatagcctggtaaaaattagctgcatgtctttttatcattctttgaaaaacgagaagtgtttagtttgaagtatctaagtaatgacaaccagcctgaactattaaaaggatgtcaggaagaagagagcaaacatgtcctttttgctacagaatgccaaaattataatcaacaggtaacaatcgcaaggataaaccttgtttgcctaacaagataaaggactttcttaaaatcagaattccaataaagtctctcatttaaattcaggggttagataacttagaatgggacaaatagcacttatattttaatctctaatttatttgtctgtctgcaccacttgaggccaggaactatttcttattcattcttgcctcttctgcacctaggagagtgtctagctcatattcattaaataaattttgttgagcagtactgaaaggcacagatttaagactttggaacctttcccaatactatgcccttgtcgtgttgaatgaacgaatgaatcatgagtttcaagcctaatgtttcccacatgtcatgattaatggtcaaactaaatcttggttcctctttctctctctctctctctttctttttttttttttgagacagagtctcgctctgtcgcccaggctggagtgcagtggcacaatctcggctcactgcaaggtctgactcctgggttcacaccattctcctgcctcagcctcccgagtagctgggactacaggcgcccaccaccatgcctggctaattttttatatttttagtagagacggggtttcaccatgttagccaggatggtctcgatctcctgacctcatgatctgcctgcctcggcctcccaaagtgctgggattacaggcatgagccaccgcgcccagccggttcctctctcttaattcagtttcccagggtctttactgacagccctctgttaagaactgagcagtttcttgtatcctatcagtggttttgccacttccttcttttttttttttttccccaccaacatgctcctctctttctctaagtgaagttgtgcagttttttttctctaagctataaacaactacacttgggatcccaggccttcccttcattacccttatgaatatgcctttgtgtcagtggttggccagagacaaatagtaataatagaaaatcaatatactgtatggggagaagtggaaaagtgcctggatataagttttacattaaggttcggtctatacacaatcatattgattagatgtaattgatagattatcttagtattattcacatgacattatttgtgccttcctgagaggattctaccctcccatgattcgtggaactatctaaacaacttcctaggaatgatcctctcctttactcctacacagtccaactacatgcaaaggtgcccagcacatggttaaaaaacaatactacctgtgcaaatacagacgctactcagcttataatggacatacagcctgataaacccatcataagtcaaaaaatacatttaataccctgataagcccatcataaagtcacaaaagcataagtagaaccattgtaagtcaggaaccgtctgtataaggtatcaagacaaataaaagtgaataccacacatactacttgtgaacttttaataactctgaacacaaacagcttgaaaacaataattggatagatggtctttaattcatgtctttatgaaaatagcaaaagagtatattgagaatgattgaatcaaatttaacaaaaccttgcttctcagtgtgactcctcgaccatcagcattgaaatcacctagaagcttactagaaatgtagaaactggggcccaccccagacttactaaatcagaatctgcatttttaacaaggtccccaagaaaatcagtacacgcattatgtttaagaagctactctaatgagtacgcattaagtattgatcacactccagttccttcttagaaaagaactgacggcacggcttaaccagtgtgactaaaggaatgatctcagtgttggtctgtcctaaattttcctttgtgtctaccctgaactgagattcgccagggcctttaatactaggatttagtcttcctttatgcatgcactcaaattagagcctttgtcatctgagtctttacagatgatatctctcaacagtgctgggagtgtggcctaaagcaatgtaatactaagtgaagtcagaaaactggctacccatctgcaaattgtttgttacttgtctgtcataatatagcaactttggtagaatatgcatgatgacataagaagcttgtgccaaaatgtaaatcacctacatcactaggcacactcttaatttcagctgctatttttttcttagtaaaactttttcaatgaaggaagtagcatgttgatttctactcaagcatagcttgttacctccttgtggacaagaactttgaatagcacaggcaaagtgattaaatgcagaaggctgctctacttgctgcagtgtgaatgtggttaatcacaacaggccctacatattagagcacaaattaattatggctatagattaactgctttgttaactccataatttctctggggttcacagctagattcccagtacctggcacagagatggccttcagtgtctgttgagtgaatgaagtgcctagctcaactttcattgtttacctgttgttgtagttgtttcttctggcttggatttctaaagctcctgaggtatagatactgttgattttacctaaagaggcttcagcagaagagaacaatcacacaagaactagaaaagacaaggaaggttttatgaggaaaatgaacattaatctagaatttgaaggaaaaatgggacccacatcagcatcatagagaaaaggggattcctggcaaggagaacatggaattttgtggaatgcacagaatgtaggaggtaggaatacatatggcatttcaaggaatgagtgtgccatacgtcagccaaaggctgaggcaatggagtactgggaggaagtgttaagaattatggatggaccagattcttactttaacatcttttttttcccctaagcctaatgtgcttccaaacttgcctcttttattaaatgatattcataacaaaagcaatactaaagtccttccttgcctgtttcctctacacacataaaaattaaacatttaaataaaagtagaaaaattgtgacacttttttaaagcttcaagagtaagatttcacatacagatgacacattttctacaatgtaaaatttagagcattactaacgcatattaaatgctagatcagtctttcaagttacagtacacagaagataaaaataggtgcgatttggaaagaacaaaggtgaactcgaagcatacagtgaataggcacaaatcagctacaaattttagcagatattcatgcgcttattgaaataagccaccttttcctgcatttgtgccgacaagtccatttatcctttttaagatgctccagtaacgataggagcattttgggggcgggggaggggggctaattgatgtgatctaatttttcagactcaggagttttggagaaaggtcagtgtaacagaaaagctgcccattagaaataacatctataaactgtcagaaaagagtgcaagccagaagatgaagcaattcagattgcttcccttcttttccaaggttcttgggaaaaaaatttcattacgcataagaagtatagctaaatacttaactgaagttagaacaaaatcatgttttctaacagttcaggtgaatttcaagccatccaggccacaagataatgatgtcctccaagtctgacctacagggaacttttcttctaattaataaacagactacagcaagaaaattaatttatgcaccgcatttacttgttgatgcccttcgagagcatagcatttcagtaggcactgtgtacacgagatacagcagaagaatacgtcaaagctagttctttggtgttttttttttcccagagaaaatagaggtaatccaacattagacagaatttgtcgagattactagatgtacattcaaaacatccattcaacaaaccaattgaattagttgcatataagagtgtcccctctgggccgggtgcagtggctcacgcctgtaatcccagcactttgggaggctgaggtgggtggatcacgaggtcaggagatcgagacaatcgtggctgacacggtgaaaccccgtctctactaaaaatacaaaaaattagctgggcgcggtggcgggcgcccatagtcccagctactcgggaggctgaggcaggagaacggtgtgaaaccgggaggcggagcttgcagtgagcggagatcgcaccactgcactctagcctgggcgaaagagcgagactccgactcagaaaaaaaaaaaaaaaaaaaaaagagtgtcccctctgaattgtactcttcaggattccctgggtgcctttttaaaatttaagtctgctactgcctctttcataacttatggggcagagccctaattccttagcatgtcatgagaacttccaaatccaggttctgcctgcttattcaatctggttccactctcatgccagccacttcatacctaatcctccaccattgctaccgccagtgtctgaatgcatctcacctgcgtgcattttaccaagattctcccactgcctggaatgagaccacacctttttcaccctgaaacacagccattccaattgtggaaactcaactcaggcacctgttccttcccgtcttaccacatttcctgaccaactcatgccaccattgaatggccccttaagcttaagtcctcttatttttgcagtgattagacgaaatactatatgtaaattatttagcaccatgtctgacagtagtaaataactatcattatatcacatgttattataactacactggagagacaatataacatggtggctaaatgagtaaaacttgacatcatactgcctatctttcagtacttattgttctgtgaatttgtcaagttaatgggccctcccttctgggtcagttttcttacctgcaaaatgggtacaataatagtttctacctcacggggcgtttgtaagagttgaatgagttagcacagaaaaagcacttagtgtctaccacatactaagtatgcaataaatgttaactgtgctgctgctgatgatgtactttttaaacactttaataaaaaatttcaaatatatgcaaaattagagacagtggtatgcatatactgaacacccagctttagcaattatcaaattttgccattattgtttatttatctatttctctttggtctatttttcattaatgtagtattttaaagcaaattccagacattatcatcagtttccctttaaatgcttctctaaacaatgatgactttctacatagaaccacagttccttttacatccctatcttgcaaatacgtctaaataggatatttcatttaacttacttattttcctatctttccttctgggctgtaaatccttgaaaccagtggttgtgatatttaattcatttaagctgtaattcactggctagaacacggtagtagtgcaataaatgtactttttaaagagagagagggaagtaaaaaagagagaagggagagagttaaggagagagggaataggaagggctcacataacaaaataagacattaaacaaatgttgaccttaaaataggcatagtacaactagtgcctgaataagcagtaagtaccaaatgctgtgatcctagagaggtgtctcagaaacctatgcatagccaagtttaatttgccagcaggtttttacttcattgactggtcaggtagagaagaagaaagcaaaaataaaagagtgtattattctgtatcacaatggtatcagattgtttattttggagtctgtgtctatttctcatttccaataatttatgatatcatttaccattattaaaggaaccttatttttaaagccctgtgacacctagtgtgaagcagaagagtttgcaaagtttaaacatcatattgttaaattctggagtggctttaactagctgtgtgatcttgggcaagttacttgctttctctgcttcagttcttcatttttaaagtgtgacaggattagcacctatctcataggcatgacatgcttagaacaatacctgatacatgaaaagaatttttaaaattttatttattatctagttataagagaacaatgaaataaaacaaatatgaagctcgcccatttaaagaaaaaaaaaagaatgatttcattgaagatacttcctctgccatggaattgctaaatgaaactttgcagcaattccaaaataacttgccccagggagtaggattggattttgctaaactgaggatttaagatttacaattttttgactgtaattcattcttacctctgccaaatgtgattgcaaagggaaagaagacatcataattgtacgaaagggttttaaccaggtttttttgttttttgtttgtttgtttttactaattgtttcagggcatttgaggcaattgtaagagcttacacatggtaaccactacataaatattaaaatgatggcttggtacaaaaatgactttatgattaataaaatcacaaaaacttggaaaaagagttataaaaattctccataattgagtgccaactttgggcctaatgttttatatagtaggtagaacccaataactgccaattatttggcagttttgatgttagaaaaggccacgggataaagttcggacaaaatacattttttctattcctccagatagtagggttctcatttttcacagaggaaattagggtttagatagataggggacttgtataaaccacatgctacaaagcgaccatgtagaaacgtgagcccaggttttcaggctcatcttattagtggctaattccaatgtcctttgcatatttaggaaatgtttgctataataaagaagctgggcaataagatattaaatattttgaaaagggtaaatatttagtgatttatcaaaggaagcacaaagcactgagtactttagcagaagaaatggattaaagatgtgagacccatgtcacataaaccaaagaccatttctcctccagataataatgagattgtcacatctatcaatttctatgtatgtattccattgtacatcctctctccctaaattttaaaaagttatgatcatgttgatatgcaaagggaacttatgtgtttgtttaactttttgaggagaaagtgagaaagagaaaatattttacattccaggagagaagcactttagagaaattgaagcaaaaactgggaagaagtcagggccaactggtggaaagtcccccaggatgcaagagaggagcactgagccctgacctacttctcactaattgctgcaaacctcccataaattccttgcccttcctggtcttcagattcctcttctataaaacaagatggctggggaaagactctctgaggtttcttggagtttttacaatttaccgatcttgtgaaattagaccattaattatcttttaaatgtatgttttacaaagtgttaagatggaagaaataaactggtaaaatataagatggtttgtaatcataaatattttccatatttaattatagtttatttctcatagaagtgtaaattgaggtgggttacagtgttaaaacaatattagaccagtttgaaaaaaaaaagctagaaagttctatgcacttacatattttgtgataatcagatattagtcaccattctttatataaacccaatgttactaattacttaagctttaagatgaatgccaacattttgatttattcacatccataacataatttggagaacctagaaatttttttgtttttacatttgtgcaatgacatttcaggtttggttttagacttccttcttttctttcaacatgatgctgagaaacacaagtaataggataatcacaggttcattcctagccatcgcttttgcctgtcaatatcctaattacttccctactccacttagatgactcagagtccatgccatgaatactgatgatgagagatgatgcaatggggagaacttattgtagctccatcctgtcctttaactttcattgtttctccagccaagaatttaagggcacaagttagaggagagtctggtcatcaaaataaaattcgttagccttttaaaatatgtcaggctaataggacaagcagcctgcaaggagaagcatccctgactttgctggacagcatttccaattatcagcatcttctggcattttaagttataactgaatattctcaaataaatgttgcaagaatatgaagtgtagcataagtattatcttttcagtgaaatctattcttatttatttacatagagtgtattctattttaaattatatatttatggacataaaattcacatatttgacaagttttttgaagaggcttttccactggagtaaaaagatggaaatttttaaacagcatttgattggtattccattttcctttaatatttgaaaatgttatgttgatcatattttaggtaggaatggatctattaactaccatggaatcaatttgtagttatccatgaaaataaaacaggaagaatttttaaataaatattcactctttatttacaaagatttattaagtctctgctatgtgccagtcctagagaaataaactagtgatggcctggatcgtttaggagcttacaatgttttgggagacatgcacatagaatgattaaacgaatcaggagatggtgagttccacagctgatgtatacacaaacaaataatgggtgcatgaaagagggtcaccttatctcttctgataaggttatgaaggtatcccagaagaaaaacatctgagctgagtcttaaaaatgcaagagaatattcccagatgaagaaaggggagcaggccatctcaagcagaggagacatcagttgattttcagcaagtatgtagagtgtttaaggactgattgacaggtcaacgtggcccaagtgaaaatggtgaaagttagttggacccaactgtgcaggtcgtgaagtcagattgtgaggatggctcccatctcatctgggagaaagagatggcttcctcaggcatcaagtgctttcttcttaaagctgcagttatttcaccgctatttaaatttgtgttttcccgatggtcagagactacagtcagactgcctcttggatttcagtgatctttgatttacctgtttacacctttcacatatttgttgttgtttgcattttgacttgtagaagctctttacaaacatgagtagtcatcctttgtcatttttgttgtgctcatactcccacggtactttgctagttttgttattttgtctatgattttaccccatacacaaggtttattttataagtttagctaacaaatacttattatgtaccaagttttattctaatgtttttttacaaatgttaacacatttaatcttcataacaatcctatggggaaggtattaacatgcctatgttacaggtaagaaaactgagctacatcttgaaggtcacataacttcccaaggccttactgtggtaggtgtgaggccagggaatgctacaaagccctgctttgagcctccactaagctgctttctttcaaatttgtcttctgttcctttatgatacctgtattttatatcttattaaacaaggccttgcccagctcagattataaaataacctcctagacattcttataattttatacttctgtgacttttgggtttagaactttaatcaatctgcaatgtattcttgtgcatgatttgagttagaaaccttctcaaatgttacattatttattgcagtaaccactgtttctctcatttatttgaaatgataaatttattgcaaaatagattttcatatatacatgcattttttgtaacttttttattatatttcactgttcaatttgttcattccttcactaataccatacattgctctaattactgttactttttagcattgaaattgatgtttaagtgttccctttttaaaatatacttgtcactgttctcatttatttataaattcctccaaataaatatatacaattagtgtcttacattttataaagttggtttgttttggtggagtagattaaatattgacttgggatgcaatatacttataaaattaatttgaagaaaactgatattgtcaaaataattaactttttcatactagaatatagggtgtcttttcatttattaaggtctttcttgtatttcactacatttttagtttttttcttaagtcttacacaatgtttggtaagcttatttctaagtattttatcattgttttccacttttaatgagatttcaaattccattaaaatttttaattggatcctgctgatatacagaaaaactattaatgtttgcatgtctttcatgtatataattgctatattaaattatcttattaattctagtagtttttcaattagttatcttggaatttttcttagtcatatccgtgaaaattgttagctttatctcttcttttgcaatgtttacactttttaattatattgtctcattgtggatatgtacttataatgaaaactattcgtgataatattcttaattttctagttcctggttttaattgaaattctttgtatatttcaccagttagattgttcttacacagtagtttgatttttattcctagactagttattccattctcacatttaaatgacactttcgctgctttaggttctcaatcttttgtctcagaactttctagcatcttgtgtttcagggaaggctgaggccaatctgagagttattccattgtgctaccttccttggttttaaaaattatcttcattcttgaaattcaaagattttacccaaatttcacctaaatgtgtatagatttggagttaagttttccagagaaaataccagacactcagttaaattaaagttcagataaataacaaataaaaactatttcccagctgtatgcatttttatttgctcaatctgataatcctaatggggtattgactgttaatatattattatcattattaattatttttgttactgtttggcagtcaaagggatattttaaaataaagtcctttttcagatcagaccaatatttttcaattacttctttgacacagcgtagcaggtcagaaaactggttcttaaaaccattgtgtatattggatgtggtcttacatttaactcccggacaagctgtttataatttggtagtatgtcttaggctcttagatgctcacatgctagaataagacaaaaagaattaggccattcctttttctctttattccctgttctttctatctggaaaaacagatattggaaattcttcatctattccctatgtctcataacttttctattaaatgtatatatttttgtcttttatgcctcatgttttgggagtttatcttcacccacattaattttaatatgtatgcctgatgaatttattaaaaatttctacttttaatgagattgcaaattccaataaaatttctaattgtatcttgctgatatatagaaaaactattaatgtttgcatgtctgtcttgtatataattgctatattaaattattttattaattctagtggttttttaattagttttcttgggaatttttcttagtcatatctatgaaaactgataattttatctcttcttttgcaaagtttatacattttaattatattgtctcattatggatatgtacttataaaacaatttgtgataatattcttaattttaaattaagaatctttttaatatcttaaccttacatgtataaatttattaggtctgataattttattattagaccttcactaaaatgttaaattttagctatcatggttttaatttcaaaattttttttcttgatcttaggttatttctttttcatagcaatttgttcttgctttatgacttttgagtttttttctgttttagcattatcatggtttcctctaagactgatcaactttctccttttacataagcatatttgttgattttcctcaaatatctggtgaaacttgatttccattcttatgttattaatatttataaatgaagtatcggtttatcaatgtaggtaactacagtggttttaacaattgttatgaaaggctggttttgcagcaggcttcttccctgactaggagagagaaatgtgtgggtctggttttccttttcttgttatgcaagcaggaagaaccagaaaagcaggggcactctcatgattgcaaaagcaagtgctcatctgggtggtacttttaagtgctttggcaaaggatgaggtaaaattaaaagacaacagcatcactgttttcagaacttcattcagagccattacgacaaataatttggttgcaagggtgtttgatacctgaaataacataaggattcttagcactctcgttgtctgttcacaattgtctgcaaaaagcaaggcaaagcatagaggtcatgcatggtgttatttttcatttgtgggaggagaatacatgttcttattttgatattaaaattaggaaagactagtggtcaaaattgaaagtatagagctttactgtgacataattcagtttcttataaggggatcatatataagagtaccccaaagtactttgtattgtgcttgcaacttttctgtaagttaaaattatttaataaaaaaggatttttttataatcaagaaatctaaagatggaaaattatgattagatttaggtttaacttaaagtgacagaaaacacaaaatattactgtttcaaataagatagaatttatatcttgcctacataatgtaagcggtcatccaagcctggaatggtgctccttggtgtcaggaacttgagttcattctgtcttgcagcctctccatgcaggaattccatgttcagggtcatcccgtggtctaagacaaatgctggaatttcagcatttccattcacattccagccagcaggaaggagaagatgattgccaaaaaagtgcactcctttcctctaggaacactttctaaaagttttactttcttcctgcatcccagtgtctaggaactggtcacataaccatatctagctacaaggaaaactaataaatacaaaagctgctaattacttctcagcattcctgtacctactaaaaatcataattattgtagaaattggatattgaagacaacgaagaaaacaatgaagagtatttgccacaccgtttgaacagggcagtgtttgtagaatctcttgaagctcatccattccaaagacatccgtgagtgcttaccatgcacgaagcactgtgctggggcttgagatagaaatgttgagaacaacacacttggtctctgtgctaatggagttttaggctaatgggaaaagtggggattcaaaacataaggaaacatatttgaatattaataaaagctaagagactgttaagagggaaattatcacatgttctgagaatgtgtcacggaaggactttgccaagccagggcaggatgatgatgatctaagaaggctttcctgagggcatgatacatgtgttcaaatccacaggatgaatgggaatatgcaaaggagaggctagagtaggaatatcaaagaaggcagcatatgcacaaatgtcacagggaaaagaataataatccagttaagaaactgaaagttctttatggctggagtacagcaaacaaggaggaaaacaggagaaaatgagactagaaaggttctcaaggttaaaataatgtagaatcaaatgcaggccacatacagttatttgtgtcattaaagggttagaggcagagagcaacatgacctgttttatacattgaaaaatgttctgaatgcaatgtagaaaacaactggatgagtgtaagaggagactatgctaggagttcaggcaaggtgggagagagagcaatgtggacagaatcaagagatattcaagagattaaaaacaatagaacctgatgataatttagatacgaaagagtgaaggtaagagaggagttgaaggtgattcccacatttccagattgtacaaatggatgggtggtggaccatttattttctgaaacagagaaatatcaactaccaattagaggaaagatgttgatttttggtttgatttaagagccttgagtttgcggtgcctttctgacgttcaagtaggcatttcagataggaagttaaacatgcaaatctggaacaccgagaaaatagcaagcctagagatacagatttgagaggtttttgcacataggtagttggtaactaaatcacagtttcagagaggagcccctacagagatagcaggcagagagatgagaaaaaacaagaatctgggacttgaatctaaaaggcaggcagaagaaggttggcagaaggcagcaatggagactgaggagggtgggtgagaaggtagggatctgttgggagtttgtactatgatagaagccgagggattctaaagcactaaacaggcaaattcctccttgacttgacttgacttccttccttaagtcaaggaagaggagggctgaaagaaaaaattgagagtacagaagggttctgaaatgttactgcaaagataagatgtgacaagtatctcttaaagatggtggtagtcatgatggtggtggctgtgtctgtgtatctttgttatgcatcaatatttgaaccacttggggagatgtccgtcaaagaatacaaaatttcagtttggcaggaggaataagttcaagagatctattgtacatcatggatgcttagtaacaatatattatacacttgaaaaatttctaagagtagatcctaagtgttcccaccacacacaaaaaaagtgtgtgaggtaatgcaatgttaattagcttgatttaaccattccacaatatacacatatatcaaaaaattatgttgtacggtataaatatatacaattttgtcaattaaaagtaaatgaatgaatgaatgaattaaaatatttggagcactctgaagctgaattcagaaataatgctaaagaagacttgactttgttaaagacagaatttttatagaatatatggaaatagtaattattgcttaaaaactgtattcaatattttgatattgacctcaataaaaaaatgtgtaatcaatttttgaacttctagtcactcaggggacagaatggttaccatttgttgtcctaaagcaagggtagcataggggcttgtcccaggaacaatcagttggtcttcaaccaaaaaagtggatatttccatcagggacatttgcctggacaccaccatgttagattctaaaaatcaaacatgtgtcccaccctaactttgcctttagtccctgaaagaatggacctaggtttgagagaggagaacagtgagggtcatccctcttcatctcaggagcaattaactagttattttgctcactttgggaagaatttgccttcaaaaattataccttttggaaaactataccatataattatttatcttccttcaaaatatgaattatttgatctttttctcacttcaacttttcaaaaatttcacataaggagccctattcaattatctccttctgtaattaaaacattttagtaggtgtgcaaccaaattgccaaactaagacagatcttgttattttaaaagaacattataatttcaattgttctaataattgttattattcgatagagcaaattatgaatgcaattttcaaagcaaatgaaaacataagaaattcatgatttttctatactgctacaaatttggataacttcaaagtgattatcttacatttggcttttactttggaaaatattaatattagaaaaactgcaaaattttggaatctagattaaagaacgatagattatgatgataactgtttatgattcttattttattatttcttttttgaacctgcttttccaatctagataagcatgtctagtctcataccatattcatactgcatattataacatggtgttaataatcttaagtaatattccatggccaatcaaccttttttggacactaatactcattatgagactgagcttaacagctgttttttgtttttgtttttgcttttttagcatttaagtttaggggtatgtgtgcaggttggttatataaatacactcatgtcatgggggtttattgtacagattatttcatcatccaggtattataatcctagtacccatttgttatttttcctgatcctcttcctcctctcacccaccaccctgatgtagggcccagtgtccattgttcccctctatgtgtccatgtgttctcataatttagcccccacttgtaagtgagaacatgcagtatttggttttccattcctgcaatagtttgctaaggataatggcctccagctccatgcatgtccctgcaaaggacatgattgcattattttttactgctgcatagtattctatgatgtatatataacgcattttctttatccagtctactgctgatgggcatttaggttgattgtatgtctttgctactgtcaatagtgctgcaatgaatatatatgtgcatgtgtcttcatgatagaacaatttatattcctttgggtatatacccagtaatgggattgtggagtcaagtggtagttctattttcagctgttttaggaattgccacagtgtcttccacaatgattgaattaatttacacccccaccatcaatgtataagtattcccttttctccgcaaccttgccagtatctgttattttgtgacttttgaatcatagccttctgactggtgtgagacggcatctcattgtggttttgatttgcatttctctaataatcagtgatgctgagcttttttcatatgcttgttggcctaatgcatgtcttctatagaaaagtgtttgctcatgttctttgcccagtttttaatgtggttgtttattttttgcttgtaaatttaagttccttataggtgctggatattagatctttgtcagatacacagtttgcaaaattttcctcccattctgtaggttgtcagtttactctgttgatagttttcatttgtttgtttttgttgttgttgttgttgttattgtttttgctgtgcagacactctttagtttaattagatcccaattgttaatttttgcttttgtcacaattatttttgatgtcttcaccatgaaatctttgcctattccaatatccaggatggtactgcctaggttgtctttcagggtttttacagtttggggcttttttttttttttttttctgaggtggagtctcactctgtcgcccaggctggagtgcagtggtgccgatctcagctcactgcaacctctgcctcctgggttcaaacaattctcctgcctcagcctcctgagtagctggaactacaagtgtgtgccaccatgctcggctaactttttgtatttgtatttttttagtagagacagggtttcaccgtgttagccaggatggtcttgatctcctgacctcatgatccgcccgccttggcctcccaaagtgctgggattacaggcgacagccaccatgcccagccagttttaggctttacatttaagtctttaatccatcttgagttgatttttgtacacagtgaaggaaagggtccagtttcaatcttctgcatatggctagccagttattccaacaccatttattgaatagggagtcttttcctcattgcttgtttttgtcagctttgttgaagatcagatggatgtaggtgtgtgatgttatttctgggctctctattctgttcctttggtttacatatctgtttttgtaccaataccatgctgctttggttattgtagcctgcagtatagtttgaaattgggtagcgtgatgcctccagctttgttctttttgcttaggattgccttggctattcagactctttttttattctatatgaattttaaaatagtttttttctagttctgtgaaaaatgccgttggtagttagcagcttgtttttgtttgttcatttgtttttgaaacagaatgttggtctgtgccttaagtttgaaaatcctccaaaattttctgtcctttcactgaatatgtggtctcttggtcacaatgcagcactgaattccctgttaatatgcatatcttgggttctttttattcagtacacacagaggttgttcccttgaaaatgagtagtccagtaaaatgccctttgcagagttatatcccatatttctagaaataaattctaccaaatattagcactactgaataacacttttaacaatgtttaaacttgcctttttagttgaaagcaaacataaactcagctgtaatatcttaagttcaaatgcactaattttcaatttcatatcaaatttcaaaatacttttaggtttctattcaacactttggttttcatacacaagccacagagtatactaaaactcatttgggtggcatgtttctcatataagtaaaggtaaagactaaggacaagtaagttctttattttctaccagggtgaatggtaaagtagtaaagatcagtatttcctggaaaaggggaaaattgctttcagcaggagtttacaaatccacttggccattaaacatttttcacagatgacatcaaaagtgttattcacataaatgcatgggaatttttttccaatgtatgtaggtgttattatgttaaataaaacacagacccacttaaacatcatttaatttatggtaggcttttcaacaagctggccagatttggttgatgtttctcaaaaactactaaaatttcaataaagtgaatgtctgtgaagtgctttgaaatttaaaagagctgttgaatgtgtgcaaagatttagctatagggatgttcaatgaatcactgattatcacaaagaaaatgtggaacaacctaaatatgcaataataggagtttgattaaatacattatactatatccataataattttgcccttttggttgcaagaatcacagatacagtcagacaatttcagaataataggtgcttttgcaaagaagcattagcatctctgctgcagggcgtagtcctaactcctacccttctcctctcaaggtggtttattggtataatttttaaagacaccagtgccccctgtttttccctaacttagcagagaagatctgacaaacctattcagtcactatcatgtatgaagcatctctcatattcataaagtgtgggcaagaggctggtatagggtaatagactttcccaactataataggataagagtgattgtagctatcaaaaatatgacagatctttcaaaagtatgtgaaattattaatttaatgatgacccgtaagtcatgattttatactatttggcatagcttcacaaaacacaattttcatatgtattgaaaactaaagcaaaggaaaagtataaaaatttttgtgtaactgaactgacatgatatcagtcataaaatctctgcttgacaatctcatctgtcattctttcaaaaataacttatttattaatgtcaacagtgatgctgctttgcactgtattgaatataaatctgttgttcttttggcatttgggctaaggttggctaaattatcttagtaaataaattagcaaagcacctttttttttttctttttggcaatctctctctataattcctctttacctgtatcagtttttctcttttcctcatatttctcaaatatatatcaccattggttcttctttctcttgattgagaatttctgagaaatgttggtccatagtaaccagtattccaaggttagatgaaataaccaggacttagtgagaaatgattgttcagtaccatggatagcagaacacttatttccccaaatactaacacatactcctccaaattttagctgcaccattgaaaacatttctttcaacatgtctttggctcaggctattattttcaggccaagaagttctagtcagactagccaggctggctatactttttaaactatctgtggcaaaggatcaagatttttcccaccactcgatctaccgtgtaccaatatgttcatcatggaaactgaacaacctgctcctgaatgactactggatacataacgaaatgaaggcagaaataaagatgttctttgaaaccaacaagaacaaagacacaacataccagaatctttgggacacattcaaagcagtgtgtagagggaaatttatagcactacatgcccacaagagaaagcaggaaagatctaaaactgacaccctaacatcacaattaaaagaactagagaagcaagagcaaacacattcaaaagctagcagaaggcaagaaataactaagatcagagcataactgaaggaaatagagacacagaaaaacctccaaaaaataaatttataaaaagttaaagcaaacacacaaaatacaagtagtaatttcttttttattattacataaaaaacaaacataatatagtctgccaaaattgctgtgacagttttaaacagccctgtgatggcatccagttgataaaagtgagtagagccccagtatgtgagagaggcagagagtttccctctgtgacttacctttccactggagatccaagcaacccaggccaagagagagcactttgcttctcctaatccctggagttagcttagggagagtcttggagaaactgtgaaggaaagacaccaggaaaagtggcagaagttttctcagaccctggatgagagtaggatgccattttaaatctgggtgcatacaaagtcagccatgctttggtgccctagcaccatggctacagaggcactttagtcttgtgccagagattgaagcatcttatctggagtggggtgggggcctccacagccagaactgtaaaaaagtgtctcagcagtagtctctggaattgtgctctctcccatcacaggcaggaggagagctgctacagttgcggtttcttctgagcagcaagacttgcagccagggccagcttggcaatctggaactgatctgtgtgtgccattgctgagtgccccatcctcctcccctgagatcgtggtgcaacagagccctccctgctccattcctaggcagaaatctgggtatttggaacacctgcttgcctggaccggtggtctgagccacaccacccttccttgatgtatatggtggtacagagagggtctctgtgctccatgcccaagcagatttctaggcattcagagcgctcattcacctggttcagcagcctgagccacctaccctccttgtgcaaagactggtacagagggaccctctctgctacatgcccaggaagatctccaggcattcagagcgcctgcttgcttagttcagcagccagagtcaccccacccctcatgtgcagagatctttgtgcagcggggctctctctgctccacacccaagaagatctctagacttttggggcattgctcaccaggaccaccaagactgtccaaagatcttggtgcaaggaatccctctctgttcacactcaggcagatcaccagacattctgagcatacagtcatctggttcagcagcctgagctgccccaccatttatggacatagatcatggtatagtaagaccctttctgctccatgctcaggcaaatctccaggcatttagaatacctgcttgcctggtgtggcaacctgggttgcacaaccccttctgttcgtagatattggtgcaggaaggccctctctgctccacacccaggaagatctgcaggcatctgaagcacccactctcctggattaggaacctggaacacagaacttggagcaaaggtggtttcctgactccacatttagacacacttctgggtgcctggtagccacccacggattctcacttgatactggtgcttgtgcctgcatcaggggacctccaggcagacctgcccaactggtcccaccctttatggctcctacccccacagtgctgagcagggacctcagaccaatgtgtattctatgaatcaacccattgcctgggcaacagagaacttccacttctaaatacagataccagccactttgaccacagctggctgttatctacaggcttgtaggacaaacttcacagcccaatataaaacctgttgaaagaagtgcatactgctatagaagaaaaactgaaagaccctcctcagcattcttcacagtcacaccccataaagcacgtaagggaaagagaataatagtaatgacattataaggaaagaaagataaaggaaaagtcctacctgtatgaaaaaaaatacaaaaattagaagtgccagtgtctccaggtgagaagcaaccagcacaagaattctagcaccatgaaaaaacctgaatgtagtgaaaccaccaaaagattgagctacctctccagcaatggtccctagccaaaatggaaactcagaaataataaataaaaattcaaagcgtggattgcaaggaagctcattcagatccaagacaaggttgaaaatcaacaaaaggaaatttctaaagcaacccaggaaatgaacaaaaagataaacatcttaaaaagaaatcaatcagagcttctggaattgaaaaactcacgtaaagaattccaaaatacaaatgaaatctttatcaatagactgaaccaagcagaagaaagaatttcagagattgaagagtggtcttttgaactaacccaatatggcaaaaataaatatgaagaattttaaaaatgagcagtcctcatgaaatatgggattatgtaagaggactaaatgtatgaattattggcattcctgagagagaaggaaaaaaacaaacaacctggaaaatatagttgaaagaataattcaagtaacatgcctaatctagctaggaagatagatgtccagatacaagacattcagagaatacctgtgagatactatgcaaaacaaatatcaagccatgtagactacaaaccatgtagtcaccagattgagcaaggtcaacgctaaagaaaaaatcttaaagactgctagaggttttccttaggcaaagatcttaagatctttccttaggtaaagatcttaaagatctgctagaggacagatcatgtacaaagagaaccccatcaggctaatagaggacttatcaccagaaaccttacaagccaggagagactgggggcctattttcagcattcttaaagaaaagaaattccaaccaagaattctatatctcaacaaaggtttataagtgaaagataaataaaatattttccagacaaacaagtcctaggggaattcattaccactagaccagccttaagagagatccttaagggagttctaaacatggaaatgaaagaacgatacctgtaaccgcaaaaacacacttaagtacatagcctgcagaccatataaagcaactacacaatagaaactacaaagcaaccagctaacaacctcatggtaggatcaaagcctcacttatcaatattaaccttaaattttaatggtctcaatgcacgacctaaaagacacagagctgcaaggttgataaaaatacaagactcacttcttatccaagaaaacaccaaatagcagatgacgctggtggagcgagggggcccggaggactcgggggccctgggatggggaaccacagtggctttcgtggaggttttggcagtggcatctgggctgtggtcacagccatggacagagctggggctgaggccacggagctcactgaggcaaggccgaggatgagtggatgcccgtcaccgagctggacctcctagtcaaggacatgaagatcaagtccctggaggagatctacctcttctccctgcccatcaaagaatcagatatcattgactttttcttgggggcctctctcaagaacaaggatttgaagattatgatggtgcagaagcagacccacgtcggccagcacaccaagttcaaggtgtttgttgccattggggactacaatggccacatcggtctgggtgttaagtgctccaaggaggtggccactgccatctgcggggccatcatcctggccaagctctccattgtccctgtgtgcagaggctacaggggtaacaagatctgcaagccccacactgtcccttgcaaggtgacagaccgctgcagctctgtgctggtgcacctcatccctgagtccaggaacattggcatcatctcagcccctgtgcccaagaagctgctcatgatggctggtatcaatgactgctacaccttagccaggggctgcactgccaccctgggcaacttttccaaggccacctttgatgccatctctaagacctacagctacctgacccccaacctccggaaggagactgtattcaccatgtctccctatcaggaattcactgagcacttcttcaagacccacaccagagtctccatgcagaggactgaggctccagctgtggctacaacataggatttttatacaagaaaaataaagtgaattaagcctgaaaaaaaaatacaaggctcatcagtctgctgtgttcatgaaacccatcttacgtgtaaagacacccacaggctcaaagtacagggttggagaaagatctaccatgcaaacagagaagaaataaaagcagcggtcacagcccaggtgctgtggctcacacctctaatcccagcactttgggaggccaaggcaggcagatcacttgagcccaagatttcaaaacaagcctggacaacataggaaggccccatcctttaaataataaacaaaaaagcaggggtcactattcttctatctgataaaacatactttaagccaacaacagtaaaaaaaagacaaagaaggccattacgtaatgataaagggttcaattcaacaagaagtcttgactctcataaatatgtatgcatcaactttggagcaaccagatttataagcctgctaaaagacttagacagccacacaataatggtaggggtcttcaacccccaactgacagcagtagacaggtcatgaaggcagcaaactaacaaagaaactctgaacttaaactcaacacttgaccaactagacctaatgaaggtctagaaaacactcaacccacaaaccacagagtatgcattcttcttatctgcacatggaacatactccaagattgaccacatgctctaccataaagtaagtctcaatgaaataaatatcaaatcaaccatactctcaaaccacaatagaataaaaatagaaatcaataccaagaaaatctcttaaaactacacaattacatggaaagtaaataatttgatcctgaatgacttttgggtaaacaatgaaatcaaggcagaaatttaaaaattatttgaaataaatgaaaacagagacacaacataccaaaatctctgggattcagcaaaagcagtattaagaggaaagtttatagtgctaaatgcttacctcaaagagttagaaagatctcaaattaacgatctaatatcacatctagaggaactagaaaaacaagaacaaactaaccccaaagttctcagaagaaaagaaagaactaaaattagggcagatattgagaatcaaattgagacccaaaaattcatacaaagtatcaacaaaactaaaagttggttctttgaaaggataaacaagatcaatacactagattaacaaagaaaagaagagagaagatccaaataagcacaatcagaaatgacaaagaatgacattacaactgatcccaccaaaatacagaaaatccttggagaccattatgaacctctctacacacaaaaactagaaaatctagaggaaatgataaattctgggaaacacacaatttcccatgattaaatcaagaagaaattgaaacattgaacagaccaacatcaagttctgaaattgaatcagtaataaaataaaaactaccaaccaataaaagccccagaccagagggatttacagccaaattctaccagatgtacaaaaagctggtaccaattttactgcacctatttcaaaaaatcaagaagggagtcccttctaacacattctacaaagccagcatcaggccaataccaaaacctggcaaagacacaatgaaaaaaagaaaattgcaggccaacattcctgatgaacatagatgcaaaaatcttcaacaaaatgctagcatactgaattcagaaacacatcaaaaagctaattcaccatgatcaagtagacttcattcctggaatgcaaggctgattcaatgtacacaaatcaataaatgtgactcaccacataaagaattaaaaacaaaaacaatatgattatctcagacacagggaaagcttttgataaaatccaacaattttttgtgataaaaaccctcaagaaactaggcatcaaaggaacatacttcaaaataataaaagcaatctatgacaaacccacagtcagcatcatactgaatgggcaaaaattggaatcattccccttgagaaatggaacaaaacaaggatgcccactctcaccactcctattcaacatagtactggaattggtagccagagcaatcaggcaacagaaagaaataaaaggcaaccaaataggaaaagaagtcaaactatctctcttcatggacaatatgattctatacattgacaaccctaaagactccaccaaaagcctcttggaactgataaatgacttcagcgaagtttcaggatacaaaatcaatgtacaaaaattagtagcagttttatacaccaatagcattcaagctgagggccaaaacaaaaatgcaatccgatttacaatagccacacacacaaaaaaatacctggaagtacatctaaacaaaagaagaactacaaaacactgcaaaaagaaatcagatgacacacacaaatgaaaaaacattccatgctcatagattagaagaatcaatatcattaaattggccatgctgcccaaagcaatctacacttttaatactactcctatcaagctaccaacatcatttttcacagagctagaaaaaaaactattctaaaatttatacagaccaaaaaagagcccaaatagtctaagcaatcctaaaaagaaagaacaaagccagaggcatcacattacacaacttcaaactacactatatgctacagtaccaaaacagcatggtactcttacgaaaagagacacgtagaccaatggaacagaatagagaacccataaataaagcctatgccatctgatgtgtagaacacctaaagccatctgatctttgacaaagttgacaaaaataagcaacagggaaataattgcctattcagcaataaataggactgggatagctttccagccatatgcagaagaatgaaactggatcccatatactacaattaactgtatacaaaaattaactgaaaattgattaaaaatttaaacataagacttcaaactataagaattctagaagaaaacctaggaaacaccaatctggacatcggcctggggaaagtattgatgactaaattctcaaaagcaattttaacaaaaacaaaaaatgacaagtggacctaattaaactaaagagcttctgcacaccgaaagaaactatcaacagagtaaacagacaacctaaagacagggagaaaatgttcacaaactgcacctgacaaaggtctaatatctagaattcacatgaaacttaaacaattgaacaagcaaaaaacaaataatcccattaaaaataggcaaaatacatgaacagacacgcctcaaaagaagacacacaagaaacatgaaaagatgctcatcatcactaatcatcagagaaacgcaaaacaaaaccacaatgagatagcatctcacaccagtcagaacggctgtgactaaaacatcagtaaacaacagatgttggcgaggctgtggagaaaagggaatgttcctacactgttggtgggaatgtaaatcagctctgccaatacagaaagtagttttgagatttctcaaagaagttaaaacagaagtgtcatttgaccatgcagtctcattaatgagtatatatcaaaaaaaaaaaaattctaccaaaaagacacatgtactcacatgttcatcacagcactatttgtgataacaacatcaaggaatcaacctaggggcctatcagcagtggaatggataaagaaaatatggcacatatagactatggaatactatgcagccatagaagagaacaaaattatgtccttttctgcaacatggatgcagctgaaggccattatcctaagcaaattaacacaggaacagaaaaccaagtcctgaccattctcacttataagtggcagataaacatccagtactcacggacataaagatggcaacaacagacaatggggactactcaaggggagagggagagggtggggcaaggtttgaaaaactaactgttggctactgtgattaatacctaggtaatgggatcatttgtatcccaaacctcagcatcacacaatatatccagataacaaacctgtgtatgtacccccaaatcaaaactaaaaattgaaaaagaaaaaaaaagttttaaaggcaaatcctccattgatatacttactttgttacatataacgccatagacaatttattcccctcccccgcccaaatttgtttgccgaaacgtaatccccaatgtgacaatatttgaaggtaaagccttcaggaggttatttgttcccttataaaggaggccccagagagatcctcctcccctcccaccatgtgatgacacagcaaaatgatgaccatctataaaccatcatgcaccaaatctaatagtgccttgatctttgacttcccagctcccagagctgtgaaagataaatttctgttgtttataagctatctagtccatgttttttttatagctggctgaacaaactataatagatgacttataagtagttttcacactggccttattccacagaccagtctttgaatagtaatgactaaaaaaattaggactttttgtctctcaatgggttctataattagcaaccacaataatgtttcaagtacccaaaaaatgtcatataatgcaatcacttaaaatgaatataagcaaagaatatttactgatgtgctgagtttcttccatacattaatgggaaaaagcatattagaaaacagtatgatcccacttttattaaagaacaagagcaggtttaaagagtcagaaagtataatagtggttacttctgggtaatggacttataaggattttttttcctttgttgtttatgtttcattagctatatatgctaattttgtacagtggtcatatatttcttttatctaaatattaggactcattgaaatggattactattttaaaattgattattcattcaatatttttatatttcaatctagggtctgttactgagtccctaagtgcttttataaatggctggataggcacctctgtaaataaagtacgtagccttagaggctgaaacaatgtaagtgcacaggaaacatttattgtaagaaaatgaaagaagtgaagttctttggttcttatttttaaagcattatgtgtcaaaaatgtatttggttgagtgtcatcaatttcatgtggcctaacctaatgttaagtggagttacagctaagtaaaatgttctgtcccgctttgagttaacaatcaatcatgtgcttacactaaatggtggataatcattacttttatttattttataaaaatgtagtttggtatctccatttagaaaaaaaattacttcattaaaatgaatcaacttaaattgacatgggcttgttactctaaatttctacttgatttccttattgtaaattatcttcaataaattaatccttatctccctaggccaggtctttgacatgtctggaacaaaactcagccaaatattaaaatgggaggacagaaacagttcaactgaaacatattagcaaaatctaagttggatgaatttatgctttttaggatgcagagcactcatgaaattgacatttgtaaagcagcatttgtagcatattgattaaaaatattcaatatatggattttttaaacagtgaaccactcattactctaatgcctcattaatatggtgtcaatctattcagaacaatgcataatagcagtgcactttctcagcatgttattctattgttcaatttgaaaaacaacaacaacaacaaataatctcaagccttttccttaaatgttgggggtttgtttttcaaattatatgggttttgtggtactagaagttcaaattttactaatgtaaactacatttctctaactaaagaatcatggtcaatgtagagaaaattattattatagaagaaattgaatcagaaaaacacctttcaaaacctcctaattccctgccctgtccacaaaagagatggaaggcaaggaggtcaccacaagacactcagagcagcatttgctgcagcaactaaaataatgggagactcattccgttcttccttatttacctggaaatataagtaggaaaagatattttattttataattaaaatattttattctaatatttgctagggacaggaagatagaatagggaggaaggcaaatatatgatgcccgatggattctttggaataaaattccatagggaatgttcctagtattaggaaaaatcatttttaacatatagtaagcaagttacttgggatgtcataagtaggatagaagtcatatgaaagttataatagaagtccttttttcttagggtaaataaatataagtaggaaaagatattaatttttttatttattaaaatattttatttatataaaataaaagtaggaaaagataccctcaaaattcatctcactgtgccagcagggagccgttgaggaaaagtctattttcagtagggaagcttggaaagagctggccaagttgcaattctctcaagaaagtaacacctgcagagagcacacattactcatatttgggatactcatgacacatcatctagccccctcctccctgcatgttagcacacggtgagcacacccactttccagtgacttcttggtgttttgcttacagaagcctacattcagcatatgaatcatctagccctccgcaagaggctgcctggaaagaataaggttttagagaaccagccctatggattgatcattggttctgaccacacaactattatgacaagtgaaatagaataacaacaaacggctatgatttttgtctttgtggatggatttcatgggggggagggcagcagtagaaagtataaatgacatgaaagaaagaatattaagctccaaaattgtgcttaagtaaatctggaataaaaaactgcagcaggttcttattgctcaattccagcccatttgcagagaataaaaaggcaaagcaatgtgggtgaaaagcaaggaatttgccaccttagctttgaatactatttcatttatgagtttaactgtttccccaccagccttcactaatttcacttgatctccatcaagaaagatggagaaggttttgatgagcaaggcagcactgacaaaattagatgtaggattaaaaaagaaaaccaatccacaatgtaatgaattactaaatttaaagacaactagtgaattcctgggcaagcatgatggatgcattcaaacatagattcttgaatttgccacaatcctatgccccatagctatgacttttcaccaaaaagcaaatttttaagagccaaatttgccatcgatgtgagtgggttgcatcttatagtcttgaacaaaaaggacaattataggtacattgagttcctggttccttggaaactaatggtttcattctctgcagattgatcacgtcaaattcatcaggttcatttccaaaaataaaaatcccctgtatgagggaaattgtggatttcatgtcagtcttctcaggaaatatttattttatttcaaaatataattccagttgatctgcctagcagaaacaagtgaaattgcttctgttatcattgagatagagtgatttccattttcaaatattccaaatggcatttacttgtggtaactgtaataatagagtaatacatttacagcaatgtgatagcaatatagaactactctgaaacacatgctgtatatctcatttctttagcctataagatatcaaaatgccaaacattacatacatatgtaattctcctacttaccacattccaggtaacttgcttacactgtatgttaaaaatgattttttcctaatactaggaactttccctatggaatcttattcaaaagaatccacctggcattatatatttgccttcttctctgttctatcttcctgttcctagtaaaaaaaaaaaaaaaaaaaaagcaccgattgagaaggaagtgtggtaaggaacagaaaatagcatcatctgtcttcacttacagaaaggccttgcactgtaagtattcatcagacatttgttggatgttttccataatcacctcatacctgtgaggatggctattatcaaaatgtcaagagaaaacaagtgtgcacaaggttgtggagaaaagagaaaccttgcacactgttgatgggagtgtaaattgctagagccatagggaaaaacagaatggaggcctctcaaaaaattaaaaataaaactaccatataatccagcaatcttttatctgggtatatacccaaaggaaatgaaataagcaactccaagggacgtcagctttccatgttcattgcagcactattcacaatagccaagacataaaaacaatctaagtttctgttgattgaaaaattgattaaaataattagggtactatgtatatatacaatggaacattattcatccttaaataacaacatggatgaacctggagaacaagacattatgctaagtgaaataagccagacacagaaggacaaatactatatggacttacttgtatgtggaatctgaaaaaaaaggtgaatacatatagaatattgataaaagaaaaaggcagaattaaatttaaagtttaattgagcaacaaacgattcgcaaatagggcatcccccagaatcacagcagattcacagagactccagcacagccacgtagtgaaagaagatttacagacaaaaaaaaaaaaaggaaatgacatacagaaatcagcagtaaggtacagaaacaactagaatggttacagcttggcatttgccttatttgaacagtttgaacacttagcagtctatgagtggctgaagtatggccactgggattggccaagactcagttattgttacaggtgcatactcctaagcttggttttcagttttgtctgacttttaagctaggttacagttcatccacatggactcatatatagaagtatggagtccttctcagaccatatttagtttgctttaacagtataatggtgcataccatggacagggaagaggaggaaatgaagagacataggtcaaagggagcaaacttgcggttatataggatgaacagaccaagagatctactgtacagtaggaggactatcattaataacattgtattgcaatactgaaaatttactgagagtagatgctcttactatagaaataaaaatatggaaagtgatggatatgttaaattgcttacctatagtaatcatttcattatggctatgtatagcaaaacctcatgttatacaccttacatttatacaatgaaaatagtattgtaccagtgttaatttcttagtttggcaaatgcaccatggtaatctaagatgttacagtagggcaaattgagtaaagaatgtacaggaactctctgtactatctttgctactcttctgtaagtctaaaattatcctaaaataaaatggttctgcccctaacaaacttttgtcatcattttcactgccccagaggatcagactaagttacctccaaggctccttttaattttaaattgacaatttatgattcaagtaaggatcacttcctgtgtgaaacattattttatttatccagctaaatacaatattgctttttcagttcccttctctttttcttgtcatgctctctatgttatacatctatgtccatgtcttatggctcctattatatttgctagttctctaagcgatgctgcatttttaacttgatatttcctacagccctatggcagtggcctgcattcaggaaattccctctaaaattgaatgaattacaaaagcaatattcctgccaatgaaaaggttttgtactatgaggaatttaccagtttttcctctcctgaatattaaagaccctctgccagaagtagcttaaggaaacgactctttcccattctctattcagatcctctccacttttggtttctagcccttcatcctgtgttggccaaaatgatttgactactttatagaaagctgtcgttttaccaagaacacaatttttaagcctttccatccataattgtttcatttaattcttaaagtttaggccaggcatggtggctcatgcctgtaatcccagcacgttgggaggccaaggcaggcagattgtctgggctcaggatttcaagacctgctagggcaacatggtgaaactctgtctctacaaaaagtacaaaaattagctgggtgtgtcgtgtgtgccaatattcccagcaacttgggaggctggggtgggaggattgcttgagcctgagaggtcaaggccatagtgagccatgatcgcactactgcactctagcctgggtaacagagttacatgctgtctcaaaaaaaaattttttttaaataaaaaaactaccaagccagcactacaagaactgctaaaaggagctctaaatcttgaaacaaatcctcaaaatacatcaaaacagaaccccctcaaagcataagtctcacaggacctataaaacaacaataaagaaagaaaaggtattcaggcaacaaatagcacaatgaatagaatggtacctcccatctcaatactaacattgaatgtaaacagcctaaatgctccacttaaaagatacagaatggcagaatggataagaattcaccaaccaagtatctgctgccttcaagagactcacctaacacataaggactcacataaacttaaggtaaagggatggaaaaagacattccatgcaaatggacacaaaaagcaagcaggagtagctattcttatataagacaaagcaaactttaaagcaacaatgttaaaaaaaataaagagaaacattatataatgataaaaggccttgttccacaggaaagtatcacaatcctatatacatatatatatatatgcacctaacactggagctcccaaatttataaaacaattgctactagacctaagaaatgagatagacagcagcataataatggtgggagacttcaatattccactgacagcactagacaggtcattaagacagaacgtcaacaaagaaacaatggatttaaactataccctggaacaaatggacttaacaaatatttacagaacattctccccatcaaccacagaatatgcattctactcatcagcacatggaacattctccaagatagaccagatgataggccacaaaacaagtctcaataaatttaagaaaactgaaattatatcaagcactctctcagaccacaatggaataaaattggaaatcaactccaaaaggaactttcaaaaccatgcaaatacatagaaattaaataacctgctcctgaatgatcattgggtcaacaatgaaatcaagacaaaattaaacaattatttgaactgaacaataatagtgacacaacctatgaaaacctctggggtacagcaaaggctgtgctgagagaaaacttcatagccttgaatgcctacatcaaagagtctgaaagagcacaaatagacaatctaaggtcacacctcaaggaactagagaaacaagaacaaaccaaactcaaacctagcagaagaaaggaaataactaagataagagtagaactgaatgaagttgaaacaaaaaagcatgcaaaagataaatgaaacaaaaaactggttctttgaaaggataaataaaactgatagaccattagtgagattaaccaagaaaagaagagagaagatccaaataagctcaattagaaatgaaaaaggagatattacaactgacaccacagaaatacaaaaggtcattcaaagttactatgaacacctttatgtgcataaattagaaaacctggaggagatggataaattcctggaaatatacaaccctcctagcttaaagcaggaagaattagaaaccctgaacaggccaataacgagcagtgagattgaaatggtacaaaaaaaaattgccaacaacaaaagtccaggactagatggattcacaggtgaattctatcagtctttcaaagaagaattggtaccaatcctgttgacactattccacaaaatagagaaagaggaaatcctccctaaatcattctatgaagccagcatcaccctaataccaaaacggggaaaggacgtgacagaaaacaagaaaactacagaccagtatccctgatgaatatagatgcaaaaagtccttaacaaaatactagctaactgaatacaacagtatatcaaaaagataattcaccatgatcaaatgggtttcattccagagaagcagggatggtttaacatatacaagtcaataaatgttttacactacataaactgaattagaaacaaaaaaaaatcttaaaagtctaggctttctgcctttactacacagagttgatcaactccatctgctactttttctagctctaaatctgattcacaatcattacaacccaggaaacataataggtgcaacactcttttctgactctttaatagattgtttccatttggaaaaaaatctcatttatttgtcggatatggaagctgtttcataaattttccagatctgagtgagaaaaagaatatttaagtgaagattacccataaaattttgaaacacacatccctttttttttcttggtagaagaataagatttcaaattttattttcaaaaacccatcatagaaaataatttttgttttctgtatgcctagcaaggagaaaatctagatccagatttagaaaatctggaccggctaatttttgtatttgtagtagagatggcatttcaccacgttggccaggctggtctcaaactcctgacctcaggtgatccactatcctcagccttccaaaattctgggatgacaggtatgagccaccacacctacagcatgggtgacagagtgagattcagtctcaaaaaaaagaaaagaaaagaaaatctggaccatagtctgacatacttcctaattgcccggagaatttatgaatttatattgagtcttaacagtgaggccttagacagtgattcagtttcctcagtgctagtaatcaaattctattgcttgtgacaaacacagaagataactttagcagataatataacatagcagataactaagtgaacaaatacacttttctatagcaagcataatctagcaaatactaccttgttttttattgtgtaagaacacttaacatgagatctaccctcttaaaaagttaagtgtatatttgttttgttaactataggcacaatattaaacagcagacctcaagaacttatgatcttgcataactgaaactttatagcctttaaaataggaactcttcattttctcttccccccagcctctggtaaccacaattctgctctctgcttctgtgtttgactgttttagatacctcagataaggggaatcatgcaatatttgtccttctatgactggcttatttcacttagcaaaatatcttcaagtttcattcatgtagttgcatatcgtaggacttcctccttttaaggctgaataataacccattatatgcatataccacattttcttcatttattcatccatcagtggacatttcattgtttccatatcttggctattgtgaataacagctgcagtgaacaagagagtgcaaatatttcttcaagatcctgatttcaataattttggataaatacctagaaataagattgctggatcacatgctatttctatttttaattgtgtaggtacctccacatagttttcatagatgcagcaccatttttcattcccaacaacagggtaaaaaggttccaatttctccacatccccaccaaactattatcttttgtgccatcccaacagttgtgcaatgataagtcactgtggacttgatttgcatttccctgattgtaagtgatgttgagcatttttccataaggttttttggccacgtgtatgtcttctttagaaaaaaatgtctatttaaggactttcccattttttaatctggttatttctatacttttgctaattaagttgaaagagttccttatatattttggttattaaccccttatgagatacatggtttgcaaatattctcttccattacatagatcgtcttctcactataataatcatttcctttgctgtgcagaaactttatagtttgatatagtctgttgtctatatagtctgttgtctatgtttccttgtgttgcctatgtttttggtgtcatatccaacaaatcactaccacaaccagtgtcatgaagcttttctcctatacattcttctaggagttttacaatttcatgtctcgtgtttaagtcttcaatacattttgaaataatttttatgtagggaaagataagggtccaatttcattgttttgcatgcagatgcccagttatctcaacaccattggttgaagagactctcattttcccattgtgtgtagtcttggcatccacatctaggatcaataaaacatatatgctcgtgttaacttctatgctgtctattctcttccgtcggtctatatgtctctatgctagttgaattttgattactgtaactttgtaatatattttgaaatcaggaagtgtgatgcctccagctttgttctttttcaagattgctttggctattcagaatcctatgtggttccatattaattttagaattattttatttttctatatcagcctaccttcagatatcaacacttccttctgtcagataatatttgcacatcctgttctctgtagcctggaatgctctcctcctctcttttcactgccaccatcataccacttatacctgcttaactgctatccatcagatctctgctgaaaagtaattccttagaatgtttttcagtaacactgttcacctccccactgccccttcccccccccacacacaatacctgaaatctctgcctacctaaggcaggtttttcctgagttttttctcaatggtataacatttgggactttgataggaagtatgataaatttgcagattgcacaataagaagtaaggacatttgaacaatattaagtcttccggtccatggtccatgtacacaggacacctttccaattgtttgtgtctttttctttcattaatgttttgtggtttttagtacaagtcatttaccactataattaagtttattcctaagtattttattctttttaatgttattgtaaatgggactgttgcttaatttccttttcagttattaaaaatgattcattattaatatttagaaatgcagctgattttgtatgttgattttgtatcctgtgactttgctgaactcatttgttacttctaacagtgttttttggtggaaacttcagggttttctatatatcaggtaatgtcatctgcaaacggggacaatttgacgtcctctttttcagtttgaatgccttgtgtttctttttcttgcctaattgctctggctaggacttccagaggagaagtacctaatgtagatgacaggttgatgggtgcagcaaaccaccatggtacgtgtatacctatgtaacaaacttgcacgttctgcacatgtaccccagaacttaaagcataatttaaaaagaagggtggtaaaagtgggcatctttgtcttgttctagattttagagaaaaaactttccattttcagcattgagtataatgttaactttgagcatttcatgtatgtcctttagtatattgagttagtttccttctattcccaacttgtttagaatttttatcataaaagggtattgaattttatcaaatttcttttctacatttattgagatgattgtgtggtttttaccctttattctattaacatggtatatcacattagttgattttcatatgttgaatcatccttgcatcccagggataaatctcacttggtcatggtgtctgatccttttaatatgctgttgtatttggttggctagtattttgttgaggatttttgcatctatgtttatcagggttattggcctgtagtttgtttttcttacagtgtctttgtttggcattggtatcagagccaaggtattttacttggtattttaatatttggcctaataagatgagtttggaagtattctgcttcctagattctttggaagaaattgagaacatctttaaatgtttggtaggagtcaccatttgacttttctttgttgaaaagtatttgatcactgattcaatgtccttactagttataggtcttttcagattttctattgctcagtaattcagtcttggtaggttgtatgttcctaaaaatacagccatgtcttctaggttatccaatgtactggtatataattgttcatagtagcctcatgattctttttatttctatggtatcaattacaatgtctctgcttctgttttcatttatttgtattctctcttttttccgcagttatactattggggaaagttatactaatatcttgttaatcttatcttttaaacaaatcaattcttttattaaattttaaattatttttctattttatatttcatttggttctgttctaatctttattattttcttccttctgctaattttgggcttaatgtattctttttctggttctttggggtgtaaaattaggttgtttacttaagatgacctttttcctatgcggatgcttccttccatttctcctgcccttggacatcagactccaggttcttcagccttcggactcttggacttgcatcagtggtttgctcggggctcttgggcctttggccacagactgaaggctgcactgtcggcttccctgcctttaaggcttttagcctctgactgagccaatactggcttcttttctccccagctcacagacagcctattgtgggtatttgccttttgatcatgtgagacaattctccctaataaactccctttcatatattcatgtatcctattagttctgttcctctggagaaccatgaataatacagcacataactggaacttgaggtttttaaaatccatttagctatttctaagtcttcatggagagtttaatccatttacctttaaagtaatcattgctaaggaaggatttactattgccttgttgttaattgttttctgtctgacctgcaattcttttatctctggttatcttcctttgtattttttaaaattttttatattgatattttatattgaaattttatattgatattttatgtaggtattatctttgtggttaccaaaggtttacataacacaacttttattatgttatctattttaagctgataacaacttattttcaatcacatacaaaaatccctgcccccacatactttgttatattattgatgtcacaattcacatgtttttatattatgtatcttttaaaatatttttataggtgtggttatgtcagtacttttctggcttttaacttttatcctgaaagtaaaagtaatttacacaccaccattacagtattacagtgttctgttttgtctatatatttatcttcaccagaaatttttgtacttccctttccttttgttctgtcatttcacatcattttgtttcaacttaaagaactcccttaagcatttcttgtaaagcagttccggtagtgatgaatttcctcagcttgtgtttctttgggaaagtcattatctctccttcatttttgaatgatggtgttggccatatatagtgttcttagttgacagattttttttctttcagcacttttaatatatcatcctgctctctagtgacatgcaaggtttctgctgagaaatctgctgacagccttatgcagattccctgtatgtgataagtcatttttttcttgttgctttcaaaattctatttatctttggtttttgacaatttgattataatgcatctcagtgtggatgtctttggatttatcttatttggagctcttaggcttccttttttcctccagatttgggtaatttccaaccattatttctttgaataagctttctttccatttctgtctctcttcttgtgaaattcccataatgcatatataggccacttgatggtgccctataagtcccttaagtgagcttttatcactctttttcatttttttctttttgttcctctaactgaataatttctaatgttgtgtctccaagtttgctgatcctttcttctgcttgatctagtctgctgttgaatccctctagtgaatttttttagttattgtattcttcagctcattgatttctgagctggtttcttggtagtcttttttaatgttttctatttctttgttgaaattctcactttgttcatgcatgttctattgacctcattgagcatctttctgatggttattttgaattttccatcagagacataatatatctccattgcattaagtttgatttctggagattaatcttgtactttgttttggacatatttacctggttgtttttcccttggttcttcattttagtatatctggatgttaaacaaaacagctacctcttccagccttcatggactggcctcaaacaaaagaagaccttcacctatcagcctgaccagagattctgggggcttctcaaatctgtatgctaggcaaaaccatcagctatgttcttagtagctcccagatgtctagaatatgctgggactcatctgcattctaagacaagtgagacagaagccagttcctcaggcaatccctggaaaaattgaaacgttaaatatgtgatccaactcttttcttcctcaggaagtagatgagatctgtcgtttttctcccacttgctctgtgctgagcaagaccctcccaggtctgtgatgggggccggcatgctagttcaaacagccatctttatttttagtagctccaggtgtctggaaaattgctgagtctcatttgcactctgagacaggtgagacagaagtcagatccttgggcaacccccaggaaaatcagaatgttgaacacataatgtagttctttccttccctctccggagagaagctgggaactgggggtttcctcccaagcatatagcaatacactgagggtggggattatggttagaggatgtctcaaagtttcctatcagcttcagtgtggttggttttttgttcacttcagatccaagagcttctaaactggcttctgaatttattgcaaaaggagttgacctgtgtattggttgttgaatcactgggtttatgatgggaacgaagatccaagtcttcctattctgccatcttgctgatgttactgtcctctaattcttgaatgccttctatgtaacagagaattttcatgcacactatctcatttacttttcttaaaattctgaacaccaagttgacaaaaactaaatcgtaaagtataagatttagtaaaaatgtaggctcaaaatttttaatcacaaagctggtaagaggatttgaactcaggtacccaaagcagagtgtagtgttcctctacccagggtgtcaaggagatgtgtcaatgtgtagcacatggtttatgttcctcgggtttatttaaagcctctgagcctcatgtgtgtgttgctgtagtagtggaaaccactatcttgctaagaaggcttcacattggattgacagcaaattaccttttccattcattcacctattttcatgctgaaaatacttctcaatatttttgagtcaataaacaagaatgacttgttaaggctaggcttaccctagatggctcaggatcttgctggtggaactatttatgcctgcaaactatgaaataaaacctttgaaaactaaggccttgctaccagcatgtgtcttgtggatcagcagcattagcaccacatagaagcttattagaaatgtggaattgcaggccgtatcccagacctcctgatttcatatgcctttttgtttgaaaaagccctactctaaagcacaatatacattttgatgcttttctcatgatgtaataattttctagtatgtttgtgactaaatgcagtcaagaaagccctcaatttcttatttttctatgttcccttattttaaaataataaataatgaagagagtcttcattgcctgttagaaaacaatcacttatttacaacaatagctttacaagtccagcaattcatctaaatgcccaatttgccctgtagctctacagcatgcccacagagccaacctaggtaagctatattctttatgggaaaaaaagagaaaaataagttgatttggtaagtttttgaagttgaaacattgtaatggaaatatcactggactgggttcaataagacctacgtttaagtaagaattttccttgaaccatcaagatattcttggacaggactctttccttttctgggtcttgggtttcctcatgtatattaagaagttggcataacctgtgctccaaggtcttttcccacgcagaacatttgctaatttttctttaatagatctctccttgttccccttgtaaaccaaaaataaaattctcaggccccaaccatctaaatggacttcctcttcatccagggcactcttaaattttaacttgagacaccagttcttgtcatgacaggaagctggaggtcagacatgcctcactctacctctctggcattaatatgaatacagactttaagcctgataagaaacattttacagcccattctctctgaagcctactaactgaaggtttcctctgcaaataagaactttggtctccacaattctttatcttaacccagacatttctttctattgatcccagatctttacataaactcaaccaattgtcaagcagaaaattttcaaatctacctgtaagctggaagcacaagctccaagttgccctgccattttggaccaaaccaatgtatttcttaaatgtatttgattgaagcctcatgtctccctaaaatgtataaaccaaggtgaaccacaaccaccttggacatatgtgctcagtgtctgccaagggctgcgtcacaggccatggtcactcatttggctcagaataaatctctttgaatattttacagagtgtgactctttttgtcaacatcttcatctcctcccccactgctatttcctagtccaagtccttcatttattgctatagcttttttttttttttttttttttttttgacagaatctcgctctgtcgccaggctggagtacagtggtgcaatctcggctcactgcaacctccgcctcctgggttcaagcaattctcctgcctcagcctcctgagtagctgagactacaggtgtgcgccaccacatctggctaatttttgtatttttagcagagatggggtttcaccgtgttggccatgatggtctcgacctcctgacctcgtgatccgcccgcctcagcctcccaaagtgctgggtttacaggcgtgagcaaccatgcctggcctgctacagcattttaactagtctcctgattcctgctttcttggtttcctgcttcctcagttcaactagtattcctttgttcccaaaagaaaagctgaccatgttcatctcatgcctggaacactttaacagccccaaggctgtttctgttgcttgaaggtgctatgctcatcttctgtccctaaccacactgctactttccatcccctcttgcctgaaatataccacacacaccagcctctttacttagcttaatgttgctcatcttttttcttttgagacggcatttcacccttgttgcccaggctggaatgcaatggtgcgatcttggctcactgcaacctccacctcctgggttcaagtggttctcctgcctcagtgtcccaagtagctggaattacaggcatgcttcaccatgcccgactaattttgtattttttcagtagagaccgggtttcaccacgttggccaggctggtctcaaactcctgacctcaagtgacccacccgcctcggcctcccaaagtgctgggattgtaggtgtgagccaccacacctgcccttgctcatcttttaagtgtcatcttcaccgtcactggtaaaatactcttgctgccatggtgctctgtgcttttagtcataatatttgttgcttcttactgttattgcttatttgtaacttatctctgtgagggctgagaccagtgttccgtgctcacaatcatgttcttgtagataataccaagtaagcactaaaaataattgcttgaattgcctatatgaattcttgtcttctacttccattgttgattaaataataataagctctaaatattgctttaaggaataggcataattcactcaagacatgtagaaaaattcctggcatatattattcacttaatgtatgctagctattacaattgttattattcttttctctctttaattacagcagtcagtatgggcttaattataattacctgataactaaaaatttctttcttactttgaagctaaatggaatacttaaaaatgtagatgcattaatcaattaaacaaatgcatcaggttaatagtatttcttattccaatgaaacaaagaatcatattgttatatactatatatataactcatcatattattataaattatgcaccaatatatttgcaaaataatgcattgaattattattaaattcttctgcaaatggtgtgtgatttgttttctcaaagcttaacttaatgggaaaggcttgagagaaattgtcattgtaaagaaaataaatcctggatacttatgacctaaaaggaaatctggcatgtatctcttaatattcttagaaattactcaaaggttcagcttttattaattcataactcttcaaagttatgaatcaatagatcctaaactccaatctcccatccaatatttgaatctctgtggcaccatcttagcccagtgaatgaacagccactgcatggaaagggagaagattaaagctctattagttcccatagcaacatatgatttattaaagttttatctatgatttttttaagaatgcattctctgcaaatcagaaacaaattataacatagtcatagaagaaaaaatgaagatggatggtggataaggaaacaattgagatatttatattagtttccttctttgtcaggcattaaataattatacaggtaggagttataaccagaaaagatgcaaaatatcagtcttattctatcgccattatatcattcaatattactcttattcccaatttacaagctttcttcattgtctcctagctattctttgttgatattctttctctccatctgattcctccttcctccctttttactttcatgcttctcttcctactagctctctttgtttgtccaggtattctttcatttctataatacaataatatggttttaccttaataacccagaaactgaactataataataaaaataaatactctgacacaggaggggtaggctggacagccacagtgagaatatgtggttaaaggctcaaaacatgtaggctggttatgtggatggatagataaatttaattttacagatatttctcaagttccaaacagtaaagtactatgctgtatactgtgatagatgataggtgaggtctcattttctgtacttcaatggctaaaatctcccagaaattttatatacagaactaactaaacatagcacaaaggagatggtaagaaacaatgcaaagagaggaagaagtgagaaaaaagaggcacagcagaagagagaaggggaatcttatgcagggaggaggaaatagaaataaagtagttaacaaatggaaaattaacatggactacaagaaaggcatgtttcagaacttcaagcacattaacattggttttttcaaatcatgtggatctaacacacagccactggtgaaaatgctgcgtgctatgactttattcagtttttttgttttgttttgggtttttttttggagactgagtctcactctgtcacccaggctggtgtgcacaatctcggctcactgcaagctccacctcctgggttcaagggattctcctgcctcagcctcctaagtagctgggattacaggcacatgtcaccacgcccagctaattttttttttttttttgtatttttaatagaggggggtttcaccatcttggccaggcaggtctcctgacctcaagtgatctgcccaccttggcctccgaaagtgctgggattacaggtatgagccaccgtgcccagctgactttatttagtctttattataaattgaataaaacctttgtaaatagagatattttgtttcttgtaacctgtgtggattattgtaaattagcatgatatacttgtttcagaccaccaataacagccatcttatgaacagaggctttcaaataataggcaaatgtgtgaaaagagacttaaacatttctgtaaagaattctatgaaaattttcaacattgtcattagaacttgtaccattaaaattttctaataataaaaatcatttttaaaaattattttaatgatgctaaatttctatttttcactttttgaaatacatatggtagcaagcaataagaaaatatttaatgatgacatgccaattaacaagttcaatatgtcaagtaaaagtaataatgtttccttaacaccaaatagcacagcatgatttatataaatgcccatccttccaaagaatggaatcctttcacttggtgcaataagttgaatactgtctttttacagctgttcacaaagacaaagatatttttgagcttcatttataaaacataaatatcatattgttgttccagccttcttgtaattcaaaatagcatcagtgctggctgaacatattactcatgcattggaaagttagaaatggtgacaatttgaagttaacattgtgaaatgaagatgaacgtgcaaaatgttctagctatattctgttttatgtgaataacctgaacatatttcttctttatatattggtttaagaagatgttataaatacctaacttggggacagaagaattttagtaaaggagaagagacatttaaaattacttctacgtcttactctaagaacaatctgccaattagtagagttgtatgtttccaggtacacagccatgtgtcctaagattcagacagaaggttgtgagtttacaggaagaaagaaatcgattctttctggggtatcctaaaggcttctcacagaaagtggcacttgaatagtgtcagatatttgaagcagggacaggatatttcaacaagaaggaatgcataaataggacatagacagggaagcagccggggcatatggagactggggagtttggctatttaatggggttcatggaggttgtgacagagaagtagtgtcagataagatggatggtaaataggggactaattgtggaaggttttgagtgctaagctaagtaattcagtttttatttggtaatgaataagaaaccccatggttttttttcccccaagttttaaaatgctgaatacacacatgatcagagctggctatttattggatacttagaatgcacccagctatgttaggtggtttataaatattatccaatatgatcatcacaaaagtatggttgaaagaagtattaaccccatttttcagatgagagaactgagtctcaggctatataatttgcctgtgtacaacaatctaacaagctgatttttttaatcaaaatctttttgttcattactctacataatcctgttgttttcataattctattgttttaacaaaatcctgttccactataatcctgttatgcttcataatctagtattttgaagaagataaaaatagaaaagattgagaatatgtcagagactattttaatagcgcaagaagtaatcattctgattcagttatgtttgtcactagttcaagtaacggcaaatctgagttaccatggtttctgaaaaaatgcacattgaaaaattgtatgatggttattttagatttttagcatgatgttgaggtttcctatgcaagggaaattttaaatttgttttttgcctgttggatttcttatgttattcagaaagttttgcaatgcctataatgggaactttcctagtaatatgcattaaatgtaatttccacctttttagaccatcaaaattaagcacatagtgtgtgtaacatctaaactatggcaagcaccttaattacatttttcctcttaatctcacaacaaccttgtgatgttggtgtccttctcccattttatagatgaagaacctaaggctgagagaaattctgtctgtatacgatgcaaccaacgttcatattcagccctatttgtctttaaatcactactgtttccactacagccaactgccctgtaactcctcatgtaataaaaacgactgatcttaaagtgataattcatatttcatgattgaaaaagaataaggaatcatccgtggcacaaacctgaaatgcagggagtgtagaatctatgttaatacataggctttgggatcaaaggaatgtgagattaacgctcatatccaccatcttaaagctgtgtggccttggatgtattacttaatctttcagaggctcgactgctaatctgaaaagtgcaaatagtaatatctacttcagggagttgttaagaggattaagtgaaataatgcctaaaaagtacttaacacaaagtaggctctcaataaaagtaagctctaggtgcatagcacactatgctatttccttgattctcatagcttcatctctgagtcaatcacttccaaatattaggtccaaacctctcttctgaattctggatccgtgtatcccatcacctacttggcatctgcacttggatgcccacagtcatctcatactttatatatatcaaactgaactaatgatatatgtcaccctccttccttccctgctagtatgtgctctcctgcttttatggtagtgaggtaggggtgagtgtgtgtgtgtgtgtgtgtgtgtgtgtgtatgtgtgtgtgtacaaaatcaacactgtaaccagcccacaactaatccattcttaagtcactcagtgctaagggatatgccttctaaattccccccaataccaccctagtcctagtggccatcatttctctcctaactaatgcagtcatatccactgctgcctatactcaccaaccagttagccatactctaaccagagggaccttcctgccccttgagttttaagattggtttaaagtcttattccactttgatggaaatccaaatcccccttggagtttttgttaatttggtgtaaacattcattcttataaattcttcttccctcaggagccaacttccacaaatactgcttctgtgccctaacacctccaggtgaaacccagccctttctacaagttccatggatgatccactcatacaaagcatttgtgaacattgggactcagggtgacggagaactatttgctattcagaatgtgaactccccaatggtgcattagatatttccagtcttgaatgtcctctgccctcctcaccatctggatgtttccattggcagattgccccttcttcatcccagcatcatatcatcttgggggctctcatcttataccctttttttattccagatttctttattctttattctttattcaaatccgttgtaatttgaatcccagtttggatgtctggtttttgtttgcttgcctaggttcctcaattcaccccatcagtatttccttctatcccaagtggttagttaccaagtatttttccaataaaactttccacccccaataggaattctggagccagcaagtaacatcataaagtttttgcttctattacagaaggtaaatcagatcatcccacacccctgctgaataacccataagtgtcttcccatcgcctttagcataaagcctctaacttttttagaagggtctacaaagtttcccatgatgccacctctactggccattcaaatgttattttggtttctcatccacattgtgctttctccagcacccaggccttcacattcaccgtccttaggtcctgttctttctctccaactaatcatcaggtcaactcttaccagcccataggtctctgcctaactagcacttactctaggctgcagccacctgctaggagctccttgatcatcaaatatttcttaacaatgctttttccacttgcaattatctagttatttaaaataatgtatttcctctctctccacagactcaaaacaccactagaacagaaaccagatttcttaactgtcatattctcagcaagaagcatacagcaggcactcaattgttaaaaactatctgaagtaaacattgagtcaagcatctgtgtaaaggattgccctaaatctcccttaacttctgggctttaatttattctgcctatatagggatcagtctttcagaagacccagaaaaccttagtgaaggtggagggcttattaaactatttgctttaaagttctgacaattttgttgttgctgatattaacaacccaacaagaaggggagttaaagggcagtgcttacaaaaggtcacaatatactgcctaaatatgctgtgagcttcgtaagtaggctgcactcttgttagctatcatcaggatttaattaactggtgtcacagctgaattgacatttcatgcctgtggggaaatttgactgaactcatccattccgaaataaatgattagcaccaccatctttcacattatctttcaataagtgggacagctacattttcacaacttgctggggaaaaaccattttcaaactctaaataccagtaagcatggaaaagaaggatggaaaataataaagtcaggcaaaatgatatttgtgggtgcttcattttatgaaaataaaacttgtttcagaggcagaatgaacctgttaggaacccctgtttttcataacaaattatgccagaagaatgttgcatagttttggaatttgcctgatcactgaactgttgagaacaaatgtattttatgggttcctgggttgtgggccgaccccctacccagtcagacaccagccaagcacagcttccaggtctttaaacttctcagcacagtaggccctaaaactgttcccatggtaaccttccatcaaacaggcgagctgtaaaacaggtgagctcaggctgtcatttgcagacaaaacaagaaaaagaaatactgactgctcttgttcgtgatgccacaaagagaagtaatactgattactgaataaatagactgaaagtcagaatagctgttgaactaaataggaatcatggcgttagtgtcctgacaaaaaaaaaaaaaaaaaatacagcttctaaaatgtgtatgtctcaaagaaaatcaatgagaaaacagatcacaaattttgtagaaacattagttactgtttttggaggatctcctaaatatcggatccttggatggaaaatttgcatgtatggtttcatttgtccctaccccctaaaaaactgtcataataagcttttagtatttccatgatttaccttaaataactgaggttcaaagaataaaagtgagagactgtcacttaagtgggatttgaacccagatctctgtgtctccaaaatttctgtttttttcatgatgctacactttttgaggatttatcaggcatattctagaagaagtcagtcacagtttgtgctgagggaatttgccaccaattaagtacagatatgaaaggtagcatttgggaaatcatcttggctccaggatcttacagtctggggactgtagtacaatagagtcacaaaatctgtagttataagaattgccttgagtactagctcctccacaatataatagggtagccttgagaaatccatttaattctttgaacctcagtttcttcttctgtgaattgagacagtaacttaacggaatgttctgaggatcaaaggagaaaatatatttgaaagtgctttctaaaatataaaatttggtatatgactattattattaccctacatatcacataaaatcttggcacttctttttggcagaacaatttcttttcacttaaaactggcaggttgaattctttcctcaagtgtgttttgtttaatctccaaaattaggagctgtgcagagcttccagcctgagttcattttagaagtcaggaaataattgctgcattattatatatattgaactgtcattttacacatgcacacatggcaacttgatgagaaaatatcatttgtacttattttaaattaatgcttaattggtgacagactttagctatcacctacactctggttgggccaagaaaatagagtatgatctagaaactgaaggacaaaagatgagtaatggtcaaggaaatggcagtgcaaggaattcaagggctataacctggcagcctacaggctggggcagacctgccaatgtattttctttggctagcaggggtttattttgttgtaattgtgctttttaatgatgttcttaaacagtgcatgtaccctccagtctgctaacattccatcatttgtatcctcttacacctggctgcctctcacatgtatattacctgcctgacagtaattgggagatgggagtccctttaccaaacaacaggcaaaagagatgagttttcttcattttgaaaccataaagaatgtatctattgggaagctgaggtgggcagattgcttgagcccaggagtttgagaccagcatgggcaacatggtgaaaccctgtctctacaaaaaatacaaaaaaataagcagatttggtgtcgcatgcctgtggtcccagatacttgggaggctgaggtgggaggatcacttgagcctggggagtggagattgcagtaagccgagatccggccactgcactccagcctgcatctgatcatttaacacaggaaagactgagcatgcaataggctcaggcaccaaatcccacaggagtagagaactggcatactctatctgaaaggatacatttaggatacatattaaaaagtctagtaatccacagcccattgtaaatattctaattcaacaagcatttaagaacctgccatatgatcttcaggaaagtttctggcacagagtaagtatgatgtaagtagatgctctttgttatgtcatcatcatcatctttattatcatcattgctattattattggtcagacacaattctaggaagggcaaaggctcctaactcctgtcttcctctttactcccaaatagagggtatccccagtgttctgctcagtttctgatgcatgcttgttgcccaaaatatatctgaggaatggctgcataaataatggaagactagagagaggccatctctggcctttgagatcaacagccaaaatctgctctgacaatttctgagagttgtgaataattctagccaggtgtcagaaggaacctggcgagtgtagccccgggactctgattttcctgaagaaactgaaaagaaagaatacccaggtggaaaaggtaccctggtagctggacaggatgtttagtggatgcattatgtaatgtctgcagagaatcatggccataagtgctatgtaagcaccaaacatcattaatattactatttaaaagaactgagcagcctattccttcctaggtggtaacctgagcacagcagaattttaataagtctgatcatttattgggttgccagctggagcactgaccatgctctggatgtacgtcacacagtctgatttggtgcaatcaacactggctctgactcagcatcttacctgcctgaactattgcaacaccctccttactgcctattggccttacatcatcccagtcagcctgttattctgcatactcctaattatataagtcttgctaaactgtaatggaatcatatcacttttctgcattacaagagttcatgatttcctttggcctaaaaaatatccaaactccttagcaaggcgtgtcttggtcttgggtcaccagcactctattctgagcatcctccgttgatctaaacactctagaggtctctggatgctcttcccgcttaacaagtgccttttctgaaccagattcccctggcaaactcacgagcatctttcatacatcacttgctccctgaagccttccctcacacccatctgcaggagcagaattgagggctttcttgtctacatgtccgtggcactgaacagttctcttgtattggccaggatatttggatgcaaatcttggaagtctagatcaaacaaattaaagaatatgttgggctttattcactcgtgtcaccaaactgcacagtggctgagcctttggatgagtgtgaccaggacctcagaccaaatcagggagtctaccactagcaactatcttcatggggcagaaattacaaacacttcagctctgcattcatacatactgaaagccagaaaggaacaagagctccttcccatgaattctagttataaaacttcagaggaaccactctggatggcctggcttagtccacatgagcatcacaggaaggggaccaggtgccatgattcccctagactgcttcaaggtgcctgctcagacccagtgacagggtaacatgatcagcaacccttgtcaggccctcattagatttagagtgggaaagaagcagtgtcccataagaaggtgcaagctcagatagaatttcagacaggcagaagagtaggtgtcatctggactgtcattcaaattcgataactaataacacttcagatcctaactgtgtctgtgagtttgcctctcactacagagtgagctcctagagttccagtacccatcttactcatgtgcctctgctcacacctagcatgatgcctgttgcccggttgccacttagctcatgcttgtgtgttattgaattaacaaatggatagctctccagggctctgtgaacaaaacatccggtgaacgtaattaccgaattctgtagtgtttggaagttagttaaacaaatgtttataaaaccgctataatttaaaagacattgagtggctcatgcctgtaatcccagcactttgagagtctgaggcgcacagaccacctgaggtcaggagtttgagaccagcctggccaacatggtgaaaccccatctctactaaaaagtacaaaaattagccaggcgttgtggtgggcacctgtaatcccagctactcgggaggctgaggcagcagaattgcttgaacccaggagacagaggttgcagtgagccaacacggtgccactgtgctccagcctgggcaacagagtgagagactccatctcaaaaaaaaaaaaaaaaaaaaaagcatcaagtgactcaaaactaaaatataacacaataacctttgaaatacaactagtatttattgagttcatagtgttagcatttttacgaaagacattttatgctcacaaaaattccatgagttttagcaattagccctattttataaattaagaagatgaagttaagagatgcttggacttcccctagttctcacaggtaaaaggctacagaggcggaagagaaacccaggacttctgatctcaaggctattgctttgctcttaagcaagttatttaacctgtctgggtaaaatggagataataactcttgtttctaaggattgctgtgaggagtaaaagaaaaaacatatataaacaaatgagcacatagcctggcccagatgagggcattaatggacaatagtgctaaattttcagtgatggtgggagctttccttcaattctgactagaacatatctctgacccgtttttgtccttgccccgcagcccaggaactcgtcctgtgttattctcctctttagtgccacccactctgtctccagtagcttctctccccgaagactgcttccagaacaggtcacaggctcctgggctccccttcttgctgaagccaagtgcccagaccccttttgctgcctcggttagctggccccactggttatggaaagataagtaccaagaggcataaggatatatggatcctagaccttgtcctgacatcaattagctgtgtgacatttgtaccgctgttctctcaagcgtaaaatgagaatgctggaccagagaaatcactacattaaatttgttatgtaaaggaaatttcagtaaaaatatttttcctgcagagtcaagcaatattattacttcatctcaaaaaaagttttacatatttttttacattaaccaaataaatcagcattggacttgcctacatttatcagatcagtttctattacttttaactgttccttcctgctctacttctcagcagggattacatgcctgcagcgtacactcagaattttctcctgaacatagattccaggaaaagctaaggtaaagaagacagagtagaaagcaagagcacagatgacacttcttttaggcgcactgcctagatcgcacttggcctgctgtcttcctctcattagtcgcaccaactgaatctgattagcccactctgatttatttttggcaacctggaagtgcatgggccaatgcttattttcatggctgatacaatcatccccaaagctgtcgttagcatttggaagattagtccctttctctggatgattttattgcctatgaagcatcacgacacacattagacatgtatttcttaaacactttacaaaattgagtctatttactcttcttcttattatcacaaccaccttctgttattggctgctaaaacatagagaaagaattcttcataattacatatttgatgcttatgaacttattgttttctgagttagtgaatcatctgctataatcaacaagaactaaaagccagatttcaatgctactggttactcagtgcctgatttgtctacattttgcttaacagactttcccattatgcaccaaacagtactatctaggtgaaaagtgaataataaggaaatataaataaatattttctcctaaaaatgcaactttcagatatgaagcacaatatgtatatgatttctatttatatttgtggacagtaagatttattagtaaggatcattatttttaggtctttgagatacaaaaattctgagattccaaataagtcctaaagtacatttagtataaaaaatgtatcatgaaaaatgaaacacactttggcaaattttccaataggttaaaagtaaaaggattttccatcagctctcggtgaatttgaaagcatatttataaccaggattccccattcactaagcatttaatgaataaacagccactgaccaccagcaaacttgcagctctggaggcaggactgtgttttggatccccagtacttagcaggctgtgtggttcttagtagattcttaatttgtatcgactagatgagaatatcaattagtaacttctatcatgggtatgattactctttcttttcctcgtacccaagtctcctctatccaatgaggacatctcagctgttccagatcccctcttgtaaagtctgtctacagaggattgtaaggaaagcaaaaagatagaagagaagaaaagataaaatttgcagagagagaagtttaaagagagaagggcgctatgataggggaaaaatgagaagtttaagaagtattgctggagacctcgggtgctctagttgattggggtctaatttgttgttgctgtggtggtggtggtggtgccagaatttaagaagtatttcaatgctgatgaattttccttaagaggaagggaagatgatgaggcaggagatgttgaggccaaccgacatattacttgtgttccctgcttgatcccggcaatgcattcaccgtgagatgaaggagggctctttgttttgcttaggaaggctagagggagggctctttgctttccttaaaaaatgcattgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctcagttctcaaaagaagacatttatgcagccaaaaaaacacatgaaaaaatgctcatcatcactggccatcagagaaatgcaaatcaaaagcactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcacacataggtgggaattgaacaatgagatcacatggacacaggaaggggaatatcacactctggggactgtggtggggaggggggaggggggagggatagcattgggagatatacctaatgctagatgatgagttagtgggcgcagcgcaccagcatggcacatgtatacatatgtaactaacctgcacaatgtgcacatgtaccctaaaacttaaagtataattaaaaaaaaatgcattgtattccccacactaaagtaagctgatgatggtagaggaagaattagtgcccctagtaaagacaggatccaaccccactgggttagctgtagcagcaagggtatgggggcattaaggaggagcaggagttagccttcagagcgtgagtcgggacaaagtggcaagaacaggagcacccttgggcaaagcagcccaccaggacaggggctgatgacttcactagacagtcaagtgctcccgctgcactttgggtctgtccatcataagcacacattgtgctgatatcctccatggcaccatcagagggatgagagggcatcccatctacctttgaggcctggaacctctgggtgcatgggtatctcttgcacagctgtgacccaccaccacactatacactcatcaacaaatgttcctcacctggcacattgcccagggcttgctcttggactgctggcactgccctgctccaccaagcaggggacaaccatgactcagctgctctgtgtttctgatggccaagaaaattgttccctacattctcaattcatttttcacacccactattgattcgacacccccttgggacactgacaaagcaaagttggagggtatgggtacaagagcagactgcacatagggccatgaaccattaacaatgcaatacttctagatttggtgcaggaggctagaatgtctgtgatcaccagccaataggttttaacagaaagtatagtaagggaaaagagatcaagcatctatgatagcaacctagacctttctagtcatattaaggatactgacaattgcttcaattactaatagaagtctattaacttcaaatcctagcttatgaaatgctgtggttgaaaaatgtcaactctctttaaaaatattctacagatgaatgagcctggcttagtcaggtcttaatgtgcattagtgttaatcccaatttatgttatacaggtaacaatctaagatcaatttttctttttaaggattacaaacctttgcgcatgtgtgtttaatttgggtatggggaagggagaagaagcagttagagagttctgtttaccctattggcagaaaagggccaacaggcacaggtcacaaccacaggcaaaaggaggttagagtagcctattattaaattaattttttttttctttgagacagagtctctctctgtcgcccaggctggagtgcagtggcgcgatatcggctcactgcaagctccacctcccaggttcaccccattctcctgcctcagcttcccgagtagctgggactacaggtgcccgccaccacgcccgggtaattttttgtatttttagtagagacagggtttcactgtgttagccaggatggtctcaatctcctgatctcgtgatccgcccgcctcggcctcccaaagtggtgggattacaggcgtgagccaccaggcccggccattaaatttaattttttaaaatacatactcttctcatcttcactcttcaccttcaccttcaccgcactgaatgtgcggaaagactccagggaggaacagaagatccccaacccctctattctagggatttcatatgtaaagcctgagacggtgaggatgaagaataaaaaattgtttatgaaggggaagaaggcatctgttgctaccttaaccgtcagatactatcatccccagcccctttttgcttccttagaaagagcccctgggaatcaatttgactatagaacaagcccttcctctagaggggcactcaaaccccaacatggaattggaagctctggggttaactgaggaagaaggggagaattgatagcacctcagccagcaggggagggggtctgcccttcattaatctgtaatcagccagctggacagacggcagcctgtgtttcaattgctcccatgtgaacaatgactttttccttttatgtgttctgctccccactatttcatagagagcctccctcacctccactggagacactaggtttcttgatcttttcttcaaagagaagggaggggagaggaggttgtaggtggggcaaagcccatctcatctcttcatctaagtcagagcatttgctctcctaaaaggaacctagaagggaagttctccaagttcttgctcagataggagcagatttctctcccccagcacaggtacaagacagtagcagaatacactggtcttgatgagtgatgccatcagtactgagtagcagagaggaagatttcaggaggcagggaggtagggcacatctggcgctggtctcaccctgatgcagaagcctagccctgcactgttctcctcttcagatgagtatgaggatcaccacagtcctgttcactgtagctgaatgtgcggaaagaccaggcacccatgagccaaggggtcttccctcagtcttggtgtgcaggcggcacactacttgagccctagatatttttaaattcctttcggttgtgtgggctgcattctttaggacattggctaggactaaatgactgaggatgaaaccaaatatgcctatattgcaaggattctcttgattttttttaaaaaaggcctttgaataacacagaactatgttcagttctagaattacttgttttgttgtttctatttctctggtgagaatttttaccctttcattcattatgagcatacttttagtttattaagtatagtaataatacctgatttaaagtacttggctacatccaaaacctggattttctcttgaaaattagtcacattttcttggatatttgtatattgactaattttggactatttcttgaatattgtgagtattatgttataaaggctgtaatatttatgtttcaggattaaactaatatttttgtcttagcaagaaattcacttggttggatggaacctacacatgctttctcgtgggtggcagcttgaaccttaggacaattcttttagctttggctgggctacctgcagcctgacctccccatgcatggctcaggaatcagcctgaggtttggacagactttaggaccccctccttttcaggattacctactcactttccattagcagtggttgccaagattctctcatcttttgcctcaggccagaaagactgagattttgtcagagtttcagctatctcacactgactgaagcatctgccctctggctataagctgatgtagaagatggatggatggatggatggatggatgcatggatggacggacggacggacagacacacacacagacagagagacagacagatagatagatagacataaaaataactcattctgtgccaattctgtcaagtgtcaactgccctccaaaatctctctgctttgttcatgattcagtctttagtcagttgtttatttggtaatttgtccagagtatatggttatttgctggagaaacagtcagagaggaacttgcatggccataactgaagcagaacttgcagaagcataattcaaaagaaagaaaagagtaatggataagggaaggagctagtatttgttaagctccatgtataggcagcacattaaataccttttctgttctttttctgttttcttgtgttttatccttcttgcccaaacaatgaaatgctcttatgaactttatgctagcctcacaattccacgtggaccactggcaatatagcatggttcatattttgtgtttgatcccagaagtacattgctcaatgttagaaacctgcccatgtgtctggaataactgccttgatacattctcctagaattttcctaggaggccacagcctcactccctcgtattttttcaaaacatgtaatttcaccacatagctgaaaccaagaacttccctagaacttaagtgtcaaaatgactttcattcattaattgactccttcacaagatgtttattttgtttattacatgacatagtccaataaagggatgttttaaaagttcattctcaatgcctatctcatattacagaaatctgcctaggatcaaccacatgaaaagcacttagcatatgccaggtactgatcctagagctggaagtgcagctggaaataacatgcagttcccgaccttagagtacttatggtctagtatgataagaatattaggaacacaatttagtctattcaatgttaagacagaattaaatttgtttatgccagacattctttataagtactagggcctgtaaaaactggatttctgaaaaataaaataacaagaaaaagtcagtacatttttcagtctataaaacctcttggagagtagtgatgtgtattgtgtgctttggttgctgaaaatatgtgagaaacaaaaatcaataagttaaactgttggtggaaatgtaaattagttcagccattatggaaaacagtatggaggttcctcaaaaacctaaaaatagaactaccatatgatccagcaatcccacgactgggtatctatccaaaggaaaggaaatcagtatgttgacgatttctctgcactcccatgtctattgcagtactcttcacaggaggcaagatacagaatcaacttaagtgtccagcagagggtgaatggataaagaaaatatggtgtgtgtgtgtgtgtgtgtgtgtatatatatatatatgtgtgtgtggaatatcattcagccttaaaataaaaaggtaattctgtcatttgcaaccacatagatgaacctgaaggacattatatcaagtgaaataacccaagcactagaagataaataccacgtttttactcacaatgctaaaaaaaacttgcaagttgctctagcagatgtcgttactagagccaaggaagggagagagagggggacagccaaaggcttgttaagggatgcaaaagtatacctagccaggaggaatacgttctaatgctctatagtactatagggggactatattgacactttatcgtgtattttcaaataactagaagagtggattttgaatgttcccaacacaaagaaatgataaatgtttgatgtggttgatatgttaatcaccctgatttgctcattacacaatgtatatatgtatcaaaatatcacaggtaccccataaagatgtaaagttgttatgtgtcaattaaaaataagaataataaaaccaaaatcaataaattgagtaatttgttagaggcaaatgcccatatatcgtcaatttaatcagccattccttcactgatgtaacagaaacttaacagtcatgtgttatgtgttatatgacagactcagtgttaggacagtaagttaagagatgaagacaaatgaacatgtggaacaataatgagactgattttttgtactggtgaccatgggcaagtgacttaatctttctgagcctcagtttcctcagctacaaagtgagattaaaagtaacgatacgtatctcatgaggttattttcaacattaaatgagatgtttttatatatggagcgcctggcatagtgcctggatccctgtagattcttaacaagtttcagcaatttttccaccctgctattatagaaaagaaatttgaggctcagtgcagtgaataacttactcacccgggacactacatacctagaagataaattaaacccaagcacatggtacaaagtacatgagtcttgtttgagaccagaaagaaagattaattctgcctatggagtctgagacagaatcagggaggaatatttaaaccaattccatggatgacttttcaggtattgtccataaatacatatttggagacttggagcaaagtttttaaaaagtccatcaaccgctgatcccctagacaccagcagatcctccatctggtctcttcctcactagcatagcttccttcatctttaagagattatgctggttaatctttaatgacaaggatcaacaccagtttctcaatcctgacctttttataattttcagagctagcagatgagaggaaatagacgaaataactgccttgatatattctgctagcatcactccctctaaagtaaaaagagtacttctttaaaccatgtaactttgccagcacagttgaaaccaagaacttctctagaacttgagtgtcaaaatgactcattcattatttactcctccacaggatgtttattttgtttattacatgacactgtccacaaactggaagcagattttcagtggaaaaaaatcctcaaagtaaaaccctgagaagattattaatcctaagaaggataatctctttctgattttctttgtgtaactaaaatacctatgtaactctattttaagaaataaggcttaccataaacataactaatgtttatgatacacaacaatatgtaaaaattatcttagcataactttattgccaattatctgaatataacctccatctctttttattctgtttcattcaacagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaagtaagcatcatgtgtaatattgtcccgtttcttcttattgttcccctgtttcttcccgtagggctcgaattgacagactccacccagaatggcaaaatcacttgccttaatgccaagtgacgtagattcaaagttatgagctatattaagaatacagctgaagtttgatgtttactctttaccttgtgataacaaaaatatttttaaacccaaaaaagtaaacctcaatgatgtagtatattttgagactgagtaacaatttcaaattcatgattggaccatgtaattttctgctatgttgcttaataatgtcatcataacttgtttatttttttccagagcatgtattctcatattaagcaattcagtttggggacaatgaactgatactcctatttaacctgctcaaattcaggtataggtctttggctgagagagagaaaaagatatatttatttatcaattgttattccccacctcatcttcaaaatagctttgccttctacttcttaagaaaaaatgccaagaaaaaaaattactggcattttaaccttcattagtccatgtcataaagagttaaggctgacattgggaaatttttaggaatacttttaactccatgtgattttttttcactttactcactgactttaatatctaatctcaaattaagatgtgactctactgtctatgttgacatgtggaagaaaaactgatatctgtaagacagtagagtttatcactagcacaatataatggctcagcaaagtcccttttgcttgtgttctttagtgtaagttttgcaacagctgcaatttgttaaatgccatctatgtgtgattgttctggtgataaatacgtggaaagacagtgatattatctgttgggataaaaggaagcagaaactacaagaagcaaaaactcagaaccaagctagaggacatatttttaacacatctctcaaaaattaattaaagtctccattggcacaatcccaggatcagtagtgagtcctaaaaattaggaatggcatagacccaagaccttcaaagtttatagacataatgaacagatctactagttgaattaaagggagaacttacctggtaaaatactgtcttaaacaagctctagaaaaagatgaattgcaagtcagatttaggcagcagatataggcacataacgcctacaatacaaactccttaatatcaaaagctctgtcttacttatcttcataatttcataaacacctagcccaagccttatgcttgcttaatagatgatccataaatattagtacaatttagttgagcaagtaataggagagacccggggggaaaaattaaggcacaaagaaaaatagatttaggactgtaatgacggtcgctgatccaacatttatgagcatgcactcagccattcctcatcagttgcagctgaatgattcagccctttagctaactgttcatgaagaaatttgataggtaagcaatgctaaaaaatttctagaatatcacttagcatttgcaatgagttccattcaaaatatattctattttcctttgtgatgtttttctttgacctgtagggcttacaagtgtgttgaatatccaaaaatttggaaattttgcagacatcttttttcactgattccttgaggaagtgttgttgtgatcagagaacatattttatatgatttcttttacttgaaaattgttgagatttgttttatgggtccaaatatggtctttcttgctgtgtattctgtgagcacttccagggtgaagtttcaataagtaccgaccaggtcacgttgattgttcaagtcttctatgtccttactgattttctgtctatttgttctaataatgactgatagaggaatctgaaagtctccacttgtaactgtaaatttgtctatttctcctttcacttattttggtttatgctttacatattttgaagctctgttgttattaggtgcaaaagctttcaagattgctatgtcttcttgataaactgacccttttgactatatgtaatgtccctctatattccaagcaatatgccttgtgttaatttcccttttgcctgatattaaaatagccatagttttcttttttaagtgtttgtgtggcatacctaatccacccttttgctttcagcctacttctgtctttacgtgtaaaagggtttcctgcagacagcatagagttgagtcttgctttttttttccaatctaaaaatctttgtcttttaactggagtatttaggacagcactatccaataaaaagagaatgttaaccttatatgtaatagtagattttctggtagacacattaaaatgctttttaaaaaggtgaaattaattttaatatcatggtttacttaatccattatattcaaaatattatttcaacatataatcaatatacatatttacacattttttactttcatacataaatttaaatagaaataaagttgcactagcctaattttaatcgctcaatagccatatgtagctagttgctaccaatttaaatagtgcaggtttagacaatatatatgtaattattaatatttattattataatataatacaattatttctatggttgaatttgaatttaccatattgttaggctgtcaggtagaacagggagtgagtcgatctagtcaatagttgagctgggtttaaggtattagacacctttcgttcatcacagatttccagttcttcccatgataggctgccaggagtggtagtgggtatttctcagtgtttcagtttcaccctcagtatgcagcaagccctgaacaccggcaccacagaagagctcccccagcaatagactgctgttgcttttcactcattgctaactttttggtggggacagaggatgttcttcgttctcgtggtccagcctcaggcttaggcagaccctgtgatgttagatgggacattcttgacatttttacccctcaaactacaccgacactgaaattctacattaaatccatgggtcagagagattcctgcctcttctccagtggtagcagaaccactgatactctactttgtattagtgcaggactctggtcccaaaagagtttctgctcctctcccaggaacaggcgtcttttgtttctattcatccttcaaaagaagggatattttcctgagaactagaaaggaaagatttttctgcccctccacaatacattaaggcttctcctttgtattcaggaaaggtccagggaagtaagttttcttgctgtcctcttagtggtttcaattatcatctgcacacctgtcacccccatacccccatccccagccccccagagggaggctctctctagtcccctatcctgcctctggtagtcctcatgagcatggggtagaggcccaaggggaaagctagagagagacagtagactctgtttgtgtctgtgtctcccagttagtctagaccagtggtgacctagaactttgggatgatggaaatgttctatgtccatattgtccaacatagtagccactaatttttaattttaattagttttagttcatttaaaatttgatttaaatagctctatgtagctaatagctaccatattggacagagcaattctttgcatccatttagaccatactcagcctttatgaatccattaaactcggagctgctttcttcttatctgcttcgatgttgtatcctcttcctgctgtgctttgccaaaggtgaaatagtgtgtcgcctctctccagaggggctggtcactccttcgaattcacatcacttggttcacttgttacctcacctctcctgtaacctcaagaatagttatgatttcgtgaattatgtggcttttccttgttgaggtggagaagaagtgatgttgtcctggggctttctacatcttaaggggaagagaaaacacgtattgatttccaaagagtaaaattaattcatgatggtctattaaatattatcttgtacctcatttttaaaggttcaattacattatcccaaatttgaggggcaataataggttgggaatatcagaagtgggaattagtgcacaaatatttctgtgacattaggcatgagctggcatttggtgacatttgggtttcagcttccaccttcataaaagagggaattgaagtacatgatgactaagataaattttgagctctgaaactaacattatctgtcagttaatgatgtgtttttgccatctttatttttctaactgaaagctttttaaacaagtttggaaaacatttgtagtatctgctcacagagttgacatatttctcctgagaataaaagagtacctttatagcagtcatttattgtgtgttagatgcttgtcttgatgaaataagcaatgacaaagcaattggccccagggcagtcctttgatatttcactatagttgttctgagtctgtcactcttagagaaagctgaaaaacatggcaaagaataaatttggcacagcagagtcatttggccagttcaaaagaatttcacaacccttaggctgtgacatgtcattaatatttaattgattgagaaccttcagtatattgcctgcccttcagagggaaggggtagtttctcagcacgtaaaaggatgcctggaatcagttccttggaaattgaggaaatgtcacatacacacagctgtgtcatgtgtcagtgaagttctacagatagtggctgtacacattaaagaatacacatagagacactctacaaatataatattctatacagtcctattctaaataaaaataattcatgaatttttattttagttatcaggtacattctctgtgccatgtcctaggtaccaaagaaataaagatagataaaaatactcataatcaaagatgttatactatagtggaagagacaaataaaaaccattacaaataatatgataactgctattgtaaccagaaaggggtcacaatccagacccccaagagggtgcttggatctcacgcaagaaagaattcagggcgagtgcacaccgcaaagcaaaagcaagttcattaagaaagtaaaggaatgaaagaatggctactccataagcagagcagcccaaggactgctggttgcccatttttatgtttatctattgattacatccttaacaagggggtggattattcatgagttttccaaaaagggtggacagttcccggaactgagggtttatgccccttttagaccatatagagtaacttcctgacattgccatggcatttgtaaactgtcatggcactggtgggtgtctcttagcatgctaatgtattataattagtgtatagtgagccagtgaggacaaccagaggtcagtctcatagccatcttggttttggtggggtttggccagcttctttactgaagcctgttttatcaccaaggtccaccccagtaggtctcagccttattttacccagtccctattcatgatggggttgccctgttcaaatgcctctgacactgtgaaagaattatgtgaaagagactgccttgccttcctagggagcactgggaaggcagcacagaagaaacaatcattgaaaaataaaggaaaatttgccacaagaatgaagaaaggaaagtgttacagagtcaaatggaatcgtatatgcaaataatggaggcatacatagcatggcacacttgatgactgcagaaagttaagatggcaagtgttagctgttgcagaaaataacaagaaaggtggctagaaatgttgaagaactttaagtaccttgcagaggaatttagactttaacctataagtgatgagggagaaattacataataggatttgaatggagaaagctctctcttgtagcaaagctgcaagccaagagatcctgaatcctgcattggaatagaaaaattatcaagcaagtatttggggtagtagttcaatcatatgtatagccttaggcagatgattactttctctaaatcttagttttcaaatctacaattcattctaggggttagcaaactttttctatgaaggcttagataataagtgtgttatgctttgagggccatacagactatattgcaactacacaactctgccgttgtaaacaacagcagccacacacaatacataaacaaatgataatggctatattataattaaactttatagacaccaaaattttatttttttatacaattttcacgtgccatgaaatactattcttttgtttaggcacaacatctaaaaatgtaaaagcctttcttagctcaaaagtcaaacaaaaacaggtggcagggcagatttggccttgtggactgtagtttgctcacttgatctgtcgtatcattataatatgtaatattgggataattagagtgcctacttggtgggggcattataaaataatataaagtaagcgccttaacaaagcatgcagtataggatcaatcaagataagaagtatcaatggcattaaatagaaagttactcaaggtgtcagaagtgaaggagattgagacagattgggcagggaaatatcagtgagaaggaggtgactggtttaggacaaagattctgactaaagtgagaatatcaagtaccgtacagacattgaaattttgagcagaaatgaataagaatattaaggtgagaatggaggcagggagaataatttagaaagttgttgaaatgttcgaggaaagaaatgatgagaacttgaactaaggtactggatgtgatggtcaccacctcacttggactgtgggcagctggtgttgccagacctacctcgctggcctgctttgatgtagctgagatgccaggtcaggtctcaaatgatcatctatgcaccaaacagcagctctggcctcagtccagtctcttttccctgtgcctgccatcagaagtgagggtctaatcccagatcctctccctcaagagaactgtgccagaagagacacattcttcagctggtcacatcagaggttactgaacatgaacacaattgcttctttagtttgtattctttagtccagctaaacagagcaatctcagaaagaagcaactcagcagttagcatttaataagtaatacatagctacttttgttttctttaaacaatatgtgctccacatttgtttgtatttcttgtctcttctccgagatagtcacatccagaactttcaaaactttcctattcatgatctctcttgaatgattcaaagataattaaggggcataaaatattgttcaatttgaacatgagttttcattatatgagacacctaatgagggaaaaaatgatcacactaaatgtcattttttattaaagaaaaaactaggaacttatgctaggatttcttgtcaaaatatgcagtccattcttcttgtcatccactttttgctcctaccacaaagcaaaaagaaaagcagaagcacatttccagacacaaagccacaatagttctctaagaaccagaaacaagataaaaactcaaagcagggaaatgggctgaagtaatgggccctctgtgctctgggtctggaaaagacactattgagtctgggccccaatatagtcagaaggactgaaatgctccacgctagacagggcacagagccagcctctctgcttacagcaaagattcttcctgtttgacaaacaaacaaacaaacaaacaaacaaaaacatacataaagacctgaggatgcaggagacacatattcatcttactaccgaggtccaaggctagttactctctgactcagtgaatgaatctatagtgataaccactatatcatccacaatattaagaatggcaaaataatgtcatatgtcttgctgtagactgggtgctttggtgggctgagaggatgcaatggcttaattatttttaaaagcaaggcataataagagagaaatggggagatgaaaaagcatcaaatgagcccagagcctgtgtctcaaaacacatgaagaacttatgctaaaaaagatagatatcaaaacaacgataacagttcagattatattttaaatagcaatttaacaaaaatttaattatgtttataatgttcaaggacataaatgtaagaaccacctccagtttttgaaaccagggaattagtgggaaaaaaaattggcagaaatagtgcagtgctgtgcctacagttccacctaatcaggaggctgaggcaggaggatcccttgattccaggagttcaaatcaaggctggacaacatgatgtgaccctatctcaaaaaaaatttgcagaaataaaataaaaacatatagaataaacatgaataaattaaaatttttataaatgaaaacataattatttaaattaatttaaaatttaatgcatcaaactaggtaaaattaatttgattgattaaatttaaagtttactaattgaaaagcttcagtagataggacaaattctatactgataaaagttataaagagctagtaaattggaagataataccatgcaatttgcctcataatatagcacagtgaggcaattcacaggcatggaagtgggagaggctctagctaagaaggcttaagaattcatgaaaaagaaggagggaatggtgggcacaatatttggagagatgattatgagaatttccaagacttgaaaaatgatatgaattcacagactgacagagcattccaactaagtacctaatagagtaattcaaaactaaaactacgcctaaatatataatgctatattattgttattatatatcatcagattactaaggctgaatgaaaatagataaataagcttgaaaggtacaagagaaaaaaagcgaagtatctacaaaggaatgactattctactgacagaagtcttcccttctgcaataactggtgaaagaaaacaaaaaaacaacatcttcaaagtactgaggaaaatacctgtctacctagaattttatacccagatacatcaagaataaaccacattaagaataaagataaaataaagaaatcttctaatatacaaaccctagagaacttaacacctatagctctgagttaaagaactgttaatagatagatttcagcaagaaaaaaggtgaatctagaggaaagtccaggacacaattttaaaaaatgacaatgggaatatggtatatgacaaagattgtgttacaaattagcaggagaagatggaaaaagaaccccaaaacaggcaaaagaatttaacaattctaagaaaaggaaagctgattgaccaaaaaacataagaaaaaatcattaatctccatgagcaggaaattaaaacaaagagataacatttcacacacctcagagtggcaaaaattaaaaagactgatatcagcgaaagttggaaaatgatatggagaaagaggaactatcatacactgctaatagatatgtaaattgccctaatctatttctaatctaattagaaaactttctgaggctagactatctgacacagatgatgtgtagacccttctattcaggattttcaacctaaggcgacatgccgcaaacatttattgcagcattatttgtaagagtgaatgattaaaagcaattactctactaaaagaataacaggtatattgtgtaggttatatagttgcaaaacggacactaaaataaaatttttagacgttcttgtatcaagagtgataaatcttaaaacaatgttaggcaataaaaacaagctgcaggatagttatgataatttacataataatttaaaacatgaaacaatgttggatgcttacaaatatataagtttaaaaaacatgcatgagaagataaataccagattcagagtaataatttacttctggtcatggtgggaaaagaatggggtttgggtaagttacaggggggaatttcaaatatattttctaatactttatttatttgaaaaattaaaacatctgtggacaagaaagtaatgaacaaagatattaagtgattcaccttgtccaacaactccatttctctgtccagtccaggctggtcataagaaaaaaagggaagtacaatggagtgactgacagggcaaggactatcagcttagattaggatttaaccttgtcatcactgaaatacctgttagtaactatagctctagttcataccacaccacttaatttctaaaaagaaagacaatgagagaagtcactggagagatagtaaaatatttttagactatacgtttgagttcttctaaaaacagtaattcttgaattgaatactcctcagtgatgcttagacatcaacaggatttactgctgacctgggtcatttacactgaagctgagggaaacataaaaaaaacatacaagcaagcattttaagacattctcttagtttaaagtttaagtagcttgttgcagaaaaaaaattggaaaataaaatatctgttctctaatcctcctgtctgtcttgaatttcaaagtttgaccgtggctttgatgtgcagacttcgtgcctcagggcatgaaagattgagtgcccttctaacttctcttttcagtagaagaaaccctgatgaggatgtgaaacaggactgcagcagtgaaggagttactgctccgtggctactttttctgtctcctttcattttagttctcttagggtcagagtcaatagctggatctggtagactccatgggttagtaaattaggctgggttgaaaaaaagaacttgaagcagttcaaaacttctttgggagttttgaactcaaaacagagttttcaagggttggttgattggttgacatggtacgtaagtgagttagtgagttcattcagaaatgttaccttcatgtaggaagactagggatgagacaaagataaaattcaaaccttttaaccagactatagcacatagtctacagtgacatgatcataaaatatactggagtctgaaggtcttcctaacttttttgtagatgctgtttttcagaaaactccaggaaaaatcaaagcatgaacatgtagcttcaattatttctgggtttcttaaagtcaaaaacaaagatagattaagaacctgagcaacaaaataaaatacattcagctacagattgagacatactagatcctcaatagttatttattgaatgaactaagtcaaatttggagttctcatgttattgaaattgaaattttttaaatgtaaagtttaaactaaggacatttctttaggtcagcctatagatgatgtccaagaattctctcaattctaaaagtgtgaatcaaaaatttttttttctgtcaacctaaaatcgtcaaaagggtcagaatctcatttaaagagagttttatcaagcacaaagtgtgaggctggaccacctggaaacaccaactccaaaagaattcagtcagtgctctgaagtagtgaaattgggatctcatttctataggcagaaacagagaagattttatcaggattacaaaaaaattattcatataaggatggcacctggttacagaaatttcattgattataagcagtgtttcttttggggaagggtacatttaacatttttttacacagagtgtaatagttatttataggttttctgtcatccagcctaagcaaagcaggacaacaaaggggggaagttaatctacaacaagggtcattaattaagaaggcaggagatttttgtccctgacatcatttaattccctctagtcactgcacagaacaagaaaaatgaagtgagttaatctgtaatttgagaacagaagttataactatatgtgactcagatcacagttacatcttttggggttccaacagcttttaaattttacttatgttcatttttcttttctttttttgttttttttttttttttttttgagatttcactcttgttgcccaggctggggtgcaatggcgggatctctgctcttggcaacctctgcctcccaggttcaagtgattctcctgcctcagcctccccagcagctgggattacaggcgcgtgtcaccacacctggctaattttctatttttagtagagacagggtttctccatgttggtcaggctggtctcaaactcccgacctcaggtgatccacccgccttgaccttccacaatgctggaattacaggtgaccccaaaccaaattatttaacatatcttcttaataaaattcatacaggtaaaatctgtttaatagcttctttagaaaggtgcaaaatgcattatttacaagaattttgcaggagagtgggagggggaggagaggcaggcatatatcgatcatggattttaaaaaatgagtatttttaaagttttccagtgaatgaactactcaagcaaaatagaaatgttttctttaaatttctacagaaagagtggtttgataaacaccacaaaacatatgttttacaacattggacagtttaaaattttatacttcatatggaaaaataagtgctatgttcacaggaagaaataaatgatcatataactatcattggtctgagccaaaatttattttctgttactggtctgttactgatatcaaatttcctttgcatgagaaaaagaaaaataaactaggaatctggagatacagactgtcatgtacttgttaaattaccttggacaagtaatttagtctgtgagtcatcattatatttataggtgggacggagatattttatttgctcttcctagatctcaggactgttgcaaaaggaaaaataaatgtaaaagttcttcaaaaagcagaaagcaccatataaaatgtactttattaattactgctaagaacattcaattcatggttactgaggagtttagtgcccacagacagtgaaaattatgcgtgaatttctggtaggtgtaatccttgcttaattcaagtattgatatcggcctttctctctcctctttcttttccctttctccatttacttcacttctgtagaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaaggtaagcagcaaaaggaaagctgaatcaatgatgaccctcactttttacaaagcttttcccaaatgatgttctctcttactgcaaagaggttttataattcactatttgacctataaatgagccattaaaaataattattgatttatgaaaatcgtgttatgaggaagcctagaacatctggttcattacttgagagtcgtgtgtcatgtgttcagcatgagaaatactctcattattgtcacttacatgttactcttccctaaggcagcatgcctggtgcaggaaataaattcagacttaagtttagaagcacaagtaaccgtttctttctgggtatgatagatgggcatttctgggactgggaagtcagagtggtgccttttgcaaagtttcacttggagatgatccaacatcctcaaatgcaatgctgtatgaccagctaaatgcatacattaacatacaaaaattagtttcgctttttcactggcttgatgggaaccttgaggggaagggagagaaaagagcccaggagaagtaatatttcaaattactcaaaggaacaaaatcaacttctctgggtggaaggggctagagggagagggaagagagggcattcagtttcatttgggagtgaatcctagtgaaggaacttgaatacgctcagggcacatcgggtgggggtgggaggtaggtaatgatatcagagttggctgactgtaactggaaacatgtattggtggaaagagaaagtattgaagcacacagagcatgacatccaggaaaatgtcattttcacttgctgcttttacacactcatttcttcaatggatttagtttttctgagacactatttaaaatatatgcagtggggctgggagtggtggctcacgcctgtaatcccagcactttgggaggccgaggtgggcagatcacttgcgttcaggagtttgagaccagcctggctaacatggtgaaacaccgtctctactaaaacatacaaaaaatctagccgggcgtggtggcgggcgcctgtagtcccagatactcaggaggctgaggcaggagaatcccttgaacccaggaggcagaggttgcagtgagcctaaatcacatgactgcactccagcctgggcaacagagcaaggccccatctcaaaatgaatgaatgaatgaatgaatgaaatatatgcagtgaatttggtttttttaaactttgaaaaaatcaaagaaacacaaattccacaaagtattatgttctttatttacaatgaaaacagataatctgcaaattaataaatggaaagttatttgtttatagatcacatgcaaatatatttatgaatgattaaaaagcaattactgaaacttttgttaacaatcataaattttaaaataattaatataatcccattcttaagtcaattactttttcaaactatttttagatttcaattcaataagtggtacttttagttttgttctctcatttcttttgagttggattggatttttagtttattgttattctctttaaagttttctaagtggaatccaaacttttattatttctttttttgggcaggttctgtctgcaaactggcaaataaaccagttttaaattaggctagtttttctaaatgaaaacttttcttggaaaattgctctttttttaggtcataaggtggcaaaataccttggatttttatcttaaagtaaatggccagtgtaaacttaacctctacaatttctttatattatctccttcaattaatacataccccaaaagttcctatcacaaaaaggttaactccaattgtgtttgatctgcttaggaattttgtcagaaaaagcccttcaggattgagtctagacattcaacgtttcgtctctagccttctactaactctttattactgcccataacagtagttgaaggaaatattattttgtgaatgtttagccataattgtttcaaactttccagaagtgtgtgacgtttagaagaccatatttttcatgtaattgattttctcttcacagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactggtaagtctcctgaagaatcaaatacagtgaaaaaataattcagttatattttgctgtacatttattttttatcctaagaaatattctgatccagagcaaagaaagaaaatatatatgtttaataacctaaaacagattttctatcaatataaaaagaactgggcaaaatattcaataagaaaaatctaaaatatgtcaatgtaatcatagatttctaatctttgaataaaaagctactatactattaccaaaggttataattaactgacttacccagatctagtagacatcagttattgctgacaagtgaccctatggcagaaaacagagtgaagacattctagtacagattatcagattattaaaggaaaatattgaaattcaaatgtatctaaaacttgcggtgcttgattttagtagcaccactaatatgaagcactattgtaggatggatggatagttgcatggatggatggatagatggatgggtgggtggatggatggatggatggatggatggatggatggatggaataatgaatggataaaataagcatatatctactaagtacccatcaccaatataagcaaaatcgtatgtgcctagtatgcctgaatactcaataggaatgctggagaggccattctgatgagcatcaggaagggattatgatagattacttctaaggtcttgacaatttgaaattctaagatgtcatgattcttattcattagtctaagaccaggaaactatttcagctaaatcactaattcacctaatgtcaacagttaagattctatttatgtttttcattattcaatgtaagtagaaaaacattaattgagcaccttctacctggaagttgttctcagtactgagacatgaagacaaagactgatgagacaggatccttgtcctcaaaaattggtactcataatacacgaatggcactaacacaaggcagaatgagataaatattataacagaggtacaaagttatttaacaacacaaaggaaggagagataaatttttattagaagctcatggggcctagcacggtggctcatgcctgtaatcccagcactttgggaggccgaggcaggtggatcacctgacgtcaggagtttgagaccagcctagccaacgtggtgaaaccccatctctactaagtatacaaatattagccgggcatggtggctggtgcctgtaatcccagctactcgggagactgaggcaggagaactgcttgaacccaggaggcggaggttgcagtgagccgagaccacgtcattgcactctagcctgggcaacagagagagatactgtctcaaaataaaaattaacaaaaaagttcatggaagaggtgataatggaactgctatttgaagaacaagtagaaactgttacaggcagagactacgcagtgcgtcttcataattttctccctgtaagtaaagtgtgcttccataatttgtaaactcattttgagtttatatgtttcattttagagaggtgaggagtgaagctatatttctaacatgtgtgttaacatctctaaaggcaacacatgtatgcaactcttgtaggtgcaactatgtcacatggagtattttcatcttcatagctataagtacactatacttgttttgttttggtttttttgtaataaaaatccaggaacagagatacattttttgtaagtggaattacgataaactgaaaaatatttatatactctgcttttagaagtggttgaattaccacttcaacaagcataatattgtaagttaatatatttgaagtgtgactagtggtatgttgataggtatacatcatccacaaaatgttagaagtatgtatacggaaaaaaacacagcttatcttgatgtaaatttgtctgtgtatcagaagtaaaattaaattccacttttaaaaatctgcttgtgtacctgactcattaagagattaagtattcactctaattgaattaaaaaatacttgaaaatgaaaattctctctcttacagccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaaggtaaagcagtaggaaatcagaggaaataagaactgatacaaaggaaggggaattgaaatgtttttaaatttgagtttagaaagactgatcatagacagttattagtcaaagaataatggtaatgaaaggggagaatttaattgagtatccaatgcagactgagagcagaaaacccaaatgaatagactggataagaatcagaaggtttgggtgattcacaagttgtaagtactgccaactgtatacatttgactgcccactatttctcatgtctcagaacaatgaggaaaacatcatatttggaaatattttgaattaaagatctaactatcccagaatattacaacataacctagagaaattttctgttttctcatatgcaaatttttaaacatggcagcaaagtaatacttatgaaaacattactacttcctcaagaatatgaggcatgtgtcctgctaaccagccgctcttgttccctttagggtgtgcccctctagaaaaagcaccacagttttccaaagagaagctgatagtaaaatggaaaatacacagctgctgacatttccatatagctactatattatattttgcattgactaactcaggatctgaggttcattctttatattttagccactaacttaggaaagtagagccatgactttcaacaagtttgggtcatgatacctatctcaattgttgtttggtagatttttatggttatttgttgtttgtttagtttttacagtaatatacttcattttccattttctgatctagtagtttgagtggcagaggttataatttgtaaaaatttgaagttacagtgatagccttatttttagggtgagagtttaaggcccatgtagtctcatatactgacatattgtttactcctattttacttaatagcatgagatacaaaatctgtggattcttctatacaagatgatacagcattcaaccatacccaaatattacataaaatgaaaattcttaattatttgagtcaaaagtcattttcctggaatttcctattttttttaaagtttccttaatctatcatttatttttctgttcctaaatatgttcctacggcaaataggatcttgtcattacaaaaattttttactgcctcttctcatgaaggttctattatgcatttatctgactcagtgtcttcttttgaaggctgttgtagtcaccaactgatgataatgacttcaaatgaagtaataagcagcagaggatggatggactgtgaagcaatgtgaaataattctttctttaagaagatctgaaagcaaatggataaaggaaaaatattaccatgattattatttttttaattttactttaagttcaggggtacatcagaaaatataccttaaaaattagatgtattttaaataaatgttaaagcacttctggatggttaatactaccacaaagaacttacaagatatttgatcctggttattttttagcccttacctcgtgatgagaaagccaacaattgttaacttttcctgattatctacttctattttgtacacataattttgttgggtaggagtacataaagatacacagtgtagacccatccctagttttattgatttgaatgccgtatttgagttttgttatttggaagactgtaaaaatactgaactcttatttattattctttaatggtacctttagtttagaggtgtaattgaacttgacaaaaggagggaacatttaaaacacctaattttttttcattaatcgacttgtctatacccagggcctttccaggtgtctattcatgtatcttctcttttttataaatgatttagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtaagtaacaaagagatcattttacacttactggggagctagaacaatggaactggtgggattaatgatgctcagatgtcaattattcacaaaccttagggatgatgagaagtcttcaagatcaggagaggctgagatccacaagctttggatagcagaggaaatgaatgcttgtttaatagtagcaatcctatccaggggtttaacttgaggattttttttttactattgtgataattgaacatttattaaactgacctttcacattagccataacaaagcctccaaggatgtggacatacagtttgggaaatacgacatttgtttgagcccataacgaaatgatattataggactgtgaaaaatctcattagagtattgagcttgtgaggctcaaaagaaagacaaagattcaagtgtgggtacaccccgatggtctcaataaaactggtggaaaaagtcatagctagagcaacctgaaagtcccagtgtcaagtcctagggtggcctctaccattccataagggtaacaggacagcaaaagctagcctctgaaggttgcacaaacagtgcctgcctctataacgtgtttagctaaactgactatgtttactggaagtatagaggtcaaaaatcagtaacctaccctatcaggagttatatgtgcctccgatcagtagaaagaaaaaccagaaggcaaagaataaaaattgctttcagaaaaggataaccaccacatatcctattgccatctggaaaggcaaataccacctttcgttgaaggacggatgagagcagaagaggagctcagcttatgtagcagcttaaaaatgttgaaaatatcccagataatatttttacttaaaagaaaaaccaaaaatgtcacctctggcaaaagaaaggccttaaagatttatcagatgcgtagaaagggtattcccaactgccttgtgtgtctttcaagtgtgagagaccttggacatgtgattacttaagaaagaggacaaagtcgagtatttcattcttcccataagactaaaaatgcctcacttaccaaatagtttctttctgcaccagtacagatccaccgcacatgtgaacagcctccacgaaaactccacaacaattctgttctttctgacttttctcttctctgaattcctattctgtctcatagtagacagcacaaaacacataacttattagtgtgtggtatttttctagatttattttatgtacatcttgcttctcatgtcaagttgtaaaatcccaggctggagttatactgtttgcatatttattcattcttttgtacattcaagaaatatttatggaaccacttatatctttcatgcactctgctctattcttagagtatctaaagcgactagtgccattgagaatatgtcggaattgctcaaaaatgcaattactttaaagagatgcatcttaatatttatctagaaaaatataggctcctagaagttttgttttttctctgttgctaaaagaatgactttttaaggagattctgttctgtggtaatgagctattcagatgtaccatgtatacttctttggtttaaaaaatggataccgcagacataaatacttacacctaactgggtaaatgagcaaaaattagggtggcttacgtttgctcagtataatgtagtcacacaccagcaaaagtatatttgcagcctgtttttcctgaccaaactgtttcacatattctggtgttgagctgttacattacaatttattatatgtttatgtcgttgcattataatttacatttatgtagctttgaatgccttcccagagatgagaattcaggtaggaatttgcactagactgccaatagccttatgaagaaaacacttttattacccccatttttcacattaaaatacatactgaatcgcagaaatttcagtgacttccccaagtgtcaaaattaagattataactcaggaatatttgataacaaaacccattttcatttagcctgccatgacccatgtccttgggttgattatcaagtcagtcataaggtaaaactattaaataattgaatttgttttgcttactccaacctccaccctctgtgcccccactacactagtactcttcagaacagtagtaacacttcacgtttatgtagttctctaacacatattatctcatttgatcccaacaacaaccttatgaggtaaattaatcagattttcaaaagcaatgactcaagagacaggaggtctgggttaggtcacaagcacttactagctctatgacttcaggcagcttgtttatatctctgggcctcagtttcctcatcagcaaatgtgttagtccatatttacactactataaagaactacttgagactgagtaatttacaaaggaaagaggtttaatcgactcacagttctgcatggccagggaggtctcaggaaacttacaatcatggcagaagacgaaggggaagcaagcaccttattcagagggtggcaggacagagagagagagcaggggaaactgccacttttaaaccattagatctcatgagaactcgctcattgtcttgagaacagcataggggaaaccacctccatgatccaattacctcccatcaggtccctccctcgacaagtggggattacaattcgagatgatatttgagtggggacacagagccaaaccatatcagcaaaataaagcagtgggtctctaaagttctcttcaattctaaaattccatgatttatccatttcacagatgcaatgactgagattcagagaggttaactcatttgtccaaagttgcaccactaataatgaccaaactgagtcttagtgcaattatcgtatctccaaatttttactatttcatagtgctccaggaagtctcatgcagggttgagagcatggattttggaatcagacttcctgtgtgtgaatcctagctcgacttactctatctctacctcagttttcacatctgaaaagtgagatttaataaaagtacttatttcattggcttgttataaaagttaaaggggccaggcacggtggctcacacctataaccccagcacttagggaggccaaggcgggcggatcacctgaggtcaggagttcaagactagcctggccaacatggtgaaatcttctctctactaaaagtacgaatattagccaggcatagtggtgggcacctgtaatcccagctactcgggaggctgaggcaggagaatcgcttgaactcaggaggtggaggttgcagtgagcctagataaggctgcactccagcctgggtgacagagtgagactccatctcaaaataaataaataaataaataaataaataaataaataaataaataaggaatgaaatacgtaacacataaaaacttaaagaaggttatatgctaaaaaacagtttacatgctgaaaagcagtttatatgtgagcatccgtgttttaagctcaaccactactgtgatgtcctagacatcttcccaagagaactacggtagcatccttgtgtctgtggtgtcactgacctgccaggaacaaacgtataaatatgtaatgggttccatatctctttactataattactatcattttgtattatcatttcccttgcaccatttacaccaaaccttagtctgtcctccccagtagagcgacttgctccttttcctctcctggatctcagcttaggaatacagcatcaaattaaggagctgagaatgcatcctaagcaaataaatggaagtttcacatttgcatttcagcagggaatttctgtagataataatcaccttaacatgtcttgagtccttactaggtgtcaggcactgtgttaagaaccactttaggaacataagagaacaaagctaaggatgggcacttctgtggagacattttatggtaaggatcctgttgtgttcctcaaattatcacccaggttttagccagcttctttaattgagccagcctgttgtgtgtttcttctctaatataatcacagcctgccttttcgttctcactgttgccaaattcaaatgtttgcacagggtagtagtcgaggctgatttgaatctcaaagtaattattcctagagatcaaagatcctagtagcaaaggaataataagccctgatgaaatgccacattgccacgctcactctttgttaaaagagaagtaagttttctcaggtgaagaatttaccaggatactctcacatgcacacgatgattgaagtgacacttttgtttctgctgttattgccgaggctgctgtttagatcaaggtgaggtcaaggagtagagggttgcagctgggcagaggacctgaagagttgccagtccgaccgccaatctttctttgaatctcattgtaagggcaaaaagaaaacatgattttttaaaccggaatcttttatctcaatcagtgtaacgtgcagcctcccctgtgttccaatttgaaatgtgcaggtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtaaaggagaggaaatgagaatgggctcgccggtccttcctaagcacaaccttacagggcaatgccaaggaggcaattgtaggaagccaggctgaggtctgctgggatgggtgtgttctgtgactgttcccaagagccagaggggccagaaatgactggcaatggctttttgatggcactgtcatctccctttctcttcagaggagggtcatgttctttttcattcattattcaagggaatttgctgagcatctatgatgtgccaggttctaagatagatgttggaaatttttaaacatcctgctcttgcagagcttgtaatctaatgagaacaatagataagtgaacatataatgactgcactgtatggaataaggcctcagcttaaaatgaatgatgagagtccagaggagttcacggaagaaggagctgagcgtgagtaacatggatgaaggggaaagaggatttggaaactggttggaaaaaacatcacagagcaggagacaaccaagcagagggttggagggttttttgtttgtttgtttgttttacttttttccattcttttaattttcatttttactgtaaaagtaacgcattcttgctgaaaaaaaaaaaaacttaaaaatgtaaagaatataaagtaggctgggtgtgggggctcacacctttaatcccagcactttggaaggccgaggcgggtggatcacctgaggtcaggagttcgagaccagcctggccaacatggtgaaaactcgtctctactaaaaatacaaaaattagccaggcgtggtggcacgtgcctgtaatcccagctactcaggaagctgaggcaagagaatcacttgaacccgggaggtgggggttgcagtgagccgagatcgcaccactgtactccagcctgggcaacagagtgagactccgtctcaaaaaaaaaagaaaaaaaaaaaaagaatataaagtaaaaaactaccccctcaccagtcacaactgaaaagagctttgaagaatatatgggagacagctgtgcacagaggagagtgaggggcaggcagagacggtgtgcaactcagtagtcctgtgagtggctagcagaaggaacgcatatgccagaccaaaccctagtgaaaccgtgcaactggagcccagagtggaccttgctctcaaatgccctgagaacctggggcccagtcctatatttctaaattctggccttatgtttttacaaggtcaaatgtggtggttcttggtgtcttacaaacacattttcttccctaaaggcaaaaggaaaaaagtaattatcaattcgtgtggagtacgttggaaatgtaatgcacagaaaagatgtttgctgtatgacagcaatttgggatgtttccattcctcccaggaaaattaagcatttaatgaaattcaaacaatgataaattgtaaattgataagatgaattcaggaatcgtgttctttggagcactagaaagccatagaatgcttgagaatgaggtgccccttgagttgaattaaattaaggaataaatatgctaaaccgattaactagtaatcacagttcattgtgtaacttattagcttcctttcctgagcatacccaagatgactgactcattacattgacagaaaaacgtgttttcccctacagaccttgacctagaactcaactgcttcaaggtacatttctccccttgccctacttaatgtacacattatatatctttcacataagaatacaaaggctaaaggtagagatagatattgtaaattatcaatgagccagaaaagactagtccaaatgtacttttacaatatcttctcaaaatgcaaataggaaaacagaacatgaaatgtcctattcaggattataagcaagaagaccaatatttaaaggggagtgcaggaaagagaccaccatgctaggcatcatctcagttaccacaagacctttttgagatttgtataatatcataccactatagtccattatgccactaaataaatgtgtagaaaagcaccaatggaaagaagattacataaagtggaaataagaccatctcaggctcaaaggaacctacactatcatctagttcaaccctattatttaagagtccatcatatacaggtgcagtggctcatgcctgtaatcccagcactttgggaagctaaggtgggcagatcacttgagctcagaagttcgagaccagcctgggtaacacagtgaaactctgtctccacaaaaaaaaaaaaaaaaaaaaaaattgcctatcatatacttacttcaattagctatgctgtctagtacatttttctccttattcctttagctgaagaggaatagaactggtatccatttggagggacattggactcaactaaattctcaggaatgaagattaagacagtcaggaaaaatattgggatgctaaatgagtggaaattaagggggagcagagtgtggaagtattttgtaaaaaataaaacacattacttaacatgcagaatgcagaggcattccacttttcctactccaacacacacccaaggaggtccaggagaaataaaaaggcatggagaaacatagaagtgtaaatataggttagcagctcagtaaatattcagaaattggggaggatggaaattagtgtttttaatttattaccaagtcaggtaatctgtaatccaattacccctttgtcattttttaagtaatatgatgtatatgcccatagctacttcttattttaaaaagtataatatccctaggataaatttattataatggcatatttttgtttgtttgtttgtttgtttatgagacggagtctcgctctgctgccaggctggagcatggagtgcaaagtcatgatctcggctcactgcaacttccacctcctgggttcaggcgattctcctgccccagcctcccaattagctgggactacaggtgcacaccaccacacccagctaatttttgtatttttagttgagacggggtttcaccatgctgaccaggatgatctcgatctcttgacctcatgatctgcccacctcggccttccaaagtggtgggattacaggcgtgagccaccgtgcccggctataatggcgtatttaaacagctatgattccaggtagtcatttgaatagttagaatcaactcataaaatattatcaaaagaaaggaaccttaacatcaccatgaaacaatctatactccttatgccctttattattctaaacattctaaataggcaaaatgggtgattaatgagctaggtcagcatttacacttatagtcagatgtctacaatgtgttaagtttaaatggagcaatgtttttttgtttgtttgtttttggggggtttattgagatggagtcttgctctgtcacccaggctggagtgcagtggcgtaatctcggctcactgcaacctccacctcccagtttcaagcgattctgttgcctcaacttcccaaggagctgggactacagaagtgagccaccacgcctcactaatttttgtatttttagtagagacgggttttcatcgtgttggtcaggctggtctcaaactcccaacctcaggtgatctgcccaccttggcctcccaaagtgctgggattacaggcgtgagccactgcgcccagcctggagcaatgttgataatataacacattatatggtttaatagcatattatttatgtgtatatgttagaagaaggtctagaagaaggcatatcaaaatgtcaggatttgtgggaggaggagaacaaacaagacttccaatttacttcatttgttcttttattgggtgagcaatttttacaataagcatatatgttgtatcatataaagtgtattttaaataaataaaataatattgcttagttgtggataatatgcatcttcttatcatagtttgtctctttagaaaattctctatcaggccaggcacggcggttcacgcctgtaatcctagcactttgggaggccaaggcaggagaggcacttgaggccaggagtttgagaccagcctgaccaacataatgaaaccctgtctctactagaaacacaaaaataagctgagcatgatggcacacacatgtaattccagctacttgggtagctgaagcacaagaatcacgtgaacccaggaggcagaggttgcagtgagccaagatcgtgccactgcactccaggttgggcaacacagtgacagagcaagactatgtctcaaaaagaaagaaaagagaagaaagaaagaaagagagagagaggaaggaaggaaggagaaagagaaagaaggaaagaaagaaagaaagaaagaagaaagaaagaaagaaaggaaggaaggaaggaaggaaggaaggaaggaagaaagaaagaaagaaaaagaaagaaagaaagaaagaaagaaagaaagaaagaaagaaagaaagaaagaaagaaagaaagaaagaaaagaaagaaagagggagggagggagagagggagggggaaggaaggagggagggagggagggaaggaaggaaggaagggaaactctctatcagatgaagagatatagttgactaaatctgcctatacggcttccagcagaattaaaaatctaaaacttgtgcaagaaaccctgatatgaaagagtataaatatgaaagaaagaatgaaaatcccaatttattaattcaatataatcttattttgtttaagtcagtgggaaataaattttggtatatggctccttttacttacacgcagaggaagttgtaccaattcagattacataatttctactgtgtataatcagtttccagtgtgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaagcttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaaaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttatttttgtttttttgagagcttgtctcactctgttgcccaggctggagtgcagtggcacaaactcggctcactgcacctctgcctcctgggttcaagcaattctcctacctcagcctcctgagtagctgagattacaggcacctgccaccatgcctggctaattttctttgtattttagtagagacagggtttcactatgttcgtcaggctggtcttgaactcctgacttcaaatgatctgcctgccttggcctcccaaagtgctgggattacacacgtgagccactgttcccggtggtcattttcatttctataattagatattatatgcttctaagtgacaagagactaaagacatttctgtactgacctttgtatgtaatcagctgacaccacaatttagaatgtcaaactatcctcatggtattgctgatttgattatggttagagactgatgtgtctctagtgtgcatagttataattgacactgatgggtataaagcagttcacagggcttagaacagacaaaatttgaatcttctaggttcccttcaatgttcacataaactataaatcatcctaattttggaatctgacagcttcagtaaagccttctggatttcaaagtcatctgtgattccaaaaagagtctctgaatattataccagcctctgtgtaacattctgaaatcccagctctaaataaatcttattgggtgtttggtttaaaggtgaactcaagcaaacctattattgaaaatctggttcctggtgcccagtaccaggttgtaatatacctaaggaaaggccctttgattggaccaccttcagatcctgtgacatttgctattggtaagttgctagccacaagaagaatgactgacctatatattagggtattgacggaggggtgcaatgtgcgagctcaaatcattatcatcgtatttggaaggtccatattagttcatccaatatgctaccttcagagtaataaataacaagaattgtatacttggaaaacattcttaatatttattacttggggaaaaaatcagaggcaaacattcttactttagttttcaatgattatacaacaagagtaaagctgtgtgccgtggcacacacctacagttccagctacttgggaggctgaggtgggaggactgcttgagcccagaagttgtttgttttttttgttttgtttgtctggttttttttttgttttttttttttttttttttggagacagagtctcgctctgtcacccaggttggaatgcagtggtgcaatctcagttccctgcaacttctgcctcccaggttcaagcaattctcctgcctcagcctcctgagcagctgggactacaggtacatgccaccatgcctggctaattttttgtatttttagtagagacggggtttcaccgtgttagccaggatggtctcgatctgacctcgtgatctgcccaccttggcttcccaaagtgctgggattacaggcatgagccaccacacccagccaagcccagaagttttaatctagccttggtaacatagcaagaccctgtctcaaaaaaaaaaaaagaaaagaaagaaaagaagaaagaaagaacgaacgaaagagagagagagagaaagaaagaaagagagaaaggagaaaaagtgagaaagagagtgagaaagaagagagtgagaaagagagagaaaaagaaaaagagagagaaaggaaagaaagaaaagaaagaaagaaagaaaaagaaaagaaaagatgaaaggagggagggagggaagaaggaagggggagggcagggggagggaggaaggaaggggaggaagcaagaaagggaggaaggaaggaaggaaggaaggaagggagggagggaggtaggtattgtatcagagagtgaaaactcgggtcattaagtagaagtttgaggccattgctaagacattccttcttaactttctttttctaccccctgccctcttctttctagttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtggtaatcttcccttaaccaactgtcagtctttcctatgggaacaggcaaacctttatgtaccaaatgtgtctttaagaaattatctataaatttgattattttgtaaatacacatagtgtgttagttcattttcacactgctgataaagaaatagccaagactgagcaatttacaaaagaaagaagtttaattggacttacagttccacgtggctggggaagcctcacaatcatgacagaaggcaaggaggagcaagtcatgtcttatacagatggcagcaagcaaagagagcttgtgtaggaaaactccctcttataatagccatcagatctcatgagacttattcactatcacaagaacggcatgggagagacctgcccccaggattcagttacttcccacagggtccctcgcacaacacttgggaattcaagatgagatttgggtgagaacacaaccaaaccatattattctgccccttgcccctcccaaatctcatgtcctcacatttcaaaaccaatcatgccttcccaacagtcccgaaaagtcttaactaattaactcgaaagtgcacagtcaaaagtttcatctgagacaaggcaagtcccttctgcctatgagtctgtaaaatcaaaagcaagttagttacttcctagatacactcggggtacaggcattgacacagctgttccaaatgggaaacattgaccaaaacaaagaggctacaggccccatgcaactccaaaatccactgggacagtcaaatctcaaagctccaaaatgatatcctttgactccgtgtctcacatccaggtcatgctgatgcaagaggtgggttcccatggtcttaggcagttccactcctatggctttgcagcatatatcccccctcctggctgcattcacaggctggcattgagtgtctgcagcttttccaggtgcacagtgcaagctgtcagtggatctaccattctggggtctggaggatggtgaccctcttctcacagctccactaggcagtaccccagtagggactctgtgtgcagtctccagccccacatttcccttttacattgccctagcagagggcatgaggtccctgccctgctgcagcaaacttttgcctgggcatccaagtgtttccatacattttctgaaatctaggtggaggttcccaaacctcagttcttgactcctgtgcacccacagtctcaacaccacgtggaagctgccaagccttggggcttgcaccctctgaagccaccaagccttggggcttgcaccctctgaagccaccacctgatctctacgttggcccctttcacccacagctgcagcagctgggatgcagggcaccaagtctctaggctgtacacagcacagggaccctgggcctgggccacaaaaccacattttcctcccaggcctccaggcctgtgatgggaggggcttccatgaagatctctgacttgacctggagacattttccccattgtcttggggattaacattcaactcctcattacttattcaaatttctgcagccaacttgaatttctcctcagaaaatgggattttcttttctatcacattgtcaagctgcaaattttccaaacttttatgctctgtttcccttttaaaactgaatgcctttaacagcaccaagtcacctcttgaatgctttgctgcttagaaatttcttctgccagataccctaaatcatctctcttaagttcaaagttccaaaatccctaagggaggcacaaaatgctgccagtgtctttgctaaaacgtaacaagaatcacctttgctccagttcccgacaagttcttcatccccatctgagaccacctcagcctagatttcattgtccatatcattatcagcattttggtcaaagccattcaacaagtctctagggaattccaaactttcccacattttactgtcttctgagccctccaaactgttccagcctctgcctgttacccagttccaaattgcttccacagttctgggtatcttctcagcagcactccactctcggtaccaatttactgtattcattcgtttccatgctgctgacaaagacatacccaagactgggcaatttacaaaagaaggaggtttaattgggcttacagttccacgtggctggggaagccccacaatcatggcgggaggcaaagaggagcaagccatgtcttacatggatggcaccaagcaagagagcttgtgcaggaaaactcccccttacaatagccatcagatttcatgagatttactcactatcatcagaacagcacgggaaagacctgcccccatgattcagttatctcccactgggcccctcccacaacacgtgggaattcaagatgagatttgggtggggacacagccaaaccatatcacataggtatggctattttcaagtttttttcattgtttttgcttttaggttttgggattctcttttgttttgagagggagagaaagagataattgtgtgaagctagctgtcaactctaattgaatgtatttgttaatcaacattttttcctaagcacagaatagagcaatcaagtgcttactgcttctcctggatcctggggaggaacacaaagagatttccctttggcattccatagttagttgacactgcctaattttaatgatgacttttcatggcatctacagatcaattaaatacctctaatgtcaggcttttagaggatgttttttaagaaaacaggtaaaaattgctctttctgaaattgagataattttgaaaagtgtgggttacccatgggctattcacaaagtacacaattaccctctacccagttgaagactctgaaggactcctgttcgtggtttacactgaaaaaacactgaattgtgagaggttacttgtcttagaaatagggagaaatgtatgtacagtcacttataaataaggactgtttcgcatgtgtaatattaggaaattgcaaaatcaaacaaatattggaaatctttggctctatatctttaaatcacttttaaaaatttatatttttgtattttactttatgtctcatttcattctagaaagaatattttattatagtaaatttaggaaacacaaaaagacaatataaaggaaaattaaaattacttattaattttttatgaaagtaagtctactccaaaaatagtactttctcccacagtcttttgtctccttgcttgcttttctcattcagagaatagctaatctgctgccagcatggtactacaacttccgggttaccatggtgacgtggggagatccagaattgagctgctgtgacagctctaccatcagcttcataacaggtgaggcatgtgtggggaacagttccacaaggagagagcattattgtgaggagttaccaaggttccaaatctctagaaagtgccagtcattcacccagcactgggtgagcatcaatttcatgggagataatattgattctgatcattcattattttgtttagttgataatctttagaaatcaaaataccatttttattttgtgttaccaccgttgacttatttttattctgaggcactgaccttgattaatgtactctccggctgggattgattagaatagaaatatggcaggcacagccatcagcttcacactgcacagtcgattgattttacccatatgatgattatatttgttagagtgcctccattttcttattaattaagccatttttaaagtcataggctgactgtagtagggtcccttgtggaaattaaaaaatagggtttagagacagatagatctggatttgaatagaccctccgcataccacatataaccttgagcactttaacttttctaaatatgttttttttaatgtggaaaatggggatgataatagtatcagttatctgttattatttattacaacttcattattatataagctactttgcaaaatacacgacacaaagtttaagcacttaaaaaacaattagtcttagatcctcggaaaccttaaattatgtagttgcatcatcagtagtcagagatagcaatgaaaaggggaaattcatcaaagaaacactaacccttgtggtttgaactaagacgtttcaagaaccttttatcgaacgacaaggttgtaattagagttgtcctgagaaaacagaggagaaaaataccgcttagaggaataattttggcaaatagtttcctcagtagacatctagtttactctgttgaaatgtatgagaaaaaaaaaaagtggaaagaaatcaatcatctgtgaattcttacacaattaacttacataagcatgtctcttttctttactagccaatatccagagcactttttgttccagatgttaatagtaatattagagcagaaaactgaaagaatacccaaaaaggagaaaatagcagttacttggcaagcgctgttagtcttttgcctataatgataatcacatatttaattataagtaaacttcactgtatcaataattcttataatttaactatattgatgtaaactttctgagaatgctctttccttctcaccaggacagttgtctggaaaaagctcagatgtaacatctcaacctgggactgctcaattccagctgtcaaactttgaattatcttaacgattctgggcttctattttctcaccggtagaaccccctaaaatgtcagctaaataggcactaaagcctacttagagacaactgattagtagagcaaaacttaatatattgaacaccaccctgacagtctttgcactgtcttttaagggggaacaaaagaaatgaaatattaataggatttggcttcctggctcaagtggtttaaggtatgcctttcaagatggaaaactgactaggattgggcatagtttataacagtttaaatggacatagcaagtgtggatcaataaactatggttaatagacaagctacttacctggtaagcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcttttttatacttattttctaaacatattgaaaattctagtaggttttattttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaaaaataatcattcactgaagaatttgtaatatataaagtaaaaacgcgtgtgtgtgtgattttttttaccttcttatttaaagcaaataagaatctcatgcttaactttcctatgctttgaattttccaaattgtgtggtgtaaaagaaaataggaacaaaatatttgaattaggtgtgatttattaggaactcaagtctaccatctttgttaggcaattcagttggctagccctcaatcatagtaattatgcggaggggccaaagtattaataaacaaatagtgacatcttgtggccttccagcaatatgctaggttttaaagcaacaacatggaaataaaaatctgacatgtgagaggaaagatatatacttctgggtttgcaattttaaagatgtttcttttcctcactaaaattaggacatgagaaaataccctttgaagaaatatatgcataggttcttgtatatgacgaaatatgttggaatatattaggaggctataaggaagccaaggttattttcctttagtagaatattctgaaatatgatgtagatttgtgttacttgttagatgcattgatgatctttcaagattttattgctaagcatactatataagtgctactcgtatttcacatgaaacaaatgcatttttacttcatatattacaaattcttcagtgaataattttgaaagcatagctagttatgaatgtttgttgtaagtattagcatcacattaggggaaatgattctttatagaaaatttccatagattttagttgacattgtgctgtatctcagaatggaacaccgactgtcttcaaaccaacatacacctggaatttaaattcaattgtgtatttgttttttaaaataatcagagttagcagttactttaaaaaggtaattaaaatgttttcagagcctatatagtataaagcttgtgatgaattctcttccctcgttggcaaattttttattttatttatttacgttttttggctgggcgtggaagctcacgcctgaaatcccagcactttgggaagccacgatgggtggattgcttgagcccaggagttcaagacaagtctaggcaatatagaaagaccctgtctctacaaaaaatataaaaattagctggatatgaaggcctgtacctgtagtcctagctacttggtagactgaggcaggagggatgattgagcctgggaggtcgaggctgcagtgagctgagattgcgccactgcactccagcttgcgtgacagattgagatcctgcctcaaaagtaaaaataaaataaaataaaagtaatttttttttttgaggcagggtctcactctgtcacccaggctggaatgcagtggcaggctcatgcctcactgcagcctggatctcctgggctcaaatagtcctcccacctcagcctccctagtaggtgggacaacagggtgtgccaccatgcccagctgaatcttctaatttttttgtagagatggggttttgctatgttgcacaggctggtcttgaactggactcaagcgatccacccacctcagcttcccgaaatgcagggattacaggcattccctgcttaaatttttaaaaatttaaatgcataagatgataaagtagcaagctcagtgttagaatttagcttcgtggctaaaaaaaaaaaaaaaaaaaaaacttgttcttcccttctttctctctctcactactcactcagcaacatttattaagagcctgttttctgcaaagcactgggctagacactgtcaaaaataatgtcttgttattttatgcaaataacatttgtcttctatcctgcttgtagtactatgatcttctatcttcctacccttgtatcctactgttctttattcccataaacacctttgctgcaagtaaatgaaagagacttagtttgcaggactctaagttttttaatcctacttggctaataactccactgatacctattaatattaattggttgatgtaacaaaaatatacccaaacaagtgaactttttaggaattttgtaatggtgacatttatccaaaagactttgatatcctcaggtacagatgggtctgggggtcttgtatcttagatatacaagatgtgggatcccattaaacaagtgcccatcctgtatcaccatccttcactgttattgagaggtcctgaagttaccgggactatcgtgtgctgtgaattctaattcgctaagttgactctatatgggatttcatgctctgctggtaagtactttatttatccatctattatactaaattgtgcctcgtttctcccttgtagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtatgtttctttgaatgccagcattgtgtgtctgtaaatttagttttatgaactattgaaaaccactaagcaatcatttattgacacgtcaaatgtttgcataccagttgtctgttttaggctctggagataagacagtgaacaaaaattgaattcttcctttcatagagcttaccgtttaatctttaacagtgagatgtaagagctccaactattgatttcatttatatttagaattatgatttgagctttttcttcaggatgccaaacattttcaagaaaactacaattaacgtgtttcccattttttcccatatatcaccgacacctaaagatttggggaccttgggactactgatttcttttctccaaaatacgcttttggatgtttattgataaggggacagactaaactactgtaataaagaaacaaacaaaaagagagtggctcaaacaaaatagaagtttatacctctcccatgatagcacaggactaaccaggcacttctgctttaaggggtcacccagggaggcaaattctgttttgttgttccatctgccactatgcatagtccttgtctctagagaggaagctttatcaccattacatgcatgttccagcctgcaggaaggggaaaagaaaagggatgatgtggaagcccagcacttacaggatgtgaactgaactgtcatttgtccatgtgacttctacttacaatccactgatcagagctgggtcacatcatcccctctagctgtaggagaggatgggaaataacaatggctgttaggtaggaagccacacgtctacagatatgggtaggtttcttttgaacgtcttagaatgtacatatcagtagcaactcagtaattgtcttttctaaaacctgttatcaatatgtgagaaaatgtcagaatgagacccattccaaataagggaattcattgcaaaatttttctgatgtatataatgcattattaaggctacctcacattgggcccagctgaggaatttataaaattttcagaagatataacgtatctataatataatcaattgcagactgctgcatagaacagagagggaatgtgtctgctatagtcctttagttgtttggggtggtgcactgattcattcactaaaagtttaaacccttgattttgatgatcttgcaggtaacacgcaatgtcatgactgcaattctcagcttgcctccaggcgacatctataacctctcagtaactgcttgtactgaaagaggaagtaatacctccatgctccgccttgtcaagctaggtaagaagagtgcacagagatgggtgtgaaataatcactaatgtttgcatcattcgattcagcaagagctcctcaattcaatgaaataataacagaaaaatggctaattttttatgagtagaaaatagacatttgtactagcaaaagggtatgttcaacttggtacaagtttctgtgagtgggttgtatactgttctgggaaacagtggtgttcgctgttctttgtaaggttaaagaaaccaggtagtcataggattttggagatggaagcacattagagattatctaatgcagtgttcacaaccctataagacaacattctattttcatattaatattatgtaatgctctctttaatatcttaaatagtaatggatttaaaaatctacatattgattttttaaattttatatagtttcccaactccagaataaaatcaagacaaaaagaaactaatttataataaaataatatggatttcctaaatatatggtcagacacaactactctaaaagacataatgaaattacctgatgcctagatataattaaaatgaataagttggggtttataagaaataaaaagatcattagtccttcatataagaagtataaaaataagcaaagaaatgaacaagttaatataaattgataacaaataactaaacaagcatagatacaggtagatactagaataaaaactagagttaaaataagtactaaaagatgagatatattttcatataatgagagaaagatggaaataattttaattaaagtagggacaacacaccaaaagtttataaatggcagcatagaagcaagctggcttcactcccctctacccaacagaaaaccaaaagcaaatatacactctgagattttcaccagcaacaacccagaactcaaatacgaggatgcgaccgattccagagccatagagaagtgaaaatactctgggcagatggtaggagaatcaggcttccacattcgtgacgcctcccccgcgattctgcctggcaacaagtgtgcagaaaatcttctgccaactcatgtttctacactggaaaaagtgaggttgaggtagtcaactagtttccccactatcttgggctccctggcaggaaatctgtccttgccttaacccacaggaagcatcgtgactgcctgaagggagaaatagcttgaggataggcagaaacaaagagatgagatggaactaccattcccagtcccagcaactctgctctgtaacttggccaaaggagacaccaaatcagagtggctgttcagcagcaccatactgtaggaggtacatttcacaggtcccttgggcatgagccccccagctaactttgacacactgccaggataattcctttaagacctttctttttcaggacaggcagagccaaggcaaatctggacttaaggtgccacctagagctgaaatgtaggcagtgatctagtggtaaatatttgctaggcaaacatagccaataaaagacaaaacaaggcaaggcagacaaaggaaagtggactaaatagttaattatttaatgcaaagacatagttctatgcccataagaaacaacatcaaacagggaactgtgacccgcccacgctacccaggaaaaggacaaagcaaaaatccaatgactgaccctaacaagatggtgatctgtgagctctctgaacaagaattcaaaatacagtttaaggaaaatcagtgatgtccaggaaaacacagaaaagcaattcagaaatttatcagagaaatttttaaatcaaacaaattcttggtactggaaaatacgtttgctgaactgaaaaacacatcacagcagaatggacaaaggagtggaatgattcagggagctaaaagcctatctgaaaatacaccattggaggagaaaaaagaaaaataagactgaaagtaagtgaagtctgactataagatattaaaaaaaaaaggctgggcacggtggctcacacctgtaatcccagcactttgggaggccaaggcgggcagatcacgaggtcaggagatcaagaccatcctggctaacatggtgaaaccctgtctctaataaaaatacaaaaaaaaaaaaaaaattagccagcatggtggcgggtgcctgtagtcccagctactcgggaggctgaggcaggagaatgatgtgaactcgggaggtggagcttgcagtgagccgagatcgcaccactgcacaccagcctgggtgacagagcaagaatctgtcaaaaaaaaaaaaggtattaaaaaaaccttaaaagatcaaacataagaattattagtattcaagggggagctgaataaggaagtttactgaaagaaataataatagaaaacattccaaaacttgagacaggtacaaatagccaggttcatgagggtctgagaataccaaacagataccactcaaataaaatcaccccaaagcgtataatactcagactctcaaaggtcaaggacaaagagaagatcctgaaagcatcaagagaaaaggagcaaataacaggtaaacaagctgcaattcacctggcaacaaactgtacaggccatgaggaagaacatttttacagtgctcaaagaaaaaaaactgccatccaagaataatgtatccagcaaaattgtccttcaaatatgaaggaaagataaagtatttctcagaaaaacaaaagatgaaagaattcaccactaccagacctgtcatacaagaaatgcaagagagttcttcaatctgagagaaaaagacacatgcgaaaagaaaacttttcaaggtattagacctttgggaaaattaaatgcatggaccaacccaggatattctgttactgtgattgtggtgtacaatccatccataactctggtataaagcccaaaagacaaatcttttaaaaataataatagctacagcaacctgttaagagataggtaatgtaaagcatgtaaattgaggcaacaaagtcaaaattgggtggtggagagagatgaagttaaatttttaggtgtggtagttttgcttttgtttctattcttttgctcatgatctaagataagttgtcatctctctaaagtaacttgttatggccaggcatggtggctcatgcctgtaatccagcactttgggaggtcaaggttggtgaatcgcttgagcccaggaattcaagacctcatctctactaaaaaaaaaaaaaaaggaaaaaaagaaaagctgggtatggtgacacatgcctgtggtcccagctacttgggaggctgaggcaggaggatcactttagcccaggagattgaggctgcagtgagctgtgagctgtgattgtaacactgcactccagcctgcatgacagagcaagacccccatcttaaaaataagcaaataaataaataaacttgttaaatctataagattttttataagccttgtggtaaccacagcacaaaatcatataatcagttcattaaaaataaaaagcaacaaattaatacataacacttaataatcacttaaccacaaaatatgaagagaggattctcaaaacaatctgaaaacaggcaacaaaacggcagtagtaaatccgtacttagcaataataacactggatgtatatggtctcaattctcaattaaaagtcacagtgtggctgaatggataaagaaataagacccaactatatgctgcctttgagaaacccacttcacctgtaaagacacacagggactgaaagtgaaggggtggaaaaagatattccatgcaactggaaaacaaacaagcaaaaaagcagatgtagctatgcttatattagataaaatggaccacaaatctagaattgtaaaaacagacaaagagggttactatataatgataaagggatcagtttagcaagaggatataacaattataaatatctatgcacccaacactggagctcctaagtaaataaagtaaacattaatagatctaaaggaacagatagacttaattacagtgataggaggggacttcaacaccccactctcagtaacgtatagatcttccaacagaataacaacaaagaaacaacagagttaaactacacatgagacccgataggcctaatagacatttaaagaacatttcacccaactgctatggaatacacattgttttcactgcacatggaacattctccagaatatatcatatcttaggacacaaaacaggtctcaacaaattcaaaaagtacatatcatatcaagtatcttttctgaccacaatggaataagactagaaagtggtaacaagagaaatctcaaaaaataaacaaacacatggaaattgaacaacatgttcctgaacaaccaatgagtcaatgaagaaattaagaaaggaattttaaaaattcttgagacaaatgaaaatgaaaatacaacataccaaaatctgtgggatatagcaaaagccatagtatgagggaattttatagcaataaatgcccttaatataaaaaagtagaaagttcaaatacacaacctaatgatgtacctcaaggaactagaaaagcaaaagcaaaccaaacactaaattagtagaaggaaagaaatgtaaaggtcagagcagaaataaatgaaattgagactaaaaataaatacagaagatcaacacaacaaaaagttggttatttaaaaagataaaatcaacaaacctttaactagactgagaaaaaaagagagaagacccaaagaaataaaatcagaaacaataaagtaggcataataagagacctcataaatacaaagaatcatgagagactactatgaacagctataaaccaacaaattggaaaactagaagaaatggatagattcctgaacacacctaatgagactgaacaattaagaacaagaaaaccttaatgaaccaataatgagcagtgagatgaaagtcataataaagtctcctaccaaagaaagcccaggtcctgatggcttgacccctgaatttcaccagacatttaaagaaggactaatgccaatcctgctcaaacttttcaaaaaagctgaataggaaggaatacttccaaattcattctgtaagataatatgccaagaaaaataataggctgtggataaggaaaaacagatactttaacattcttgcaaatgaactggatctttttgtgtagtgtaatgtcaaaataattctttatattatgacatacagctggaaagtgactgtgtagcatacaactggaaagtgactgtgtaacacaaaacacatcttctacattcaaaaattgaccatttattgcggtatacatttagtttctgatacttatagggaaactcgaagacagtatcctaaaatctgccacagacaatggaggatggattgacacaaagttgtgtgatagacctttagagacagtatgaccgaaagagtggcaacccaaaactaaatgcataatttcaatatgtaattttcacagcagagattttataattttcatatttcaaaaattaagtttatctaatggcaataaaagtgttttccacatagttaatgcaatttagtgacatcattttttaagatgtctgctaatttttgtgtctgaatttgttcataacagtctcaagccatctctgttattacatgtgttcatattagcagctgtaagtaaagactaattcgtggttgttttattagtagcttaaataccatgggtagtattgttgacagtgatgtacttttagaaaaattttagaaaatctaaaaaacaaaaaatacgatctttcctcaatttacccagtaattgcatttctccagaactcaatgcataggtcactgagtcttaaatttctttgtctcctatttgccaagacaaaagctaagtttttgtgctgaaatactttaaaattgtataggtaatttggaaatatgtgatgtgttgattagacactatggaagtaaaaattataatattgaataatttataattttaaatactatcttaattggatttaaatatgccttttcatgacaactttcttctaaattattttacttaatttctttttaaaaactttcaatattatgtagcaaagtacttgcaatttacacttatggtggattttctctggtatgacatttgaaagtcatgtgggatgtgggacatgggacaatttgtcttttggtgtcctcttaataattccaggacggctagcatttctaagtcctgaccacaaaagaacagctaattccctctgctgtgactaataaaaacattcctccaaactttcaaacaccctcaagggggcactagtgccccaattgaggatcaagggttgtctcttacctttcctgcactgaaggcaatctgctcttcctcccttgtggtctatacttaaattctacgaatgtggagagcaccaacttccaactttgcataatctttctattaagaaaaaagttgcctgtctaccaattccagccattatctctgactctgacctctgtgggtgtaaagggccgttcaaaaactcatttccaggtaactgtaattacttgaagattgagctcatattcccaatgtcttcctttttccaagctttactaatacaggaagctattaagtgtttctcaggtcctagcagctttctccaactcatttggtttttcagtctcccttaaaatttaagttcagaggtggtcttatcaaagtagcatttagtgggcctattggatacttcactgaaatttctatgtgacatcatggtcgaaggtgcctcaggaatatgagtcaaagtcatgaactagtacaactgtatctacataggactgtgagttaaaaccatgatagtttcccaaacttatcaaaatgtttggagtctccatgtctccctgataatagaatggactatgtaaaccagcttggaaaatttatttaaactttacaagaaggaaagttgagttttcatggaaattatttctagttaatgtaacccttaggatcaataacctttttcttattggtatcttaaatatcaaatggaatattgtttctatcttattcctctctgtagacaagacaatctttttatgatgtgcctttcttattttcttgaaaacatataatgttggtttttatcctttagtcaaaagatctgttctactaatcatgttattgtgtatataagccctttccattttatataacacaatgcctgaacacctataactgcttaacagatactgttgaatgaattgaaattgcggacctcaaagttgaacatagtattgcagttaatatttaatcggaacaagtttaacctttcagagaagtgaaataatatcttgctttagtagtacctgaattgcaggttttgtgtgtgtttgtgtgtgttttttacagaactttcattctagttgttttatgtttcttcccagcattcattttgatatatatagaagtcatagtcattctcctttaaagaaaaatacaactttggcacagatttttcagagcatgtttgaatcagaatgccattgttaaagctggggccgtaactggttgggctaacctgcagttcaatttatctataatagaggcctctttagaatgcctctgaatgactcctgtgtcatggagggtaggttctacctctatagaaagaaaccaaactaccaatgagtccagtatcatataaattaatctaatgtgtcatgtgcaagggtagagagccctcaaacagttgccaataattctcaacattgtatcatcaataaacatccataaaaagaaatgcaccaataatggtgcttttcccaggatgttgaaccaaccatcccattaggaattttaggttgccagcagtttcacgaaactttggtggtatgtgatgacaggtccctttgacagtcagtcattactatcttctagtcttggtgaatcaacctggatccctgggccaactttaagaggacacgttaagtctacataagataatcagtttcccaaccttaaaaaaaagaaaaagaaaggaaagaaaaaacaggaatgagacgtgttggacacatcacaaatagctctctggtaatagaatatccattcatcaatccatttaactaatatatattaagaaccttctaagtactactcagatgccagagtacttgtggtagtcgtgatggtaatgaacccagagcgctactttcactttctgttcacaaggagcttatgatctagtgaaggggaagatggtaatagtgctgtacagtgctctacaacagggaaatgtggtgcagaatgactgtgtggtcaaagctttctttgaggaagccatggaggctatggtctgaataacaagaagaaccagccacaaaaaggccaagaaggaggatgccagacagagggaacaggcaggcctgagtatagatcttttaaggcatgcagttggaatattatcttcagagtaatgaagggccatttagagaacttaaaataaacagtccgatttacatttaaaacaatccctctggttgcttaatgagaaagggattattgtatcaacaatgaaagtaggggaactaattaaggggctatttgtgccagctttaaaaattatattctaattcaaagaagttgcaagagagtgatggtaactttgactacggtggttgtaatggagatgaagagaagtggacagaattcaggagctcttttggaggttgtgtccacagaactttctgatacggcagaaacacgaagtgagggaaagggaaattaatgactcccaggcttcacccttgagcaactaggacaaatggtggcgcaattcactgagattgagatgactagtaaaactacaggaggaggacatttagggtgaagtaagaatcaaggattcttctttggatgtaaacaaatttaaaatgattattggatatcccggtgcagatgtgaaggccaggggagaattctgggctggaaatataaatttggaagtgtctggatgaaatcaccaagtagtaagtaaagacagggaagaaaagagaagccctggatcaactctagaggagccaccccagcagttagaaattcagcttagcaggaagcatcagaaagagagagtggaaaggaacagctaaggaggtcagagaaaacaaaacaaaacaaaacaaaaacagaattgcacaccaccatcatcaaacttatgctttatcctgaccacagacatgttcgggcacgttcgagataaggaatcatataactttagtgctaggagagcttttggagataattcagtgctatgtcctcatttgaacaagctggcgcttagagaaatgtgacacgctttatacattgctaggtcttggtccagaaacagtcatttcgtactttttatccatctgctgcttctattcctggactggggtgtggcctttttccttcaaacttcattttttctattaaaaaatttaacagaacagggaggagcctcatacccacttttgtgactttccgttcctctttggaatttggtcttagggacattggcttgattttcttaatcttactcatacaaacctttatagagattagaaatctttaaaacataatttggctatggacaagaaaaaaatcaaaatactttgaaatgttaagtatttgggggatagtaggctttttctctctgtctctctcaaatatggttatagatacatagaaatctgtaggctgccagtcagctagaaagaagctaataaaatgcttaaggtcttatacttttttaaaaaaaattattcatcctgtgaatcagagaatatttacttagcatttactatatgccacacactattcttggttctgagcatacagaaatgaacaaaactgacaaaaatgtcaaccctcattctaatggagaaaaggagatgataaacataaatataagaatgttaaatggtgataagtgtcatggagaaaagtgaaagaggaaaagaggataggaagtgctgtgggggatgggtgcaatttttgtgaggagtagagtaagtgtcactgtgaaggtgatgtttgagtcagagcctaaaggagatgagggagtaaaccaaagagatcactgggatgagattctgtaggcagaaggaaccacaggtgcccagctatggaagcatagtgttcctggcaagttcaaggaaaagtcaggcaggcagtgtggctgcaatggaacaaacaaggtagagagccatagatacagggcagagaggtagcaagggaacagaccgtgtagggtcattgaaaagacactttcctgtgagtgagatgattctccattgcatgctttaagcagaggcgcataacctaacgggtttcactgggtcactctggtgataatagattgttcagggcaaggataagagcaggaaggagccaattaggtaatatgaccatacatccctgttgccttagacaataccactttgcaactcttatggattatttaaaaggcagtaatcctctttaggatttggggcaaggcttttctgccccaaaagtgttcccgtgtggacatttttgataaattacatggtcaccttaaagtttagagaacactgagtctgtccagataagagattatacttgtttaggtcagactgggagccacagaggcgatgaaaagtggtcagattcaaaatttattttgaaggtgttgctgagaaaatctgctgatggacttagatgttgtctatgaatgagtaaaagcagcctagagacacagcaagatttgcggcctgagcaattggaaagacagaggtttgatttattaacttggaaaagattatgggacaggctggtttggggcaatgtcagaagttcaggtctgggtgggtcaacattttgaaggttcctatgaaaccattaaataaatactgagcaggcagttagataaaggagcttggattcagtgaagacttcaggactaaaaatataaatttgagtgtaggcaggcgacagatgtgatgagttaacaaagactcaataaagaaaaaataatgctatccaggaactaagccctgggccactccaactttaagacatggagatggtgagtaaaaaccagcaaaagagactgaggagcattggccagggaagcaagaaagagcacagaaaagtgtcctgtcccaggagccaagggaagagaaagcctcagcgagtggagattgtccaggtcaaacctgtgaacaaatctggtaagatgaggaatgagaattgaccactgatcttagcagcccagaagtcactggtgattttgagaagaggcatttgggtgccatggtgacgggaaaaaaaaatctaaaatgcacaggagctaaagaatagaagaatccaagaatttttggtagttttttgtttttattttgttttctttaagtgagtgaaaacagcttgtctgtagactaagcaaaatgatccaacaaaacagagaaaactgttgatgcagcatagttagaggtgagacttggtgtgatgtccttgattggagcagaggagatggaacccggggatccagtggaaggattgggtctggatatatcttcaggaagacaatgacagacaaacagacagtatgggcattaatgggatagtgagcagagtgaagatcatgatagccgcttgtggatggtttcttctgattgacttcttgtaagataaacacatgcatgttctttaggtttgcagggggcaatacctgccatgctactcttctgatatatacctccatggccagcagccccatgcaagcattgttttctgatttaggttctcagtgacagccatgccacagtcccatggctctgtacctgggcctgacactaaccaatccctcgcctcaatatacccctcctcactgcagtcttctgagtgtcaccatggtttgtcaactgcccagaggcataccaaaccactttagtgcttctttttttttttgagacagagtcttactctgtcatccaggctggagtgcagtctctgctcactgcaacctctgcctcccaggttcaagcgattctcctgcctcagcctcccaagtagctgggattacaggtgcgcaccaccacgcctggctaatttttgtatttttagtagagatggggtttcaccattttggtcaggctggtcccgaactcctgacctcttgatctgcccgcaagtgcctcccatagtgctgggattacaggcgtgagccaccgcgcccggcccactttagcacttctctaaaggcatttctcctgcccatcataaggtactgcatattctgcaggtacatgattctctccaatgtattggaagaatctgaaggagggacacatagggcaatgactgtgaagtctggcattgacctaaatacacaagcaagtgcccactctggaaaagttggtcttgtaagcaaaggaatttttctggaggcctggtcatccccacttatatgcaactgactgggaaactcactgattgggaggaaaacaggtgtaataaggacccttgattaggagtccagaggtgtggatcccagttcttgccctcacaaacaaattgtgttaccatagcaaagtaactcagaccctctgaattccagcttcctatctataaaatgagtctgggctagatgatcttttatgctccttcaacttttagaatttcgttccatacctgagttcagaataaaagcagcaagattaatgatgcaatgaaagtgctgatcttattctaagaattttgcaatatatgactcctaacaaaataaaaatgctaagtaaaagcacatgctcctggaaccactgaaaaggaggtattcagatatttgttttgaaactaagtgaagagaatcagaagggtgagggggtgggaagtgggtggatgatgagaaattatttagtaggtacaatgtatgttatgtgggtaatgaataccctgaaagacctgatttcaccactatgcaatctatgcatgtaacgaaattacactagtatcccataaacatatgcaaatttttaaaaatttaaaaaaaagaaagtaatgttaaatgggagctttctctgaaaaactctattgatctttagaagttacttaaggtactaaaactatcaacccatctagtgattcacagaagaagatattatacttgctatctctaagccttaaagaatataggtaaggctgggcacagtggctcactgcctgtaatcccagcactttgggaggccgaggcgggcagatcacttgaggccgggagttcgagaccagcctgcgcaacatggtgaaaccctgtttctactaaaactacaaaaattagctgggtgtagtcgtaggtacctgtaattccagctgctcaggaggctgaggcaggagaattttttgaacccgggaggcggaggtcgctgtgagctgagattgcgccgctgcactccagtctgggtgacagactgagactctgtctcaaaaaaaaaaaaaaaaaaaaaaaaaaaaaaaaaagaatatagttaaaaagtaatgcaaatgacagacatttctaactcctgagaaaattttatttttatatataggaaaaaggcctcataatttaatgtgttttcaggtgctaaatatttgcctgaatttttttttttatttcctggttttttttttaaatgttcaaattacttgttaaatgtatctaggaaaagaatttccctaagtcaacaagacaaggtctaataaacttcaggtctaacaaagacttctgctgtttaatgtaaatatttctctccttaatttcattgcatatcaatcttaactcaccctgaataatttctatacctcttgtttattttcctttcagacagtgctttcttttgcagatgttatttcaccaacttgagcatagtttctgcagtccacactgcttacattgcagatgcttcctttggccaagtcgaatatactatatgacttacgctgcttaacatagagttgcttgagttgaggaaaataaaaataaatttaaaagacttatgacaatatagatgttaacatttatgctttgcatatgaagagcattctaaaaaactgttatcagtgaggctaaagattgaaaataaatgttgttatgtggatcatggattaagataattttaacaatacttttctacttaattttccttattaccaatgttgcacatttgtaaaatgactcaccacgctggtccttatggatataatcttggcctcataaacatcattctctaggcagctaaattaatgagtcacattaaaagaagaaacaatgtaatagctatcagagaaagatgggttttagacaataaacacattacattctgctcctaggctaaatattacatctgactattccctttggaattcctgagaaaaggaagagatttgctgccagagcacagaataagaatcagacactagctcacacttcaggaaggtcactttcactccccagagatcctaggcaacagcttgagcctctcataatccaatctaaattaaatggtagagatggccttgcagccttccagtctgcccatattctatgcattgtacttgattttcttataaaattagattggattctcagtccaaacccggagaggcatggaatgagagagaagaaaagaaaatagggaaggccagctagttgagtggaacgccagcaatattagaaagcttttagagggtatttaaaagcaaacaaccctatatctatacctcattttatgaaaatggtatgtctatcccccttacccatatacataggtactcacaccaaatatcatggactgtgaagttattttaaacaaaaggaaatttgaccttttggagcatgagaatatggaaaatgttatgattgaaaatgtcatttagagagataaaaagcaatagccaggagatgttccataactaatatctacatgactttacattatataaagtgtttgtgtatgcattgtcttaaatttcatttactcttctcaacattattggttttttcctatccttctgctttagaagactgactgtatttgatattttatagggttttttcatccctcatgtgcagaaagggacatatttggtattttgaatagtaagagactgtattagtttgctagggctgtcatagcaaaataccacagactgggtggcttaaacaacagaaatttgttttctcacagatctggagtctggaagttcaaggtccaagtgtgagcagagtaggcttctcctgaggcttgcagatgatcactttgtaactgtgtcctcacacggtcttttctttgtgcttgtacatctctttactgtttatatttcctcttcctataaggacaccagtctgattagattagagcacgtgctaacagcttcatttaatttaatcacctctttaaaggccctattcatcctgggtgtggtggcttacgcctgtaatcccaaaactttgggtggctgaggtgggtggatcacttgaggtgaggagttcgataccagcctggccaacatggtgaaaccccgtctctactaaaaatacaaaaattagccgggtgtggtggcaggcacctgtagtcccagatactcaggaggctgagtgggaggatcgcttgaatctgggaggtggagtttgcagtgagccaagatcatgccactgcactccagcctgggtgacagagcaagactccacctcaaaaaaaaaaatagtcacattctgaggtactaagggttagggtttcagcatatgaatttaggcggaggggatataattcatcccataacaaagatagaaagcaatcaaaatgcctttgatgtcattgtattccctatcatatgcaattgcctaattaatatttagccactatctactttaatcttgtgcttctgagaatggaaaacatgagtcatgtaaaccaggggtgtccagtcttttggcttttggcttccatgtgccacactggaagaagaattatcttgggccacacataaaatatgctaacactgatgaatcaaaaaaatttcactaaaaatatctcacaatgttttaagaaagtttatgaatttgtgttgggctgcattcaaagccattctgggcagcatgcggcctacgggccatgggttggacaagtttgatctaaaccatcttaggctgtggcactgagctggccttgacttctcatgagaagtgggaaccccctagccagtttttgccagaaatttccagacttctactctaggcaataagaagaaatgctctaactcagtactattcatttgaaacataataagggccacatgtataactttcaattttctagtagccacattaaaaattagtaaaaagaaacaggtaaaattgaattcgatatactttatgtaaccaaatatatccaaggtcatattgttccaacatataatcaatataaataattattaataagatattttattcttttctcacactaggtctttgacattctgtctgtattttacatttgcaacacctctcaatttggactagccacatttcaagtacgcaacagctacatgtggctagtggctgtgttggacaattcacattccgattcttacattttaaaacatttcctgggacagttgttgtcttgagtaggaaaatctaattataagcactcccaattcaattatactttcacttgtgaaatcttgtaatagtaataagttcataattataataacaataaattgtaataactttctttgtttcctttgggataccagagttaaatttctgcctgattaatttagggaagcacaccaatcacgaagatcctgaacagtcctcaagcaggtgatttatgtatgtattcattgacctatagagctgacatgtaaacgtcttccagaaaagtacacagtgatcacaggtgcagggaccttgaaataatctattgccctcatattccacccaaaaagaaaaatttgttacgtggttgttagatgtcccagacctttaggagattttcctgaggatcttatcacctagagccacattctcagccagaacaaaggaaaccctcactgcagtattcatgtcgtattccttggaccactgggagctcttgcagtaattcatgatagttcttgactttgcccctgaaattggataattttacctacataaaaacagaagagaacattaagatacaacctcagcgtgtctggtcttgcctggtgcttgaatcctcctcttttggttgatgaatcttgactcatgttttaaatcagccaataaataagattttttgagtacctataggtggctacttcaaatgaagacaaagtcatttataacacatgacccttgttcttaaagaatctaataggatctactagaatcaggccttcactcacatagattatataggaaataattaaaggcagtagaatgtcagagaagggataaatcattaagagaaagagtcaccaaatgagacttcaaggaggaggtaagactttttcttgaccttcgaatgagcagaataaagagcatactgattgaaggcaaacatgggctgacatagagcactgccctgaagttcagtgagaagactgtctttcccaggaggcaacacatctgtgtgtcaggaatggtggtgaagctggttggatagcatgcagccagtttaagcaggatcttaaagacatggtatgtttggatgtgataccacagacaatgcacagataggatttaacatgagtgaaatggcattttaaggtgattttaatccgttgttgacaaaatgaagaaagaattgattagagccagggaaaaagaggcacagcaagtttgtgatgatcaatgaatgtgatcacaaaagtctagacatgcaatataatttaaaaatagattaaaggaggccgggggtggtggctcatgcctataatcccagctcccagcactttgggaggcagaggcaggcagatcacaaggtcaggagatcgagaccatcctggccaacatggtgaaaccctgtctctactaaaaatacaaaaaaattagctgggcatggtggcatgcgcctgtagtctcagctactcaggaggctgaggcaggagaattttttgaacccgggaggcagaggttgcagtgagccgagattgcaccaccactgcactccagcctggtgacagagtgagactccacctcaaaaaaaaaaaaaaaaaaaaaaaagattaaaggaaaaggtaacgagtttttaaaagatatgctctctgggactgagaaataagggaagagcctcagaattgtgactgaggaacaattctgtagtgtgcatttttaaaaaagaaaagcctaggctcagcctaactaatcattcatctatgcccccaaacaacttcacacttggttctatagattcaagttccacatgagtcagaatccctaaaggacataatcctattagcaaaggcagttataaaggaagtgagaagtggaaattgacctctgtgtttcattagcagtcttcctcagagcagaagtgggacaatacaatgcctggaggactggacaattcattgcaagtgaaaaagggctcctgacacctattgtgaattttgcttgcctaagaagaactcatctctttcctccttcaactcttctgcctaaccttgtcaagttgctgcaggaaagaaacatgcttctttttagttggacacaagtttaggagatctgtgataaatcatggcaagaatgattttgacatacttcttggtcctgggcagagtcacaatgatgatattctagaaacaaggttcaaatctttccacacaaagatgtgtacctgtcaaagcagtgaaatggctgacaggactttttcaagcacctctaaaggacaggagctggagaacagacttaggagagtggggcagaaaatgaaaaatccaagtaacaagcaggaagaaacctacaacagtgggtagtcgtctgacaggcgcatataggtggatggaggatgctgttatgtgaacctagcagcaaggtacaatatgtccaaataagcaatgtcagggggtctgagagcaggtaacagggaccccagcttaaaaccttgagttcaggcacagcactctgcatactgggggacctagagggaaagacaacatccaaaagacagggtcacaagcagaagaccaggagacattcaggaatggagaatgagacagcagatgactattagaattgaggaacaggcagggttttttggtctcaagagagcaatgccagtgactcaattactagaaataagtatgaaaagaacagacaacacagcttcctttacgaatggatttatttattattaagataaaatgtctaagataaaaaatttatctaatgttttattaatcttctaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatgcaaaaataagccaggtagtcccagttacttgggagtcgaggcaggaggatcacttgagccagggaagatgaggcttcagtgagctgtgttcgcactactgcactccagcctgggtgacagagtgagacccccgcctcaaaaaaaaaaaaaaatgatactatctgtttagctttatctttttaaattttgactaaattttcaagcagccatttttctgtctgaattgttccagatagtttccagagaaaggaagacaggttgttggctaaataccaaactgcatctcatcattagaaggaagcacaccaaatttcatttttctccacctttattaagtgcagatttttgtttctcatccaggaagttctgtattatcagggcaatgctaacttcagtataaatgacacagaaactattaatagattatgactatgatgaaactgaagtagaaaacagaagtgttctgaaaagagaagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggtactgtaccttttgatctaccttttctcagttaacttaagtaaggctaattatctgggcaaaataagaatcttctatttctttgagctatataaaatgaaaactgtttatttgctcttttgtgtttcagtgatagaaattaacagcaggcttagaccaagcccaaaagttgttatgagaacttttatctttgtctgtatcacttgttcctaattcataagtcactccaggtcagacaaaggaataaaggtagtaggccattgaattgatcaagggaagaaagaccctacaatataaaatataatttaacaaatatgaaccatttgccaagtatataaaggcactgaatagaacacacatgatagaatcaatatttgccttcaaaacatttttatatggtgtagacattgcataagtatagaaaaaagtaaagtaaaatataagtaccacaagacaggtccattcgaccaagagaatttaaaagaaacgtgcatatctagtttgtaagggggacagtcttattgcaaaatgaagactgagagaaggttattgctaaagctctagaattacaaatggcagatacgataaacagagttattcaccaggtcagaatgaatgaaaggaaagagatgaacctgcagttctatgagtggcaacgccacaaggaaaaaatatttcacagccagaagtgaaaggaaaaggacagatttgttagggattttacataatatagtgtgtagactaatactgcgaacataagtaattgatcttttttaaataatgaagttcatgagattgagaagaaaaaaggaatgctgggagtgcaaatcttttcatattgaatgctaagataatttgctttgattcctttctccttttgagattcccttctatgaatgtatctcttgttgatttgtactgaacagctgaattttctctattctaagaatccttttggaaaataactgctctgccaataatggattttcttctctataactacagtgatgccttcctttaagaaaacaatggttagttagctacttactacaactgagtcctgttagcaaaagtctttccttagaataattcttttatagaatagtgaaagagaaggaagtggaagaaaatgctgatggctctcatttctttatgcaagggtgtttcaaaatcttgttttgaaaaaaatgctggctcatcttttgctgttgtacggtagtacttgtcactagtctggccatgggtccaccaagttagcaacttctttgactcaagaataagttaatactaaatgtttcttagtgcggatagttgccatgttttagtggatgttatataaaagctaagaatgcagacaaaggtgtagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaatgcaaaataaaactacaatatacaattttcactagtaataatgggaaagctcagagtttgcaaatgtatggtactggaaagaatgtagggaggcaggcattgtcacgcattgatgccaaaggtgagtaacttgcaaaatgtctgtagagaactatttttctatagctttcaaaattttaaatgtacactttttgactcagcagttcaaagaatgtgacactagcaaagaatatatgagtatatgtgtatgtgtgtacgttcacacatatatacatattacatgcatatattgtgtgtatatatgtgtgtatatatatgtgtgtgtgtgtgtgtgtgtgtgtgtgtctatatgcatatgtgtgtgtcttcccaaatttgtgaaatgaagttcattgtagcattgtttgcaatagcaaaaaatcagagaccatttacacattcatcaaccggggctcattaaataaattatggtatgtcctttcaacggatttctgtccagctcttaaaaagaataaaacagcttaatctgtactgatatggaaaaagcaccaaaatatattgatagctaaggtaaaaaaattagcagaataatgtgtaggctaagccatcacttatgttttttaactgtgtcatatatgttcatacatccataaaatgcatatgggaagaaaaataatgcctgacaacatggaataatgctgcttccatgaaagggaattggtcagatggggaatggggaaaaaaggaaacatttttcaatgctattctttgtcatcttatacattttttactctgtcaatctattaccaactcaactatgaaatatatttttaaaaaatatagatgaagttaacctaaaatttatcttattttctgaaaccccaggaaccagttgctgtttcttcccatgtcgtgaccatctccagccttcttcctgccactgcctacaattgtagtgtcaccagctttagccatgacagccccagtgtccctacgttcatagccgtctcaacaatgggtaattatacacattagtgtataattttctcactttttttgaatatatatatatatatgtatttgtatcaatattccaccaagaaatcccaagcttcggagtcagagagtccttaatttcaatcccaaagtgcacttactagctatggagttagagaaagacatttggtgcctctgagcttttctttcatctgtaaaattggaataataatatgtaactttctgagttgttttgaagcttagaaataaaatacttaaatccttagtatatgctgtctaaatgctagttgctaactcatctcatcttcttcagtaataggcacagtactcttatcaatccaatttcatctatttagccttggtcttcatctgtcactgatcagagaatgacataattgataactgggtcaaagcaagaaagtttccaatccagccaaaagtataagtgggaaaattagaggttaatgaaaggtctggaatgatgctgtttatttccttattcttttcttagttgtattacatgtgttactcctggtttgttagagtctgattctgcaacctgagaccctctatgaagcctcttgtaataaagtcactcataacttcactggtttagttccatttctgtaatattagtcatatatttagctgctaaattcagggatgactggagcggactgttttcttttttctttttctttttggttttctgtttttaatttttgttttttcagaagagaggacaaaaaatatacctgcaaagtattttaatggtctctcattcctacatccttgtacactttctaaaatatacagttgacgatgaataatgagagacttagaagtgccaacctctgcatagttgaaaatccatgtataatttttgactccctcaaaacttaactactcataggctactgttgacctgaagtcttaccaatgatatagacagttgatcaacacatttttgtatgttatacttattatatattgtattcttacaataaagtaagctagagaaaagaaaatgttattgagaaaatcgtaaggaagagaaaatatatgtactattcattaagtggaagcagatcttcataaagatcttcctcatggtcttcacattgagtaggctgaggaggaggaggaagaggagggtttggtcttgctgtctcaagggtggcagagagtaaagataatccatatatatgtgaacctgcacagttcaaactcattttgttcaagggtcaactgtaccttaatgtccatcattccttgtcagctccatgacaatgtagcataacaggtgatattattaaacttatttataaatgaggaaaatgaggcccatagggcagatgaaatggcttctctccaaatagcagtactcaagcgaaaaagctcttctgatcatgagtccattgttctttctgtttaagcactctactcataaactggagccaagctggcccaaatgggaagtggtaaatacccagaaccttagggatcagatgcacctgctcattctgtgactttatgatcaatgcaaaagatggtatgagtcctcaggcccattttaaagagttttataagaatattaaacctatgttcctgcctttgatatcctgttcttccgtgtagtatgaagaagtagacaatgtgtaagtgccacaggagacaagtctttatatatagtacatgaaaaggacgtgacccctgttcttcagggccctacaacctattaataggttttatctcttgagctgtgcagatggaaaacctctaaacatatggccacggatcatcagaatgtctgcttctagtaatgtgttaagtgcttcagcagatggtagtttgctaatgtctttttgatatacattattagttgtaagcaaagtatacagttgtgctttctgacttcaaaatcatgggcgtaaaataagaggttgccaccctctaagcttgtgaaaatgttaaaaaacgataatgcatgataatgacttccacatttttagctttcaaatgaatttaaactgtggcacaggtattcttcattctttagtttccctatgtaagaatatcctgaatgttgtaggcctttgaaagggactcaattcttccagacacctcaataccacttatcagtctagtttgctaagttacagttgaccaggaagaggtcattgctggcttggggaacatgattgttactattattggtatcatcgtaagctcactgcccttaagactagatgaaaagcaatgaattgttctgtttggttccctgtaagagaacctatgatgaaaatgcacaacttatctctttagttacagagatgaatcccaatgtggtagtgatctccgtgctggccatccttagcacacttttaattggactgttgcttgttaccctcattattcttaggaaaaagcatctgcagatggctaggtaagttaagttttactaatattttatccggaatctttaaaatatctttatctgccatatatatattgtttttgcacacctaagttgtatagcggtatattggattttagttttcagtgtctgtttctattgtgtgtgttttctaaatagacttcgaaacattatattggaaaatattaccattgaaatgagaaagcaaaggattgcttgtttacacaaagtcagacctcttgctatcaatcttggcatttgaagtagcccatatatggagatccattacatttgggtactttcatacacatttggaataaaagaaatatctatgacagttcagtatagttaatgaaaaaagttaataaaaatggagatgacaagaaagaacggggtggggggcgggaaatcctctccataattttaagctgttctattggaaaatatttgtacagtttatgattaggtccattagcagtctctattagttttattcctattactcagagttgcagccagcttagtttttcttgcaattagaaaagcctttgatttatgatttcagctcttccctgttcctttgaccactgatgcattgctcatcagagcacattctcaagtagtttctgtggccccctgtattatcagaataatctatcaattcccttaaaaactgttgcttatttgaatactacttggtttgggaaattttgttaacatttatatttgcccaatattaacctgctgaattataaattaacattcttctcctgtctcagagttctatcactcacatatttataaataaattcatctatccaatagtgatctaatcagtgcctgacatggcatatccaaagaaaaatcagacatcaaagctgtccactaggagcttacttacctaactggatatatgaatagatagatatatttaaaggcataagctgacatgtagcataaaggggattaaaaacaggatgccatgaaactagagaataaagactaattctgaatgtgaaaataagcttcttgaaggttggcatttgaataatcttaaaaggataagaagagatgtgggattgcactgtaactacagtggagagctctgaaattacactccttgaggtcaaatctttttttttttttttttttttttttgagacagagtctcactctgtcgcccaggctggagtgcaatggtgccatcttggttcactgcaagctctgcttctcaggttcaagcgattcttctgcctcagtctcctgaatagctgggattacaggcacgcaccactaggcctagttaatttttgtatttttagtagagacagggtttcaccatgttggccaggctggtctcgaactcctgaccttaagtaatctgcccacctcagcctcccaaagtgctgggactataggcgtgagtcaccatgctcggcctccttgagatcgaatcttgacttccaacttgcgtgaatttgtgtaggtcactgaaacttcatgcgttcatattacaaatattgctacatatatgacagtatatgaaacagacaaaaatatgtgccttcatggagctcatattctagtgggagaaatagacaataaacaataaagatataagtaaaaggactgccccttaagttagcaggtgataaggaaaggaaacaaggtcaggtaagggagataagcagtaccagtgtggtgttaggggtcctaggaggtgggtaggcttcactgaaataatggcattggagcagagacttgaagcacatgagggaggtagcctgtgttatctgtgggaagagtgtgcccagtggcaagaacagctggtgtaaaggccctggggtaggagcacgactgggatgttcaaagtgtagcagaggggccgttgtgactaaagcggaggaagacaagagtagaaggagatgtcaagttatgcagggcttcgtatgcctttggaaggactttggcttttactcagtaaaatgagcaggcattgcaggctctggagcagaagattaacagcatctgacttagatttaacactttcattttgacttttatgtagaaaacaggctgtattgaggcaaggacagagacaggcatatcaactgtggtagccaggaatccaggcaagagatgctaatagttcagtccagagcagcaacactgaaggcagagagaagccatcagattctggacatattttgaaaataggagcaacaggatttgctaataagttgatatggaatggaaatgaaaaaaggagttgaggctataatcccagcactttgggaggctgagccaggtggatcacctgaagtcgggagttcgagaccagcctgacaaacatgaagaaaccctgtctctactgaaaatacaaaattagctgggcgtggtggcacatgcctgtaatcccagctactcaggaggctgagacaggaggcagaggttgcgatgagccgagattgcgccattgcactccagcctgggcaacaagagtgaaactccatctcaaaaaacaaataaacaaaaaaagagagttgaggctaactcctgggtttttggcccaagcacttgaaaggatggagctgccatcaactgagagaggattccaggtcagagttgggggaacatcaagacttcagttttggaaattgtattagtcagagttctctagagggtcaaaactaatagtacatagtagtatatatatatcctattagatattatatatagatatagtgtgtgtgtgtatatatatatatatctcctattatatattatacatagatataggtatatgggagtttattaagtattaacttccacgatcacaaggccccacagtaggctgtctgcaagcttgaggagaaaggagagccagtctgaatctcaaaactgaagaacttggagtccaatgttgaagggcaggaagcgtccagcacaggagaaagatgtaggctgggaggcgaggccagtctctccttttcacatttttctgcctgctttatattcactggcagctggttagattgtgcccacccaattaagggtgggtctgcctttcccagcccactgactcatatgttaatctcctttggcaacaccttcacagacacacccaggatcaatactttgtgtccttcaatccaatcaagttgaccctcagtattaaccatcacagaaatgttaagtttgagataacttgcaagtgcaggtgcagagtagccacctggacataaaagtctaatgtttgaaagagaatttttggttgaagatataaatttgagagttgttggttctgcacagtggctcatgcttgtaatcccggcactttgggaggcaggcagctcacttgaggtcaggagtttgagaccagcctggccaacatggtgaaaccccgtctctactaaaaatacaaaaaattagccaggcgtggtggcgggtgcctgtaatcccagctactcaggagactgaggcagaagaatcgcttggacttggggggcggaggttgcagtgagctgagatcgtgccactgcactccagcctgggcgacgactgagtgaaactccgtctcaggaaaaaaaaaattgagagttgttaacatataaattgcgttagagctttagactggatgaaattcagggagtaagtgtaaaagaaggccctgcattaatcactggaacaatcaatattaaggttttcagggagaaaagaagataacagtaagcgactgacaaagaggcagccagtgaagtataaggacaactaagggagtgtggtggcctggaagctaggggaacaatgtgtatgcagaagagatgataattgcccctatattagtggatacttaggagcattaacgcagtaataacatagcgtaatactcaactcataggaagtgtgcagtaaatgttagctcataatagtaatggtggaggaggtggtaatagatgtaatgcaagtagtggtatttctgagcattttttgtggtacataccaaagatatttaggagaggtggttctgattctttcagctagttattaaagcatagattctcatcatttttcatgctatgatcctttttggcagtctggtgaactcttctaagaataatgcttccattttctgtgcctaaaataaaatacataggattatacaactatattgaaatatgataatcataatatttaaaaagcaaatgtgttgtacactttttaattagtatattcaatgtcaatatgtaatagtctaacaatttcatcatggtgatgcatatgaccaatatttcaagatatctgcagcaagtctattattaaaaaatatgtaatctctattgttagcaaatcatccatgtggatattctgatggtttggtacctactttaatgatagaaaggactgctaagtttagtcacaggttgtgaaaataaatatgtacccttttcccacatatgttcatagagtcctaaattctatctttggaactccagattaaaacccttgagttacaggtaaaataaatcccatatataggaaattgacataggaaaattcattaatgatgtgtaaattataatacactatgatattatattagtgtatttttcaaaagaagaaaattgttcttggaacaccttaataagaacaggtagataattcaagtaattagcacattgtgccagtaatgttaaaatctctgcttcagttctgagtattaaatccattaattccgtataaagaaaaaatgagatacatgagccccaatgagctgttattcatgcatgaaattagccaaaagatagagaaggcatgagaatatgtttactttttctctacttctggaaaaaaaaaaaaaacttcaacagtgtttttactagcagattaataggccacattccggacagtaggcacaccagaagcttgcctatttcaatacattccactcttttattctaatctccagtgatgaataatacgggcatcacaatataagagaaagattttggaggaagtaaacaatccacttgatccactatcattgtagggaggaaatcaaaatgccataaacaaaaccctacaaagaatttttgctaaagatggaaaatgctcagttcatctaggagagtttctatgttactattaaaggctttgtaaaaaaataaataaatattataccccaaatagttcaaatatttcttttagaatcatgaatgccctttggaaaggattgtgaagtgaattcttttggcctcaaataatttgatttgcaaacttgcaaaagattatttcttttcgttttagctttctgttttgcattgtatgccaaaagggaacatatggaacttctattagcttcttttattttgttttttttttttttctttttctttttgagacagagtcttgctctgtcacccaggctggagtgcggtggcgcgatctctgctcaccacaacctctgtctcccaggttcaagcaattatcttgcctcagcctcccgagtagctgggattacaggcaagtgccaccacgcctagctaatttttgtagttttagtagagacagggtttcgccatgttggcgaaactcctgacctcaggtgatccgcccacctcggcctcccaaagtactgggattacaggcgtgagccaccgcacctggcctagcttgttcttttttttaatttaatgctgtgatgataagctggtaaagactctctttacttttaggtcaacgtaagaatgctttgtcaagcagtaaccttgattttgtggttcctttaaaacagggagtgtggagctggtacatttgtcaattttgcatccttagagagggatggaaagcttccatacaactggtgagtattgttttggaacaagcttctacatagtttaactatgctgtgtgtgctccaaagtcgattttactatcctttggggatagttttgtctgattatccttttgtaatttcggtgatggtagactttcaatggctagatcttcacagaatataatggtttatataagctcagtgcagttctgaagtagggaaagcatcatggtctgctctgtatttacaatactaaacaagggactgaaacagtggtgcacacgcaggagcccatacctgtgctgaaaaagggcttaaatgcaggagcgccgctgaacaagtggtggctaaaggcacgagaagagattccaatgaagcagcttgcgacagatcggcttctccattttattttatattttattttattttattttttattgttttgtattttttgaggagacagaatctccctctttcgtcacccgggctggagtgcaggatgatctcaactcactgcaatctctgcctcctgggctcaagtaatctttccacctcagcctcccgagtagctgggactacaggagcgcaccaccaaatctggctaatttttagatatttgtagagatgaggtctcactatattgcccaggctggtctcgaactcctgggctgaagtgatcctcccacctcggcctcccaaagtgctgggattacaggcctgagcccccatgccaacccagcatctccattttaaactcacatttcagtgcctgaggcaataagagccaccacttctgttaaaaagttgtacagcccagtattcagttctcatgcttacagataaataaatatcaaagccagtgaagtttcataagaaaacatggcttcatttttctttatgcttgagtattaaggacccggaaggaggaagtgttcgaattttaaagagcattgtcaagagattaaattggttgacattatacctgacaatgatagatgaagattaacaatcctatccagttcaatcaatgcccaacaaaagtactaattaagtaaacatttaacatgaagctaacatgtactacttacatggtctagtttgtttcttttgcaagaaactatgcaaagtatatgtaaatgaatatatgtcatattaatcattgttcagttatttctttctgtttactaactccctaaaatggttaatcttaaagaaatacacatgggagactggaaattttacagaatcaatgagggagggagaactttatttaggatataaattttacttccctcagtgtagctgatactcactctagttgaaaatctagttgaaaccagatttcttttaataaggcaatatgttgtgccatttaaaaattttaacatgagtagaattttgctattaaaaaacaacccaactgtgaagaaaaagaaatccatcaacccttgatggtgaaaagttaggaaacgttactaggtttgttcaaatatattagcactctttccaaaattaagaggttgactcactgatacttgtttcatgcctggttcacccttgggaggcccaatgggagatcagtgatgagtggcccatctaggaaccaatccaattatatgtatttaatacttgtgactcatgagagatagatattaactaacttcacagccagtcacaattcatggaatttatgggagaccagtcatgggagagctgaagcaaaaaagaattcacttcaggatctttctataaaatcaagcacattttgcagctcttcacaaagacagttttgccgactctagcattttctagctgactgagaatagatatctcagtgaagatttgtaataactgaagtgacaaggtgacagtatttttccccctaattctcagaataactatagatgcagtcacaggatattttaaaatctatattaatgggtgttctatttgacaagtggtttgaatatctgaaaccaggcatttaaatcaacagtctgaattagaattgaagtgaagctaaactattttgctcctacttagctgaatatcagtgaggtcacagactaagtagttgatgagctacttatcttgaatgaatgatatccttgtatcatccatacctctgttttaagggttatatttataaattttatagtaatttaaaaacaatacagaaagtcacacctagtagtgcagctttattaagaatgtctcttaaaagcttagtcttcaccggaatcagtatatgtaaactgaccatttttattttctcacacaagctgctgtttagctgtcaaatgatgttacagaggtttcttaaaataggcttaagcataggaagaataatatccaagaataagcttcaagataactaatgaggcatataagtgcttcatttaactgaatgcaaaatgtaatcacctggtagcagactaattaacacaaagtaagttgaaagaaatatatctgattacaataaggtcatgtgtgaataaaaactgattttgtcaatattgtagcatttaagcccgcacatttatatttcacagaatggattaatatttaattgtaattaaggtgcttgtcatattaattaatcccaataggtaatttactgatatctattcacagtttatattactaactcttgcaactttttcatctttccatctgttgtctattaatgcacacaggcgtaggagtatatttgctttcttaaccctgctaccctcatgtctttggactgattatcttttggcattttatattaatccttggtaagtgatttttttttactgtttaacacaaactctttaaaagttagctttcaagaagtaaacaaaaaggaaagtttctttttaactattttgtatgttcagtaacatctaaagttattaatcatgtattgaagtgaattaaagcagttaccggtacaaagatattaactataaggttttccgttaaatttttttccgtgatgttgttggcaagcgttttttcccatttagtactagttatttgtttcttcattgagtcaatccattggcctctcatctttgcaaataatgctttccattttccattatcatcttcatccattagagagctccaaatttccaagaaggtagaaatgcattaagatggagaaatcagagtctatacaatcctctgtatctgaggcctccttgtttttataataatgctaactcagtgactattaaacagctgactatacgcaagcctctttgtatgattatctgatttaattttcccccgcaatcctgcagagagtattactagtcccattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatgataacagtaaccttgaattctgagactaaagaattaagaactctttcttttcctgtgctataagataaaaggtagcagtttccaggggaactgacaagaaaatcattgtccttaaatattaatacctagtgtttaggtactaaattatgtacagacagatccataaatgtggacaacttgaaaaggtctcagaagaaaacaataaaaatatctcatagactggaaaaaaaatagcttatggggtggtggtgcgggtatgaaaagcaatctggagcatttatttattcaaaaagacaattgaccaaatgttctccagctcctccaaggacagaataaatacagctggcagaatttaggatttcaagttgcactggaaggaacataaaaaaggatttcctcaaaatagagattgttaattccagaattcatatcttcttttaaaaaaagagactagaggaaagcttttgaaacaaagtagacatgatgtgtaggtaataaagtcagaggaatgtgctagatgctgaggacccattcactgttattctaagttcattgttacagtttttagtatagggcttcagcacagtcaactccgtattttcagtatttgacatcaaatagttttcaggtatgaatagcacacataaattccatttcaaccttcaaaatatacatttacttttaactgaacatctactaatcatcctcaaatagtgtgcctaccattaaaatactaacagcaaatacccataaagtatcccagattgcaaataaaatgaaagaaagatgcatatatcatttccttgcttaattctctgagactttctcattttccacagtgcgtttttaagcttctgtaaggtaggcctgtgcaagtaagcatgtattccttaataggcctcattgatgaacatatgctcaaatttcagcaaccctcacaaggtctgctatttctaataccaatcaaatagcacgaggcccaacttatggggagaaaatacccttcagtaatttttagaagaatcaccttgaaactgtaaatggttgtctccagttgagaagagaaggtaaaacatagagctgcatgctttctgtaacttcagtaaatttcacacgtatcaactagtaaaaacatactggatataaactatgttctcagcccttttgtacaatgccagatacaaaagaagtgaaattcatgctccccgctcgtggaaatacagcttctactcacacaaccactccaattccctgtttgcttcatctaataacttgtggttattttcccctgctttcattggctaaagagtcatttttaatcctcctaatgatgtgtttgtcttcatatttcacctaccctgtgaacaacagctgcaaataacaagagccatctccccagacgcacactgcctaacacactgtccaacttcctttctaaactgtcggtttcttggaaatatatgttcctgttgattttctaaaacccatctgatgccactagtggtttgtgtggaaatcaaaaaactctttctctctctcatagtgttgctcgaatctcttcctggggtggtagcagaatcagtgtggagcaccagtacccagttaggttggtctcaggattgtgttctgcaaggatttctgactttcagaacttaagagtatgtttcctattgaaagaaatcatctaagttgaactagctatatctagattcagtgttaaatctttttttttttttttactgccataatgaccctcatgctgtactcaggtatttatctgcttgttctcaatcctaggcagttggcattttaagcaagaagtggcatttagttgaaaatgctcagctttactcctgatgattgcacattctatttgaagaatgatataatatactaaagtcctttttaaggtttggggatggtttctgcttagctcatcaaagagtaagcagcacttacaaaattggagacttttagagttttgttttgtcttgttttaactattataaatctcatgtccttgctattgctttttcggaatgaattgcagtatggatggctttccaagactgtcataaccatggctaatttatgcagaatgtatcttaactttttgaagtcattaggattttgaaccttacctaatataagtgaaagagaaaaaactaaaagtgcacaatcctctatgcatatatgctgtaggtatgtctgatgggggttatttattgatttggaaaatcttttgcaatgaaaaggcgaaccctacatgtcacacaaaatcgtcactgtaacatgtgcacatacatattggctctttccagaatgtgcttaagttaaaattgctagcaaagccttaatttgcgtgaattttcccctggttttagtctcggaattagcacagcaattgaaaatgtaggaacattttatcagtgttgctgtggagtttcataattcaatcctgtcatgttccacagccttaggatacagaaactccttggaatcagcaagatctaaatagaacaatgaaaattgtatacaaatcatgattacttatgccaataagtatatgataatatgtcatacaaaacatgtagtggaattatacgttatattgaaagttcattcaataatgaatgagattgaaagaaaaaaaatgtgtctctcctccatgaatcaagtttctacgcagctgccgagtagtagcagcttaatatttcagcactgaatttattcagtgttaccctcttacatacatttgttacttcctagtttcttttaaagcctgtttggataggaaagtatttttttgttcactcctgatcacaaaatgtgttggcagcctcctgactttaccagagctgttagtcatctccgctgacattctgctttccgaaagcactgaagtaattggctcttactacaggaagtaaatgtggaactcctaaaactaactaaattaccatcacggggctgaataaaaaacatgatcaataaatattcctttaggttcccaaatgcctataagatacagctatgtccaacatgatagtgttttttgaggggatcagggagaggcaaagtaaaaactggactgatttttccctctaaatctcaagtgtggaagacaaagaggatgagggagaaaaaatagaacaagaaccattgaatggattgttttcacttagaagtgggaagaaattaaaactacctgaaaaccacaaacaccacttgccttcgtggacgtgttcctacatttcttgacctgcattattttctcttcatccacaagtcccatcttttcaatcagaacatcacaagcccaagtctagtattcaattgttaaaggaatcattaggtgaaattcagagggtaacatggcagagattattttgtttcagttcaactgaataagcatttattgaccacccactaggtgtttcattaactatgctcagccctggggggaagctatagtgagtgtagcaaggtgtgtacctgcaactaacaatcacacaatgtgagaaactctccgtttgcaaagtgctgtgaaagcacaaagtactgcttcgtcctgctaaaagctttcaggaagtggagatatccaaacattcataattttaaatataaataaatatttggacacattaaagtactaagattacaactggttatttactatagactgtttattttctgaaaagttgggtgcttctatcaaaattatgtaaagacctctgaaaattacttgcaaaaaagtttgctgtaacatcacttgtacagtcaatcatgtttctgtatttactatttatagacaacaataagaatacaatcacaaagtgcttcaatagatactgttagccttagctaacttaggtaagttatcttacttggttgggtgaaaatcattaccttaattatctcctaaacaaatgtaactaactaaagcatgcattagcatttcctgtgtttgagcttatagactagtaatgatgaagagcaagcaggtaataggtccagttcttcagatagcttaaaaattagttcaagatggaataaaaacaacgccatagtagaattatacaaggtacatgtccacactgacagcacacattcacatccccagagaaaaatgtcagaaaatgttattttagtctttaattaagaaaacaacattccaccgtctctttattagttctccatttattcccccattcttccttcctgcctgtagaaattggagtgttcaggtggtagatagatacttctatatatttacaaactgctttagcaacttaatcaacagcagttagaaatttcatttctagaactcagtttttggcaaatgggaagtataaagtgcagatatgttcatgcaatctagtagagttttaaaaaatgaatctgaaattattattatcttctcatgtaaggaaaagtaaacaaacctgatatgtgtttaatgaaaattaaataaaactgaggtacctgatgtaattatttaaagctgttcaagtttaattattatgttaatcaattcttctgcccagataaatttgtcttttcttttttaattatcaggagtaaaaatggtttaaagaagaggaaactgacaaagtaagtttttcttactatgtcatttaaaaggatgtttgttataataatcttaacgttccaattaaagattgcttgtcttcaaagagaagggacgcttaagaaagaggcaaatgcatattacaatagctaagcacaataatgtactggttgtttatgcctgagtggcagtggccactagaaaagtgtatcacagaaatcacatcagaaataaggacaatgtttatcatatcaaatctgagagagtggatcgttagcaatttttaaagtcttggaggaggaagtatggtattctaaatacagtatatgaaaatctaatatttaactacatcaaagggtttcaaaaatccttttagtattttgaaattctgtgtttattgcaggaaaaggcttttactctatttgatgttataatagatactttgataatgctttctcaagaaacctgtataataaatagaaaagataattaatctagcctgtggttttccttatctattaaaccattaaatgagaagaattactattgtggtaagtgaaaattaacccccagttgatttcaaaagcctattagattatcacctccatgccttttcttagttataattctacatatgaaaagtggaactttcctttatatagagtttgttcttgatacctgcctggatagaacattggtgaattagtacaagaaggaaattagggggtccagccaggtctgtggcatctatgcttatggaaagaaatcatgagtaatccatgacataatccaaaagaaaagttgatgtaaaaatgtttctagttagtcttgagtggcatataattttatggcatatatgaaaacagaataattttttctaagtcaatttcattttttatttttattttttaatttattttattttattttttggagatgaagtctcgctctgtcacccaggctggagtgcagtggcacaatcttggctcactgcaacctctgtctcccaggttcaagtgattctcctgcctcagcctccccagtagctaatactacaggcacacgccaccatgcctggctgatttttgtatttttagtagagacgaaatttcactatattggtcagactggtctcgaactcctgacctcatgtgatccaccctcctcagcctcccaaagtgctgggattacaggcatgaggcaccgtgtccagcctctaagtcaatttcaaaccagcatacattccactggcttataccaactgatgtaggagagataagaccagactgaatagaggagagggtaccatcacctgggagggatgatttcacagaaacagaaagactttgttaccaaaaactgttggttgggttggcaggtgagctaaagaggcagagactagagcatttagaagatagcgtccttggacgaaaaggagagactgtcaaggcttgctcctcccatgactcaggcaaagaaaagaaggagaagcaagacccagacaaaagatagggtagagattaggagtggtagaacatacccacaagcaaaaaaaaactcacatcaattcggcttccaccttcccccctctcattttcctttgactcctctctccttctctagaagacatttcttgaaaggctttcctctcacctttttatttgccttctctaccatttctctttccctccaaatgccccaccactaccgtatccccctggttcccattttctatctccacttgtcttcattccatccttcctttccatcacctcctctttttctttttcctctgtagatatttgtccttttggtctctactcccttccagctttctttttcttctccttgtcattctccttctcccttatgtccattcttctgtttgctattccttcctctctctctcttttccctctgcttcttgcttttacttcttttaacccattaatactttgtctggtttgccttctgtatacatgtgcccattttcctagtaacaagatgaaagctagagttgttaaatccaactttaaggtcgatacactgcccaaagacaccagccagagagtgcagttctaagggggttcattccaggagaggagtcccaactttagcccattcttttggaaggataacaagtttgaagtgggaaaagctttgaaccaggacttactctccctggattccagtgagaattctactgcttagtagacatgtgatgttgggctactcacttaactctcttagccgtggctctctcagctggagcatggagctaatgttgtctattcctacctcagggatcaattaagcaagataatgcatgtgactatttatgaagtgtagcgtgttttataaatgagttattgttattaagtaaaaacatttcagtttaaaggtattctctggaagatataacgccctctaaaatttactaaaatgttaacataaatgaattaatcagattagctaatcaacaactttaaatgagcattattaaatactatgtattttctaattggacataagaccacagttaggccaggtgcagtggctcacacctgtaatcccagcactttgggaggctgaggcaggtggatcacttgaggtcaggatttcaagaccaccttggacaacatggtgaaaccaaatctctactaaaaatacaaaaattagccaggtgtggtggcacctgcctgtagtcccagctacttgggaggctgaggcaggagaatcgcttgaacctaggaggcagaagttgcagtgagccgaaatagtgccactacactccagtctgggtgacagagtgagactctgtctcaaaacaaaacaaaacaaaacaaaacaaaacaaaaaagaccacagttagatgatataagctgagtaacacaccacaagaccaagggaagggtcaactataaagaccctgccaaagtggaaaggcttgagttagatgacagaatgtggaattctgcagaagcagagagctactttagagagcaaattggtttaggtaggctctagaggagataagcagctacagaaaactacaggagataaaacttgattcttattctcaaaaaaaagtgagaacttctgctgcggatgcagaaacatagctcagatgtgttacttgattgaacctctgagccatttccatacttttatagatatgcaagcctctaaagataactcactccagtgagaccctgggagctttctggacaaaagtttcatcccactgatcctgcctctgctttggggagactgtagctagcagcacaattccttatacttgtaaagctgttgaaacttacaaagttctttatgtactgtatgtcaaccctgtagctgtaactactgtattttatggatgagaacattgactctgaagagttaggcgattctctaggataacacagtcaataaagcaaaaccataactcaaacaggtctttggaatccattcctttgttattttccatatgccagagttttttagaagcaacacagatgggggtgtgtgtatacgagtatgcatatatatactactgtactgctacagtaagagccaagtggaaatctagagatttctcctatcaaggaagctggatatatatgcccttcttttcaattgcaatatattaaggattggtaacttgaaccaaaaaaaaaaggtgagtgctaaccttagagaagtaaaacttctattttctccaagaagattaagaagtatgatattaaacaatatataatacctatcaacaagaattttaaaatgtatgtatatttctttgtgtttggcaaagcccggttcaactggatgactttgatgcctatattaaggatatggccaaagactctgactataaattttctcttcagtttgaggtgagttggttaaggcattttctaccttctgtaatggaaagggcctgggaattggggggtttgtgttgcggtcatgtccctgctcactggcagtgcgtaacaaaaagggtattggcctggggattgctgatctgctggtttagagcaagggttgtcaatccttgcttagtaggcaaggcctcaggtggcacaaatgagatgaggggaagaagagaataggtgcaggtactgaggtgagcaaacatgggtatagtagaagccatcattgaaaaccagggaaatcgagagtacaagaagaaaaatgcaagctgaggcatgaagcctgagacagaatttccctttcaggggatttgtagtgtttctcatgcttcttaggccacagtagtggcggatagtggataaaactgaccccctttgtgtcctgggcacataacatcctggagtagggcttttcaagctataggactcctggcattctacttaataacttttgtgcagttttattttctttccttggacaaattggggagataaagttacacatgatttgtgttaagaaaaaaattgacaacatctctttttttccgaaggacacatatttctttggatctaaaaccatatgtcagaagagatggaagtgagtgagtctaatatctcagcagtgtgggggaagataattagttctcactttttctttctacatattttatagctcataacacagtctaaatggccccccatccttcaggtttctatagcatggcttgagtggtcagtgattcagggaaaaggggaagataaagtgatttttctaaattctgtagttttttttttttataaagccttttaagtgctcttttctattaaggtagctgctttttcttcagtttttaaaatcatttctcctttccacttctcagccaaggacagctttagtctgcaaaaagcatcagtggtcctggtgtggagacactaatggggaatttgaggatgagaagaatcttatacattaccaaatacaaagaccgctaactaccacctgtgtcctgaaaaattccacacagagcctgctcacttatccattgtatccaggtgcataggatattatagatgctacaccaaatgctatactcaaagaaattcaatttgaattggaaatgaatgaggaggatggcatttcagaaagtatatcaaggaaaggaggactttttttctaagcaaacatgaggcaaaactctgaaaaaataaatagctagatgattctaacgatgatagaaattatggtatagctacacttttaccttattaaagccacattttcttaattccttcaagatggcatgcccttggtggcacagctggatcataacctctgctggcaactcacagtttatgtcttgaaacccaagcataactattactgtttctgaattgcatgaaaaaaaattcaacaagtcattttccagtaaacatattcttttagttgtgagtgacaaaaacatagctcaaacttgtttaaactaaaggaaagggggtttattcaaaggatactaaggtatctcatacaatcaaagaaaaggttgagtagctagactacgtgcagggaagcagcacagtttcagggatgactggagccaggggcccctctatttctcatttctgcttctctctctgttttggtttcactttgtttcactgaacaaagagaaacaaagagaaacgcagccagagagggcagatgtttgtgttcagtgaaacaacaaacaacctctttttctgtcacttttgttttgttttgttttgttttttgagacagtctcactctgttgcccaggctagagagcagtggcgcgatcttggctcactgcaacctccgcctcccaggttcaagtgattctcctgcctcagcctcctgagtagctgggactacagttgcccaccaccatgcccggctaacttttgtatttttagtagagacagggtttcaccatattgactagtctggtctcgaactccttaccttgtgatctagctgcctcagcctcccaaagtgctgggattacagccgtgagccacgatgcccagcccaacctctttttcatagtgaaaagcagccaacaacaacccttgagcaccacagccttttgtttccatggtttccaaagggaattactgtctgtctttcttgtttgtagtttgaaaattaacaggggaggattttgatggacgagcctgtgtcatggtgcccattcaaaccaatcacagccagagagggcagatgcacagaatctctaaatggaaccatgtgggctcaagtagcaaaacctaagaagggcattatctcccaataaagagagggtattgggagaaccaaaccataagcgattagcatgctatctttagatatcacaaaaatatgaaaagcagaattataaattttatgtgctaaatgttcaatttataatatgctgagggcttttattcattcaatggataaatgaatacatttagcctgacttcataggatttataagaaatgtgctaaactaggaatctaaaatcctgaatcctcactacagtgttgctactaattaacattctaaaaaatatgtttttttcttaaccaattgatatataatgagtttggggtgggcttgggggcggatgatgtattagctacagattttttatgtagtgaacatgctcatgtataagtttcaatttatccaactactttgttggaataattcttatggattgaaactgcccaggcaaagtatatacaaaatctgcattttgagtaaatttcccataagtggagtaagttttcccagtgttcctaaaactatacaaacagtatagtatagtatatacttcctaaaactatacaaagagtagatatcaacatttgtaatcattgataatgtaatattacaaagaaattgctttctcatctgttaacgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgtataaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtgggacattcccgcacaatagagaattgtcctaggccgaaagtgtttgattgagaaatatgggttaaatatgggatgaggctacaatcaagctttataacccatgtgtattagtcatgggttctccagagaaaccaatgggatgtttatatagaacaaatatgatgtatatatagagagatctattttaaggtattggcttttgaggttatggaggctgacaagtctgaaacctgaagggcaggctggcaggctggagatccaaggaaaagttgagtttgcagttttgagtttgaaggcaatggggaggcagaattcctccctccttgtaggacctgtctcttctcatcaggccttcaaactgactggatgaggcccagccacattacgtagcataatcagccttcctcaaactctacttacgtaaatgttaatcacatatgagaaaaacaccttcacagcagcagactggtgtttggccaagcaactggacactatagcctagtcaagttgacgtctaaaattaaccattacaccacgattttaaagtctttaatattgttatttattatgatgctctcttcatacatttctattcttagaacattattggtcatatatgtaattaattgggtggtaagtcctgacattatttacatattctggtaggaaaatacaacttactctctagggctctgttttaagtcacaggcttagactgtatgttttggactaacatttgctcaagcagtggcccactggtccaatttacttccttcttcatttgacagacttcagatattaccagtcctcagtcccattctgccccctacatcctcagggtcagcgtcagggtttcctcatcaattttcatagaagtagtgtgctcccatgcctgatttcaggatgtatgctggacctttcacatggcagccctcacatttttttgaaatacattgatagttaattgagacttaaggaaaaaaatgttcctaactctaatgagaattcaagagggtatgagatggccaaatcaccttggtctagataattccagcagctgaacttgtacttgttctgtttatattaatgcctagtatttgtattcattttgatactgacattgaaatatcacattcacattgagaaatcacatcatttataagcattttgcaaattgaaactaatgtctggatttatagatactaccaatacagccataagtcatacatgaagctatatgagttactaatttgtgtttactgaataaatttcttttttactctgaatctgattttaaatctgctagaaagattgattatccttctgataaaaatatacaccgttcctttaaaagtcttgggacccagggattaaaataggttcctcattttttacatttcacatgggaaagattttgaagaaccagactttatagctgaaatgtgagagcccagaagacatatcacatattgctcattctgctattaatgtctgtgcttagtgtttgatcaggatactagtaaaggccctcaccatctctgttcagacatgtggctgcaaagatcaaaacaaaactacagaactggccatgcagttcacaagaggtgacctttgatttctggtagtagcttttacttgctatagatggaacctcttctgtcaacaccactggcactttctttctcctcactttttccaccccttatggacacgtaatctagtaatcttagtattgtttgaataaaccccctttcctttagtctaaactagtttgagctatgtttttgtcactcacaactaaaataatgtgtttactggaaaatgacttgttggattttttgtaatcatgcgattcagaaacagtaatagttatgcttgggtttcaagacataatgtccaccctatcccaaagcaaacaccgaaagcaaactctcacctgctgacattgttacaaaccctaagaccagaatgcagattgtgctctcctcagaagatgatattgcaggttatgggctgaatatctgtggccccccaaaattcctatgtttaatccctaacccccaatgcaatggtatttggagatggagcccttgctaagtaattaggattagataagctcatgagggtgaggacttcgtggtaggattgttgcaggacttttccttagttcagctaaagatgaggtccttgtccatcccacagccatgaaaatttaggttcacaggcaatttggagggtgagtaaaacagggttttattcggtgaaaaggaagaaaagggagaaacagggactctcactaggctggagtccctgctagagcacttcccactggcagcttgaatctcaggttccacacaggaagaggaaaggccaggttccttccccactgcaaacatggtgaacttcccgaggctccacctctgtgagcaggctagttggaatttctccaaggaccccctcccacctgactgtctcaggatcagccaagataagatgcctaagaatgaaatctaccttgttgccatcttgatcttggacttcccagcctccagaactgtgagacataaatctctactgtttaaactatcactctatggtgttttgttatggcagcccaagccaactaatgtaatgtatatgcttgtgctttgctttccaagacctgtatgcttcaaacacagccaacaaaacgtagcctgctactgggtttgggtgaccgtattagttcctatggctgccataacaaattaccacaattgtcgtggtttaaaacaacagaaacttattctcacaattgcagagccagaattccaaaatcaaggtgtcagcagggccacactccccctgaagactctagggaagaatttttctttgcctctttcagcttctgttggccacagcaattccttggcttgcagctgcataactctgatctgtctccatctttacatgccttttcctcttctccaggatgatctcatctcatgttctctaacttaattacaactgcaaagacactttctccaaattagatcacactcacaggttctgggggttaggaggtagacgtatctttttggggatcaccattcaacccactacagatgactgtatagcctagaagaaaagggtgataaattatatttagaaacaaaactgacaaaagaaaattcagaaatgatttatgtgggtttcaggtccatcactccatagtttgtcttcataaagatttaagccagtggaatttccatatggttggaaagaaaataacttcaaagctgctgaactggaaacttaatattttattttccacttagtgacaggctaaattacaaaggcttcaaagcatactgtgtttacatgcagttcccactttgctgcaattcaactttggcaacttccacttacagtgttcagccaattaaacctctcttatcaacttagagtatttacagcaggaaggcaacacacaattaaagttctgtcagttagtcagcttccacaattaaagttctgtcagttagtcagcttccacatgtgctcaaacgctcagcctcaatctgtttccaccattccttttgtatctgaggccttttcccatggcttatcagtctgtccccaaagcaagagaattgggggaagagttgttggtctgctggcataaatggcagaggaggaagaaattatggagccaggcaaagcaaaacaaagaatcatcacaaaagtattttacaatgatcatcaatagtgctgtattagtatttgttgagttaaattattccatttgataatcactataaaaaaggaaggtgtggagaaattactagccttatcttacaggtaattaaagcaaagtttaaaagagtttaactacccttccaagaacatacagtttataagtggcatgtcagaatatgtgagatattttgaaaaaatatctatgcaggcattttctaaaggaggtagatttctgaaataatttaagcaatggaagcatcatttaaataaacttataactaccaaaaggaactaacctaaacatcacactgatttagttgaaatttactaaaaataagttgcttcttacaagaaaaatagagtcaacctttgaataccctttaaaatggaacactcagttataaaataacaatgggaagcatctgcctaaatatatttggcaagtaagtgcctgagatggaaaaaaccaattttgtgagttgaaaatcaaatgtaacatagtttgtatataaaactgacatcaacttagtccaaagaacttcagatattgtcatcttgaaaagccaaaagagatgaggaatcaaaggaagagagaaatctgggcaatttttgttggttcatccatgttggctacagtcaggcaacccaatgccattaagcgcaaggtaatttgccaccaaggatcttctagttaaaagcatcagaagacccaataacttgattaataaagcatgtgctttgcaaagagcacttgaataaagacacaaagggcatgaaacagatatccctattcaatcctagaacgtggtcaagtggctccaattctcttcaacagtgttaaaagaccctccgaaattcttctcctagggaagtattcctccagctttgattccttgaagtaataattgggaggaattatgaagagtaaaacttgtgctcaatattaacattctataaatgtaaataaaatttataacaagtgatttttgcctcgcttagtagtcttatagaaagatgcacactatgtgggtaatcccacttatacacagttatgtacactgtttactaacattcctctaacatttgtataggaatataactagatccactgcattggttgcacattgtacaactccagtgaacaccgttcatatagaccacaatgtgaatgatgcctccaagaaatacaggtggcctgaccgtaatccccgtttcctgtaagacacatggcatagcaacttagaaatccccctttccccataacataccctttttgaagtgtgacagttatttatataaaaatttcccatcagttcaccttctgaaatgaggtttataagagtaccaatatacgcaggcagacatttggatgttcttattctcactgaaggattttccccaacaactacagatccatctttatgtttgaggtttcattaccagatatttagtgactgttaatcccatactttgtaacatggagattgttccctactcattcctcactattttttactactttctctaaggctcattgcctacaagaaaaaaaaagcctagatttcttcagagaataggaaatatttatacaaattgcataaacttaagttactctattcctccaaaaatctgaaatgcatttttattttcaaatatttcataccctgagtgttatacatatagttcttacttctccaaatgaccactaagttatccaaggtatttatgtgttgtattagatagctattaccacaataatgctgtataagaaacaacctcaaaatctctacaataacatttacttttctcactcatgggtctgtggaacagctggggcagttctgcttcaggctgtgggtcagagtcaggtctgccctatgtgcctcctcattctcggactagcagcttccctgggcatgtctttttcagggtagatggcaggcacacaagagggcaaaccaaacaagcaagtgcattgaaagcttctgagtggacttgatttctatctaagatcattggccaaagcaagttgatgatagtggggtggagtaccttccacctctaaagggagctactgcaatgtcatatagcaaagggcttgtgagcaataaaccagtgtgaacaataatccaattcacaccacgtatggaactctcaaatccattctctgtcctttacaggagttgaaattgattggactggatatcccacactttgctgcagatcttccactgaatcgatgtaaaaaccgttacacaaacatcctaccatgtaagatcgtcaattgtgccaataacactcatgtcttaagggttgaaggactgtcattgcagattaatcaatttcaccaatctctggccatacccacttgtggtccggatctcaaggccacgtctgagattgcattgatctcactctcctttgatgtctttagatcttagcatatggaggaagatttaattattgtgcttttaaatgaattgcatctgaacaaaaagactgatcatttggccctttagagattaaagagccacagtcaaattggggattggatcatttgtactctcataaaatattttcagccaattcattggtaatggaaagaggcaaatgggaaggcgatgcagtatattaaaatgccttctctaacttctgacaagttatatagttgcttagcattttgtaataaaaagcagcattcaaggaaaaaaaggtaatataaagcacttacaaaacaattaaaatacattccagtttagatttcacttttctctctgctacacgctgtggagctaggcatgaatggaaaagtgagaagagaaaggctgaaaaagctctagaaagagaagtctcttcttgatatggtttcttgatgaaattagatatattatcataataacacttcacatctgtacacagttcagaaattacttctttaatttaatgtccacctacaaaagaaacccatgcatcttctgttctctaggtctccttaaagtagtgaactctctggatatctctaggtgaaatgaaaatcgtgtgcttaggctatatactatagctgtccaatcaatctcacagatattgtagttcctgaaatactctgaacaacacctaaacaatcctggaaacaattctttcaaggacaggagagctggtagtgaaaaaaaaatagtggttggaagatattcacttatttatttaaacaacaaaccaaagttgaagaatagctaaaatatcaggctaaaaattattatctgcctactctgtcactgactgatttaacttaatattggatagaaagggccaaaataatttttccttccatcttgaattttaatatttttttctccttattctctacagatgacttcagccgtgtgagattagtctccatgaatgaagaggaaggtgcagactacatcaatgccaactatattcctgtaagtagaaaaaaaaaatcaggcatcccaaagctaaccagccagagaaagactagcagggctataaggatgtgtcaaacagttcaaaagagagcctttcccaacccagcaattgaattctaaaaagtttgcattactccgtttcataataaagaatagaaagaaaaagtccatagattactaatgtttctatttctttataaaggtccagtgaaagggaaagtagaaaggttaaagatcacctctcttatgtttaaatttcacattcagcaaccaaattcaaagggttccaccctagcacctgcacttttaaaatataaagacagttattattgtcataaaaaggtgtggatgtgatttttacagccttctggataacaatgcttacaatcacacagactaattatggtcagttattctgatagcctctttgattaaaacaggagaaaacattacataggtgtgtgatcctttgccaattttatcaccagtaagttttcagtttttttcccataggcgtgaagcagcatttggtgttgacagtgtctggttaggtgataattttgtcacttatctttcagggatacaactcaccccaggagtatattgccacccaggggccactgcctgaaaccagaaatgacttctggaagatggtcctgcaacaaaagtctcagattattgtcatgctcactcagtgtaatgagaaaaggagggtacgtacttactgaaactgctcccacttagcagcaaaacctgccctagccactgccgttgatgaaatgcttgctgttttcaaagtcaaataaaacatagagacaaatcgctaaatttaaaacattgtattcgggaagcaagaattagaatttgggggtaaacacacagacccggtggtctttgcaatgtctaaaggaaaaaagagaaggttggaagtcttctaaaaaggagaaatattgcatattgttttgcaggaaagttcattagcactagtaaagttttggggagctggcaagctctgattggtgaatgcatggtggtgggtaaaactagtctcagagtcccaacaggctgtttcagttgctgttagataccactggtttcaagttactaaaggcagtttcagcaaccggggcttacagagaattacattcctggaacaatgttatgcgttctgagtgctttctttttttttttttttttttttgagacggagtctcgttctgttgcccaggctggggtgcagtggcacgatctcagctcactgcaaacctctgcctcccaggttcaagcgattctcctgcctcagcctcccgagtagctggggcattctgagtgctttgtcccctgacccctcaactctgttttagttagatatgataagaatgacccaagtcatgtgataagaattcacactacgtagcagaaatggtttgctttatgtttcatcttcaccacggtcctatctaattctttagaggcgaatacctttgttttccctaagtgagcacacttaattcctttcctagcctgtttgttttaaaaaattgttttgtccttgctccaggtgaaatgtgaccattactggccattcacggaagaacctatagcctatggagacatcactgtggagatgatttcagaggaagagcaggacgactgggcctgtagacacttccggatcaactatgtaagtcaccaggcagagagcaggtgctgtccctatgctgacacctgctgagaccagtttggtcggggagaccctaacccagcggcgctagaggaattacagacacacacacaaaaatatcgagtgtggagtgggaaatcaggggtctcacagctttaagagctgagagcctcgaacagagatttacccacatatttattgacagcaagccagtgataagcattgtttctatagattatagattaactaaaagtattccttatgggaaataaagggatgggtctggctagttatctgcagcatgaacgtgtccttaaggcataggttgctcatgctattgtttgtggtttaagaatgccttaagcggttttccgccctgggagggccaggtgttccttgccctcattccggtaaaccgacaaccttcagcatgggcatcaaggccatcacgagcatgtcacagggctgcagagattttgtttatggccagttttggggccagtttatggccagatttgggggcctgttcccaacagacacctacaccaccaccaccagggaagtgctgggagaccaacccaatgagcactttgagctttgcattgctgcttccttcaagaggaaaaatccattctcagtgtcattgtttcccatttcatcagtgatggtgtggatgatatggttggtctggagaggctgagaagacgcagtaaaaagtctgcactagttcatctcgaattagctcaagatcatagaagacactattaatcattgtttatgaggcatcattgaggacagaagtgttctcattacttatattaatcatatatgagtataattggggtatataaggcacacttatgttttaaattaaataattaaaccctgatttagtagtttgggttttgttttgttttttttcttgttttgttctggtttggttttcattatttgtaaggtacttctaggtcttattatcataattccctatctctcttgaagggctattgatttctgatggataacacatccaaaaaaaatgtctgtttttctcacaaggcctgacacctttctgctgacaagtctctgagcaaacgctgaatatttctgtgacaggcttaggtgttaacatcaattgaagtcatgccattgacctcagcctatagaatatacagtttttactattaatagtcttctccacttgaacatgctgtctatgaagacaaaattgaataggaaagttctcactgagatgttcttccctgcttagaaacaatcctttctaatagttaaggaaatagcaaactgtagcctgtggaccaaatttacccactgccttttggataaagcccatgagctaagaatggtttttacattttttaatggttgaaaaaagacaactgagtatggtggttcatgcctgtaatcccagcactttgagaggctgaggcgagcagatcacttaagcccaggatttcaagattgcctgagcaacacagggagatcccatctgactaaaaattcaaaaattagctggtgtagtggtacacacctgtagtcccagctactcaagaggctgaggtgggggaatcacttgagcccagtaggtggaggttgcagtgagccaagattgtgccactacacttcagcctgggcaacaagagcaagactctatctccacacacacacacacacaaaaaaaaaatcaacaagaaaaatagtattttatgtgaaatgctatatgtaaattatgtgaaattcaaatttcaatgtccatatataacattttattagaacacagcctgcattgttgacgaattgtctatgactgcttttgtgctacatcaagcttgagtagctgcaaccaaaactatatgatctgcaaaaactaaaatatttactaactgtctctttgcagaaaatgtttgctgacccttaaaataggcaatggaaacaaagattgcccgtatcaatacaacgttagaacttgatactacctactgattgatctctacaggagataaatcacttcttagccattgttaattgccacttgttaactggcagttaacaatgtcttttatgaccaggagaattcaggcaaatccccgtatgactctaacaggctgtgtttcgtgttgtttcggtcatttaaaattcacattgcttccttgttaagcacgtttttactcaaatgcagagtttcagcttaagtgtcaccccctttgtggcgtcttctctgggcttggacaccgttagcccattccttctctggggcagagtcttaagtaagctgctttatcacagcacaccatagatagttacaattctcgcttcttgtgtctgcctccccagtatactgtgagtttcagaagcaagtgctgtatccctgtggaatgaataaatcagtgaatgaatgagttatttcaaaaataataaggcacttgtaaagcatcaatagactttccgtcagagaaaatatttgtcaatccaaatgccatttgaactctgttttttgttcttagatatttcaattgaaaagccagtgcaaactgataaccaaatacagtacaaatctgtccctaggtttgcacgtagtagaaaaaatttcagagcacaaaatagggtctgttccattgcctattctgttgacaaagaagagtcacatagattattgctgggtcagtactatgcttcttgtccttggtcttaagtgatgacctatctttcaatgacaatcatgtgaaggacttgaaaaataggaataaaacattgaacagtagtgtttgtttgtaaggaatttacttgttacaagcgtctggtaccagagtgcccccttttggccataagcataatgaatctaaatgttaagctacaatgaaggctaagttgcccaaagaacattgtgctatgctaattaatatatttttcaatttgtttcattttttgtttatacccttctttatccattccatattgatatgtggaaactttccaattataaaaagataaaattacataaataaggaactcaaggtaagagaaatttaggaatagctaagtaagataaaaccagaagagttttctcctttaacaagaaaggagagaaatgaccataacacacaacttgtcactttctactacttgaaatttggcatcaactgagtgagagctggagactaaagatcatcaaaaacgtgtttgttgccagggactttgtgccctgctattcagctcacagggctgaccccagttccaggacccctgccgtgtagctgcggagaaactaactacaatttaatgatttcctgattttaaatcaccttgcactttttaactgaatacattttcacttcaaccgtactggaatatatatattggctacaatgtacacatgttatacaaattatgatcagcatttaaacagggcaagcattttcctgaactttcctggcaaccaaagttatctggtggctgagtattcttaaatcctcatgatgttgaataagtaaattattctgcacaattctttatgcccaagatagtttctcaacatacttcctgaagagagcagtgagggtagccagcgtctttgtagacttcatgttctgtgtgtctaagccagagcccttgaacatagtaggggaggcactgcatgctgctggggatatattaggtgccaagggtacaatgggtgtaggggaggtgataacttatgtatatttaaacaaatcttacatatttatttatacattttatttatgaattgtctttatacgtttattttctgcccaagaccactgactctttgaaattcatttctctttcaatacctgaacttaaattttagctcaaaactgacagcgaggccaagcttccctccttcccagttatgatatagtattccagcctctgagtgaattctaggctcttcacaagtttgaggactgagggatgaatcagacctttatgaagcctgggtttgggatatttctgatggttgataacaagtggagaatatgtaactcttacaagttagttgggactaaaaagagttgatctggaaagatatacattctagttaatatgtactcagttcagagagaacaacaatatatttgatgtatgggttaataggaataggaaaatatacaagttatactcacttactggggactcccagaatcaaccatacaattgcacggagctggatgacggtgagtgatggtaatgaggtactagtaagtagtaatatcacacacatgattacacttaattcacacaacaactcttgttataagtatcattaggccatttttagatatgagaaaactgaagctcagtgagtcaagtcctctagtatcaaagcccaagacaaggattctcatataagtgattttgtgaaagtgcattcttagggaaagcccataagggagcaagggaagcagattgacagagaagaagccctacagagcattcagctgaaaatctcacctgtgctggatcccacagagagtgctgggggcatgaacagcaccatggtactgtctcactctgaaaaaggctggatttttgtaccccacaattagtcagtcattagctgtgggctgccctcagcaggagaacgcaacctcttaggcattttctatcgaggcagctctgtgcagtggaaggcaactatcaagagataggtactgctgtgctgttagcagcaactgggaaaagtgtgtcccaggctggcaaagtgtatctaaagggcaccaacagcactttctacagtgtttaattcattagccaaaactgatgcagcttctaaatgacagagccaggatgcaaaccctaatctgcttaagtgttgtccacaggtacagattagcctacttatcctactatttgaagctttatacaattagcgtggttttttttttcaatacctattttatgccagatatggtgctcaaagctggaaaggaaagtgtactgaccaggagtggaacgtggctctacctttttgcatgcttaactagcagagtcctgggtcatcctaacagtgaactgaaaaattaatgcttgtttttggcttttttctctaaaggctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcaggtaacctcatcaactgcattttctattaaatattaggagttggttttgtaaggggaacagctcaccattccataagcccttatcaggtttagttgaaaattaaataaactctgatgttttttaaactatgattaattgatgtctcactatatacaatgtttattctggctttcctgtatctataccctataaaatagatgttattattccaatttttaaatgaaaaaaatagagaagggtagagatgttaagggattcacacaagttcatgcaactagaacatggaggagttagtattcaaatccaggaatgccaatctgcaaagatcatgcccttaatatgtgatattatcctactccatcaaggattctgggtagttacaacatggacaaatacaaggtcaaattatagaaagctgatcacagcttgacataatataaataggcataaaaactagaaaaggaaaagaaaaatgaaaatattcagcttaggaagataaacatatttgctatgattcctcttcgggattgtctcttaaattgtcagacagtagaatgaaaaaggatataggatataaaaaaatcaaggtccacactaattcccaacaggaaaagttatcattaaatttaatttgttcttcctactgtatgaacagagctccatcaaaatctatctctgtgatacaatattgctgtaaaatccttatgcaacctcaaaagaacaggggacataaacgtgctccaatggcaagtgagaggtggcagtgggatgaagatgtgaagggaagcattggcagccatgccaacctaagcaaataaatctacaatcccagacctactgccttggcccttgtgaattagaatgactagaatgaagaagtatatgtgtgcattcatgtgtgtttgtgtggagtgtgtgtctccctggaaaggaaaatgcttcataagctactaagtttctgtttagggcagatattgttgctgtcaatccactgtaggcattcacaggttaaaagatgtgctttagcaggtaagattatctgttctcaaaatggttcttttcaagaacagaaaatgaagctcttcaactctggggtcaaactcacagattcctttcatggaagatagtaagtgcagttctggatatgactttacaggtgctcacccaatggcagatcattttatctgagaaatcctgggagggaagagttgtctagtagaaaaagcaacccttaaactcaaggtttatagagtgggatttttctagcaaactttccatataaatttgcttgaactttctcttttcccatcatttcacagtgattcaaagctaagagccatttgactctttattgaggattagagggaaaaaagggctgacttcaacacatagaactagggactgtgatgggcagttggtcagcgcatgtcagtccacttccatctgtgccccgagcattgggattgggggactggctgagactgggtccaaatttttcatttgattttaaggcaactatctcaaaggtccctgtgagatggaagcaggcccaggacccactaaaatggcaggcatgctgtaaggcaggtctggggtggtgaactgaacttagggttgaagatacacaaatctctgtggtcccagacctagagttagggtatggacatctcaactggagttttgagctgatctgagggcttaactctgatgctgttcaaaagacagggtattgtttatgtgtatcagctctctgaattcagaaatcagttcccgagagtactcaacatggaatccctacttttctgcagaagcagagaccccgataaagggtgtggccaatgcagtgcaaatgtctctcaggaacgtagccatgatagtcagaaatgtgacattagaaggaacaccaaccacaactccatacttaaaaatcagttaagtggaaaatattgtcaggagcttagtctgcgtttttccacaagggtactatttgtagttttttagaaatcatcagttttatttcaacagtaaagtagcaccatctgggctggccgaggtggctcacgcctctaatcccagcacttcaggaggccgaggtgggaagatcacctgaggtcagaagttcaagaccagcctggccaacatggcaaaactccatctctactaaaaatacaaaaattagccaggaatggtggcacatacctgtaatcccagctactcaggagggtgaggcaggagaatcacttgaagccgagaggcagaggttgcagtgagccgagatcatgccattgcactccagcctgggcaacagagcaagactccatctcaaagaaaaaaaaaaaagaggggggagaaaaaaaagaagcaccatctgaataatatgccatcggaacattcttttgcagtgctggcgtgggacggacaggaacattcattgccctggacaggctcttgcagcacattcgggatcatgagtttgttgacatcttagggctggtgtcagaaatgaggtcataccggatgtctatggtacagacagaggtaggaacataatctatatgtatttttaaattttccctggactgaaaaacttaccattattcaatgatatgcttcaaaacaattctctcaaacttctttgtatctttctttcccattttcttattgtatatgttcaaactgctttgaggcataaaagaaatagacactagcctccagaaatccattcgacatatagtgattatacttttattggcatcataattcagagtgcatgggtagattcgtaagagtaaaacctctttgaacagactcagagtcaattgcagataacagccatcctgggtaaatgccaccaaatagagactgttgaactggtgaaatttgatttatatttgaaatgttggatttgattcaatacatttgtcattagtttatcctccgtgtgactctatcccaattcacttttgatgatgattagaagttggatttgagctttctgtcccttttatgattttaaagattcccagtccccaacctaccagcattgccagttcccttcatctcaatgatgaagatttattattttaacaacatggaagcatcccctgaaatatccaacagtgttacgtgctccgtcttcctcctcttctcccgagtcctccctccctgaaagcctgaggatgcacttagtctggagcgacaacccaaggcaacgccggcagacagcaccgcctgcctcagagcagccgtgggtgtgtacccttgtgggcgcaaaaacccaagtacaacagcttgttcataagcctcatcacccagccatactcgcgacttcttagcttcggtcttacaataatcctttttctcaaagagtatgtgtgggtggagcgcttgggtagaacacaacctggcccgacctgtaatcagggtatttttaaaatgctttggtcttcctcatgcttttcctacccagcaccactagatgtcagtatcacttcaaaagcctagagtaatggcggccgtctcagctgtttctgctttcccactccttttacttttctttcctcctacctccccattcttgtctgaccaatttttggcaaggctgtttcaatacattcatttctgaactacagcaggatcataccacttgggaaagagttatcctcgttaatattcagacctctcattgataattaggaagcaagtccaattggtttcctcacttggtttcaatcatgctgcctagtaatttagtgtggtggggacatcagtatcactttttaatcataagtttaaaatgtctggtttcccagaggagtccactgtctggtgagtaaacagtgctttattaatcggtccatatttttggcttttacttccataaatttgcaccttgatatgtgattaaaaatccacgttatgtatatgaatcaccaagcttcaaagagccacaccttattttaagtattttgcatttaatgaattgtctcctcaatttacttaattcataccttttacaacttcatagattttggggcctggcgtagtggctcacagctgtaatcccagcactttaggaggctgaggcgtgcggatcacctgaggtcagaagttggagaccagcctggccaacatggtgaaaccccgtttctactaaaaatattaaaaaattagcctggcctggtgatgggcacctgtaatcccagctactcgggaggctgaggcaagagagttgcttgaacccaggagacggaggttgcaatgagctgacatggtgccactgcactccagcctgggcgacagagtgagactccatctcaaaaaaaacaaaaaaaacttagtagattttaattatggcctgtttgcttttgacttttctccaactacagattcttaatctctttcacatgacacatcctccatcccatttttagggtcattatctttctttgggtggttatcaagcagccaccatgtcgctttctgcaaagccaagaaaacgttttgttttctccctaaatgttttaccctaaattttggttgttttatttgtttatgccagcattttatgttgatatctccgcggacacagcctttttaaagtacagtatccccatcctggccaacatagtgaaaccccttctctactaaaaatacaaaaattagctgggcgtggtggcacacgcctgtagtcccagctactcgggaggctgaggcaggagaatcgctggaacctgggaggcagagcttgcagtgagccaagatcgtgccactgcaccccagtctggtgacagagcaagactccgtctcaaaaaaaaaaccccataaaataattaattaaaattaattatgaaataattaaataaaaaataaagtgcagtatcccttccctgaactctcatggggagttcaaagtcagcaaagggggcagaggttccccgggttacttactttttccaacttttctagcttgacccttgattcccgcaggacttcctggtggatgttttccagttccagttatttatctgtgtctttttttttaacttatgtctagaacatcttcttcatttacctttattttttccttgttcctctgcttaccatggttcatcccgtattttgaatacagattgatctgcctaagattctccttaagcccattcacattcaaattctgctgccaggtcacaaaagttaacaaggaaagaacaaagtaaaaaaaggttattcttttcacatgtatcatcctagagtactcctttgacactaatgattttcaagagaatgaaatggttctccacttgagctctgtttttatgtatataatcaacccacatagaccatatttcctcccatcactggtatctaattttccagccttctctacattgccttgaccccaccattccacctcacccaaaaaattgcagaagtagctgataggatgagccatgtctccaggtgcaacatgctgcctggactgcactgtgacctgccctcttcctcttcctcacctgaccagacacacttcatagacttcttcacgcaagtagaggcgtatttagaaagaatgccagaccctgaggggagcctgaatctccactttactgctgcacaagtcatgtcacctctcaaggctcccatttctcttctgtaaaatatgaatgataactttcactaatttttgtaaagcagacatgatgggaaataatataacctagataagtgatttgaaactgtgaagtgctacttatgaatgatgttctcctctcttctatttttatcgaatattttgtttggttttcctctaatatccttccctggaggtcagttggggctttgctttgagcagcccatcctcttgatctgcagtttgaatttcgggactttcaaggacaagtccctccataaatagtctttatttacttttcttgtggtcttgttgtttggttgttttttgttttgatacaaaatgtagccactaagcagatgcagattgaatgtccaggcaatctctggtcttatctattccctgtgttgacataacaccagaaacaatggattaggtgtccatgtgtgatgaccacaaggggtagctcagccactgataggataccatcaccacaaaagggaatatattttctccaaaccgtgttgaaaaatacaggttaggctgaggcatcaatccagtgatgttcgaaatattaattttgttttttgtatgaagttgttacacaggaagcttcttaaaatcctatgaatattttgaccggatctcatttaaatgttatttctagtgctattacttatagagaaactctgggaaacaaagaaaaaggaggaacactgtgaaattacccttacttcttggcagaaagatatattttggtgatttcattttggctttcattcaagtataacttttacatgattgtgctcatattatatgtatgtatatatgtgtgttactttacattctatttacattgtagtttctcatttaggattttactatgtagcctgtatagtatcaaaaattacctacaactctataaatctcattttaaggacagactaatgtttcattaaagatacactattgcatacttaaaccaatctcctttttatagaacattaaattggattattttccactttttactattatctgtgtccacaccatttattagcactttattaattctacctccacaaacaataggtaaaatggactgcctcaacaaacttgtcatcattaaatattattcttttccttctagctttgtccactacatagatagaaaataattatttcaatgtactttgtattacttgactattgttggcatattttaatatttcctcagtttacttcaaaaatcatttaataaacacagctaagtgctaagcattaggaataaaaagacatagtttctaacttccagggaatatttggcctagtggttgatgtcctttacttatttgtctatttgtatatgttactgatttgaatgactttatcacaaaaataaaggcatcaatattctgtcataattctagaaaatatttttctttcccagtttgtggtttaccctgtgttttattctttttaactttttaaaatatacagtagattgagatttttatttgtaatgtattctactgctcttaattttagaaattcctttcctaaaggaatcagagagaaattaaccaatattttcctctgtatttttaaagacaatttattaaattacctggaatttgctttggtgtatgataatgggatatcctttttttttcaaaatagccccatgatttgattgaatattcatttcctttagcattaataatgatttaatgtacagcatggtgaacatagttcataataccgtattgtatacttgaaatttgctaggaaagtagatcttaagtgttctcaccacacacacacacacacaaatatatatacatacatatatatgtatatatacacacacatatatataaacatatatataatctggggtgatgaatgtgttaactagcttgattgtggtaatcatttcataacatatatgtatatcaagtcatcacattgtacaccttaaatatatacaatttttattatactgcaataaagttaggggaaaaaaattccactgtttttttaaaaaagccatgatgttctaagctctgttattaatcaaaatacttgtacagttgattctcttggattttctagttataaaactgtgtctctgtaaataatgaaaatggtttcctttaacaccagatcttgatcattaaaattgtcatagtataaaatattatatctttgcacatgtctgctctgaaacctgtttttgtcttttgttccaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgttcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttatttgagagcttcatgaagacacttgtaacatattcaacgtcctgtactccagttttgactacgagatcagattttggaggtgtaagtaatcttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagacaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtggctattgtgagcctccgtgtgtgtgcttccaggaggctttgctcctcttcatgcacccgacactgccccttccctggcttccctccatccctgatcatcttcatgaagccacagatataagatcagcttaatattttatcagtgaccttagtgttggtgaaggatgccaaatgaacagctctgcaccccaccgtctcttgtcactgaaaaggcttggccatggcagaccttggcagagtttcttgcaagatctggccagtgagtctcagtttcaccttgcagggtgaatggcagaggatgcccataccctgcaggttaacagcttgggctcctcaggggttgtcagttcctactcacctccctgctaccacctcctcctcttcttctcacccccgactcctttatttccctttttggacattttaataatatgtcgcaccattctcaggaacaaacatggttaatgaaaggtggcaaagggatgtgtgacattcttagattttcacacatgggcagtcaggagtgaaatgtgcaaccttggaagagctgatacaatgtatggtaagctgaagtacgtttccaacactgctgctcagagcatacagaagttttgcatcctggaacattgcttcccatgaaacaaagcacttcataaatattttatgtttttcttgagcaccctttcaaggtagggatcaaatagtgccagatcaattttcccaaaaggaaagaggaagtatccagagtttagactgaaggcttagagtcaaaactacaggaaggtcacactgttctctggaacactgttgctcttcagtttgtagagtttatgatggaaaaggcatcagtctgtcaaaagacttgtttaatcctgataatgactttggaattatctctcctgggtctcagttaataaactgaagaatgacctaatcataactccatatcttgcaacaggtataagaagtatcagatacgataattgacccaaaggtgctttgtgtcttgttctctcatgtatgttccgtaaggctactctaaccagttctgtttccacaccaggacccaaatttaagcattcagaagggaggcttccagagcctctgtattattaactagggtttttaaaattcatttgagtaatgctttgttctaaaagaacacaggggccttagtgcatgtgttcataatagcctgtatggcacacaaaaagatctaaaaacttgagcgttacaaaacatttcattttgagtgctattttttttttctttttttttttgagacagatcctctctctgttgcccaggctggggtgtattgatgcaatggcgtgaccttggctcactgcaacctccacctcccaggtttaagcgattctcctgcctcagcctcctgagtagctgggattacaggtgcgtgccaccacgcccagcgaattttttgtatttttagtagaaacagggtttcaccatgttggcctggctggtctcaaactcctgacctcaggtgacccccccacctcagcctcccaaagtgctggaattacaggtgtgagccaccacaccaggccttgagggctattgagatcaaattccttggctgcaaaagataatttatgaagttaattgagaaactaccattaggatctaattaataaatgtaatagttgacagcagtatatccattacttcatatgatgatttcgtttaacttgaaaaaagtgatggatgacagcattttttggaaaagcattttaattcggggtctacaatttcccactgtaaagacaacattgcctccaaaatgtaaaactagaaaagttactacttttttttaatgtcagattttataatgtctctcctttcctaaaagctgttcctactcccaaaaaggtgacacagctctcaaatgaggctgtggtgtcaacaggcaaagcaggatcagatgctttggatttgaattttctgcaggctacttgatagctgcttgctagaggattggccc

SEQ ID NO: 13923 - DNA, 278866 bp, Human; identical to SEQ ID NO: 13922
  misc_feature (1)...(278866): n = A,T,C or G

SEQ ID NO: 13924 - DNA, 278866 bp, Human; identical to SEQ ID NO: 13922
  misc_feature (1)...(278866): n = A,T,C or G

SEQ ID NO: 13925 - DNA, 278866 bp, Human; identical to SEQ ID NO: 13922
  misc_feature (1)...(278866): n = A,T,C or G

SEQ ID NO: 13926 - DNA, 278866 bp, Human; identical to SEQ ID NO: 13922
  misc_feature (1)...(278866): n = A,T,C or G

SEQ ID NO: 13927 - DNA, 14635 bp, Human
gaggttgattaatttgctatctaggggattttttaaaaaccttgcgcatgtagtttctgtttgcctaaatccaagctgtatatttttagcctaagaaaacaaaaataggggggccaggcatggtggctcatgcctgtaatcctagcagtttgggaggctgaggcgggtggatcacctgaggtcaggagtttaagaccagcctgacaaatatggtgaaaccccgtctttactaaaaatacaaaaattagccaggtgtggtggcgggcacctgtaatcccagctactcgggaggctgaggcaggagaatggcttgaacccaggaggcagaggttgcagtgagccaagattgcaccactgcactgcagcctgggcgacagagtgagactccatctcaaaaaaagaaaagaaaaggaaacaaaaataggggttacttaggtagctttgatttctttatctgcaaaatgggaattttaatacctcaccacataactggaaaaagaaagaagatgacagatataaggggtgcctacttgtgccagccacagagtaggcattcacttaatgtcaattgaattagaattaagcagaattaaagagttgagagcagaattaatcaagcctcttgaaagagagagtatagtgtagtaaccgtatggggtgttcgtgtcccagcttggcagcttaacaactctaattccctttttcttcttttgtgaaatgggtatagttatgacaattgtaatagattaacaaagtttatgaaagtagtgtacataatgtacatagtatagttgaacacatagcaagctctaataaagctaagtatatatgtatgtggtttttaatcacattcaccagcaacacaaagatggctatatgaccaataatgatacatataaatgtatagattactggtaagatggatagaaagattgcagctgatagatgtcaggctaataaggacacaatgcaggggttgagctttaaaggcaggaatgaacatcatctagaagagacagtactacatgccaagcaggataaatagcctctaagcttgggtctgagaaaagttgtgtgtgttctgtggaagagagagaagtagatagcagggctgataaaagaacaagaggaggttacaaagaataatggcagaggactggaaatgtacattttaagctttaccctaagttcctacctgttttgacttcagtatcaccagtgtgtcttggccttcctcttcagcacattcccaattatacttccaattccagacacagataactacattcctctactcaacggcttttagttgaatgtaactttggaatgtgaaatgactcaaggatcatgtaaagctaattctccttccctattacacccatgaaagtaccatatatggtaattccttaccttgcatttgcaagcctgttttttgatgtttccattatcctgcttctccttctttacctgtcttcgaattgatgatgatggtgatcatgatgacaattgtgataaggatattataaatttattgagggtttttcttgggccagtccatattttatctccattacattagacaataacccattaagttagaagctattactatttcaatttttttttttggggggggagacagagtctcactctgtcacccaggctagagtgcagtggtgccatcttggctcactgcaagctctgcctcctgggttcatgctattctcctgcttcagcctcccaagcagccgggactacaggcgcctgccaccacacccggctaattttttgtatttttagtagagacggggtttcactgtgtcagccaggatggacttgatctctcgacctcgtgatccacccgcctcggcctcccaaagtgctgggactacaggcgtgagccaccacaccaggcctactgtttcgattttaagaatgaagaaatttagtctcagagactgaatccctcaagcaaggttaacagctaaatcgtgggactggaattcaagtcctaaagcctacagttttgaatactactgaaatgacaagttgtaagttgggtctccaaagcaggatacataagaactgaggccttcctaagttcagtgctgctgctaggtacatagcttgatgtttccaaagagatcagtctatgacctctggtcttttgctttcaacctacttatagttaatctcagtgctagtatgtgatgttagtctatgtttagggcatttttgctatttatttttgcttatactgcacccttttttttcaagtagtacttgcttgatgtcttcaagctaaataatatagaactagataaaatataatattgcatacttttttttttttttttttttgagatagagtctctctctgtcgcccaggctacagtgcagtggcgcaatcttggctcattgcaacctccgcctcccggatttaagcaattctcctgcctcagtctcacgagtagctgggattgcaggcacacgccactgcgtctggctaatttttgtatttttagtagagatggggtttaatggggtttcaccatgttgggctggctggtctcaaactcccgatctcaagtgatccaccagcctcggcctcccaaagtgctgggattaacaggtataagccactgcgttcagcccctatttactttgacattttaaaaactaaacaatcatttcttctgcaaatagtccaagatatttttaagaacagtataattaatgctgcaatataagaacatcaaatgatcttccagttattttgggtatttatgtctgctttttcccattttatttaaatctttttaagattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtaagaaatttggaggtaatattttcttacttttaagagttggaattctggagagcagttttcttaattttctttttttatttttggtaaagcccaatagcacactgttttatgctgtaagtgaagtatgccatcgtttggcacagatggatctgatgtatttatggaacagttgctttctcctagaaactagtaaatggttttttcattatggcttttacctttttatcattctgctaagcagatgagatattctggaatatcaaagttttcacggaaactttctttcattttggaattaattttgccaatgagggtttagaaaacaatcattttctagacagttaactggtattttcagctctagtgcaggtcaagggtatgattttggttaaaaaaaaatagaaaaaaaaagaagaaagaaaaagaagaaaaaggctgagaattaaagtcttactttcaaagtgagcctcatatatgagccttttgaattttgtgtacttctgactttttaagtggatactatttctacccagcattataagaatgacttttttttttttaagtgcagatgtggggagggtggtagacagattctgaagcacatattatgtattcaagcagggtttatacgtgcttgaagcgcgtagagcgaggttccctttacaaaattaaaatattttcacgggggtagtccctgtgctcattcagcaacttcttcctggagaccatctgtttctctcttaggacctgtcctgagttttgtcctctagagccttgattttatctataggtcacagtcttccctaaggtgtttccttgttacttttttttttttttttttttgtgagatggagtctcactctgttgcccaggctggagtgcagtggcaggatctcggctcactgcaacctctgcctcctgggttcaagtgcttctcatgcctcagcgtcccaagtagctgagattataggcacgcaccaccaggcccagttgatttttgtgtttttagtagagatggggttttgccatgttggccaggctggtctcaaactcctgacctcaggtgatccacccaccttggcctcccaaagtgctgggattacaggcgtgggcctggcctactattttgaggtataatggaaggatgtttgcattttaatggagggaacacctctcatgcactgatgtgttgcagcatcagggcaacaaagtggctgtctgcttccaggtccacactgacttctagacacagaatgtcaccaaggaaatgtaccctgtcttaaaagaaaagatgaagggaattcaaatttggagagtgccgggagccacacgctttttatgtgtgcttggtcatgcagtcattttacacacttgttagcattgtcaggtgaaatgaggattcatctttccattttatatagagggggcagttagaggttaagtagctgtctgagtccctttgggctgctcttacaaaatgccatagactgggtggcttaagcaacaaacatttgtctcacagttctggagtctggtaagtctaaaatcaagatgccagcagatctggtgttcagtgagggcccagttcctgacttgcagatggccatcttctcattgtatcctcacattggcagagcacagagagagagagagagaaggaagcaaactctctcctttctcttcttataaagactttaatctcattcatgaggactccactctcttcacctaattacctcccaaaggcctcatatcccagatactatcacatcgaagattaggctttaacatacaagttttagggggccacaaacattcagtccttagcaatagcttatccaaggttacatacaaataaagagtgaaactgagattcaaactgaaattgcattaaacccaatctaatgccctttccattgtaatacatttatttctttattcaacatatatttattgtacatctagtgtgtgccaggcacttatttaggggagcactacgatgaacaagacagacaggcctgaccttaggaactttatctggaatatttattccagataaagatgttgaggaaaactgatgggcagtatcccagccctgtgcatcggttctcttcaacatctttatctctaatataatgttcatatcatattaagaaaaaatagaaaacaaatgagattaattttgcagtttgtgtttttctctgccatcaattattaaatagtggcacatgcttaaatattttttaaatgcagatttcaagtttcaagggatggggaagctatttcaaagagcataataattgcaggaaggaatacatgaatgtgtacttcttattcctaggaatgcaattcagcttctcaaatttcattatacagtattcttcaacccaaagttttatctgatttagaaaaagaaaagaggtacacatgttctgacagagtacaagacacctttcccatcccttactcttttatgcttcttgcctgttctctaaaacctttggcaggtaaacatattactttcagatgagccaatcgcttggaaatgttaatacacttgagggaaggtatgtcaacatcactgtgaaaaagataccagtgaaccatactaatagtcaatgacttagaattatgcctttccccatatttgcttccttttcactatttttattcactggtttttgttcaagttcttatttatgcttctctttttacaactttgcattgttaataaaaattcagttttaactatagatgccttcttctcctcttgtgtttgatttattgctccaaatgggccaacctggatgtctatatttcttccactaaaatgcaaataacttactaggtagaatatccccatgttatttcttggtttgtttgttttcttttttttgaggcagggtcttgctctgtcacccagactagattgtagtggtgcaatcacagctcactgcagcctcaacctctcgggctcaggtgatcctccaacctcaacctcctgagtagctaggaccacaggcatgcatgtggcccactaccatgcaaaattttttttaaaaaaatttgtagatatggggactccctatgttgcccaggctgatcttgaattcttgggctcaagcaatcctgcctcagcctcacaaagcgctggaattacaggtgtgagctattgctcctggccagtatttgaaataagttttttttcttggtatttggataggtttttgccaatccagaagactgtgtagcatttggcaaaggagaaaatgccaagaagtatcttcgaacagatgacagagtagaacgtgtacgcaggtaaaccagtgtctcttgaaattacttactttatgaaacaattttggtcaaggagttcagtgaagatgtctcagggtcttggagactgaggaaaaaaagtgagacctcttacctactccacatgacaattacagaaaactggatgtctgaaattgacacactgcacttgtatgtgttgccaatttggcaatactgtacttttatgtgtactttcttggggttaatgacgttgctgtatatagggatgtatcaaaagtaatggcagggaggaggtaaaatgggaacagtagattcttggagttttatcgtctttgtccataggtgagactgtcaactcatgtaaaaggttgaagaattaggtatttttgcataagattcaaaataagaatgttgacactctggaggagtaggaacctctttctctgtccctctccccactgccatctctttttaaatattatgttttaatgtactgggaattcaatgagcaatgaaaagcaataagccaagatacgactggggtatgattgttcctatcacccaggtagtgagcatagtacccgttagtttttcaacctttgtctccccttctgtactccctctaatagtccccaaaatctattgttgctatctttgtgtttatgtacccagtgtttagttcccacttataggtgagaacttgtggtatttgtttttcttttcctgtgttaattcatttagggtacttgcctacagctgcatccatgttgctgcaaaggacatgatttcattctttttttttttttgagatggagtctcactctgtcacctaggctggagtgcaatggtgtgatctcggctcactgcaaccttcttctcctgggttcaaaccattctcctgcctcagcctcctgagtagctgggactacaggcatgtgccaccacgcccagctaattttctgtattttcagtagaggctgggtttcaccatgttggccaggttggtctcgaactcctgacctcaggtgatccacccaccttggcctcccaaagtgctgggattacaggcgtgagccaccggacctggccaaaattcattcctttttttttttttttttttttttttttacagctgtgtagtattccatggtgtatacgtaccacattgtctttatccagttcatattgatggacaactaggttgcattagcccttttttgattctctgtgaaagtctgaagcccctcccaagatttctgcagattcccttatggcatatcatctccaggttaactctggatctgggttcctgcctctatgcatgtttccatattctgcaattggttatgctggatgttaatccagccctttcatcagttcccttcaaaaatgaactaaaaaaaatgtggctaaaaatagacttgagtaagtggaagtgcagaggcgtttacactgtggcagcacaaacattttaagttgtatgttatttctctgtcagacaatggccttcagcgtcctctctttgcagaatatgccccgtacctgtacctccttcacgcaagcaatgcccagtgttacaccatttttgaggctctcctctagccccacagactcttcaaccttttcagcactaaaattaaaagtaccttcttgctcatgcaaaacaattctacccccaagctattcatcaagcaagaatgtttctcttctaagaagaagtctgtgcagatacttagcacaaaatttcaccttctatctcacttagttatatacttcttaattcagcagccctgctgagtaaatcagtgagtcttgagaatgggttgtgtcaagaatatggatataaaatagtttcaggacaaagaatcactgtggaaatttcaaacagcagaacaatatcaaaggaaaaattatgtgttagacgaaaaaaaataaaaaaaagtgagtgaagcttaagttttcaaaaccactgaagagacatgaaaacttttaaagccttgtctggtcctttatgcacttccccttttagagcaggcagccgcctgcatgatgctagtcatggccctgtatttataaaattgcccagaactggaaagtgatcagaagcaattagaccctcagtagtattagtaagactgaaatgaaaatccaagtaagtctcctgtgtgaaagcgtaacaaaagatattttatttggggattttagattcctccctactattctttccgaccttccacccttactccctgcccgtgggattgtacttttagaggaaaacgacgttatctaaattgatccgctagtcaggttgcaaatgaatgttagaaagaacaattgaccccagttctgtaaaggttccgagtcctggaggaggtgcagcgactgtgtgcacagcgccccctggtgatgagacactggcttttccgcatactaagagaagagcgtctccaacagagcggagtttccagttgtataatgctttttgagacagtacctgtttcatcgaaaaagtgcctaataacacacttttggagacacttttcagacagagcgtttccagcatcttccctttccacttttaagttaagacttttttttttcacctctctcgttacttcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaaggtaatatgtgttgaaataccaagatatgtgacttaaagtcagttatttgagttctggaaagacagaaaccagtgatggttagaaagcacttgacatatttatttatttatttaataccatcttagcttgtctaggaagcattcaagaccatatacattcaacacaaaaagataaaaagaaagttgaaaggcaaacaggccagctggtgaaatacagggagtcattcaaaagacaaaataaaggcttgagttggtatttagggacaggagagacatttagaatatattccctttaaaggtagagaataacccttcactgagagtgttccatggagtctaagtgacacttgctggggactctgtcatgagactggagcataggctaggggttgaactggatgatgtccctcgtggccccagtgtatgaacacacatatatggagagattattgtgtatgtatcactgtcatttcttctattgggatgctatcaaagagctttaaaactgggttcctgaccctcaggggtttatagtgttccccccctccccgcccccaaaagacccacatgcatataggaatgggagaatgatatgaagccatgttccattagttccatggaatatttcataaaggaagaccttgaagagtattaggatttgaaaggagaaagaggagagaagtctcatcaatttgggaaaattcctttgtgagaatgtgaacacatggctggctatgtgctgagggtgaagagctttggctgagatgagggcgtcaggaaaagcctgctgtgcagctccttttgtagttgttcacagcctgacaatccccagaagcatgtagcaatggcagtccaggtcaggtggatgctgggatccaagtaattctgatctgagggaaggaggcgtggctgtggcctcaagagcacagagatggtgggaaggtccgtcacagagcaaatatatgccagggcatgtgtgtccaaaggagaaagaagaatgggaaaatgtaatcatggggaagaagggtaatagacccaggtagaaagtggactcttaggaagactgatgtccacctggtgatagattttggcagctgtccataaatggcactaacgtgaaggaagctgccgctccaggaaggagtctgtcgttggagaagaggggagggttaggacggaagggtgatagtgcactgcagcaggtgctcacagggaaagctggggaactgtttgcctggaacagagtctcaaaagaagtacaaaatacagcataaattggcataagtatgagggtctgtggaaaacaggccttactagcatagtgaggagtgttatctttgagaacattttgagggctgacgaaagagaaagagaactcaaaagggagaataagataaagagaaaatgaggctagaaaaacatgcaggagctagaaaggtaaaggaacccctgccccttgaccttccttccctctaccctcatggtcctcttactgtccttgactttcttctctgctttaacattccattctatttgtcaactgcgtaacacaggcgtagaagtggacattgttttccagagagtctcctttttatagtttcttcctcaaccttaaaatgtctgtccttttggcatgttgtgaaggagaacactaacgtgcctaagattggaggtgacgatatctctgtgatgctgggggagaaatcacaggggcaaaacaaatactctaggtgtcattgacaaagtgggcccttctttaatagaaaatggtattcctgtcttttctttcccatctcattctcagtagtacttgtattgctccatgaaagagagggcacaggaacactcacaccatcctctctttgcttttattctgtattgaagccttttcaaatcattacttagctgggctgctgctgtcctcttcatgtctctatgtagtcatcctctttgtgagacaagcttagagataatctagggaagacaagacaaaggaaaggagaggaggagagtgacgatcgttgagcaggcaatatgtaataattatatgcttattgctatagaagagagtaacgtaaagcagaaatagttttcattttgaaatacatatcaatagctgacaaactatcaaattctccatttctagcctagattctaaagcaatttctaattctgtagacttaagggaggtgacattttaaaattaagtatttttaaaaatgttgctgggcatgatggcttgcacctataaacccagtgttttgggaggctgaggctggaggactgcttgagaccaggtgttcaagaccagcctgggcaacatagcaagaccccatctctaaaaagaaaatttaaaaaattagccaggcatggtggtgaggcctgtagtcccagctactcatgatgctgagactcaggagtttgaggctgcagtgagctatgattgtaccactgcacttcagcctgagcaacagagcaagaccccctctctaaaaacaacaatagcaatgacaacaataataataaaaatgtcaagtccatagtagatgtgttttgtattcggtcttagccagagaaacccaagatgccacggtttggagcaaaactgtggctaaaacatgctttttgttttcttctagctctgttataaagaaaacatttaggaaattctctctttctctctttcacctatcctactttttgtgtgtcctttgtagttttgcaccatcattcctaacgaatttatttggcatttggaagataggttagcaaaaattttactatatttgaaaggctagttatgtattctgttatttagatataagagcatgagagtcttgatattaaattggtaaattaattattggcaacctagtggtttgggttggcaaggattctgtcagtaatcatttggtagagtagcagaagcaaaggaggtgtcttaagaaaaatcaacaccaaaagggttttcttccttcgggagaaagaatttttataaaaagaatcttgaattgctaattgttatgaacctcataagaaaaaagtatttttatttacaaaaatgaaatgagttctattagatagatgtcgttttgatattctaggaactacaaaatgccttctgtgatatttaaagatacactaaaaataaaaagaaacagaaataatgagagattctaaataaaagtcaagtgggcaaggaagcaagacaatttgagagaaaaaaaataaatcttactttgaaatttaaggatccattagtgctcagatttagtttttagaagagagagaaaaaaggatacatatctagtattttgaaattagtgtctttaatagttatctttttccacagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtctttttctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatgattttgtttggttttatttttcccaacattttattttcaaaagtttcaaacctagggtaaagttgaaaaatagtacaaagaaccactctgtaccctgcttagaatcgccagttgttaacattttgcatatttgctttccttctctctttgttttctttttctctgaaacatctgagagtaagtggcagatatcatgacatgtcactctttaaaacttcagcacgtttttcctatgaataagacattctccaaataactacaataccattattacacccaagacacttagtattaatatactaatatttcatatatagagtccttattccaattttttcatgtttccccagtaatagtcttcataactactttatttttgatccaggattcaaagatcaaacattgccttctgttatcatttctatttaggtttcacttaaatgagagagttcttttgctttctttctcttttgtataaccttgacattttttgaagagtatagacaagttgttttacagaatgacccttaatctggatttgttttatctatgattttctcattcttagattcagattaaacatttttggtggtgtgtccttcacactataaaacatcaacaggcatatgatatcagtttgccctgttattggtgatattaaatttgatgaatttagtaaggtagtgtcaaccaaatctgtccattttaaagggatccttttatttttataatcatatgtggggtgataatttgagactgcatatcctgtctccccacaaactttcacttaatagatttagcacccatggtttctacatataactatgtagcacgtaaatcacaaatttagattttttttggtcttaagtggaatgtgtacttaagtctttataataaagggtaagcttttaaagtatcagttttttcttgtatatgccatccatctaatttatattagtttttgattttcatatcttttgatgcattttaattttaaatatgtatttctcaaacagtacttttaatgacatttgtgaattgttcatttagatgtgccactcaagagaaaagtcactgtgttgtattttaggtttcatagtttgagcaactctgaagtccataaacaaaacctattagacaattgactacgtagaattccatacaagtttccttttacttcttttcctaatgttaaaaagcagctttgcatgctgtggatcttggccttaggaacgctttgtggtgtaattgacagaaaagaccacgagctcaggagggaaaagtccgaaacccatgagttggctctgtgtgcatgaacacgcacgcgtgcgcgcgcacacacatacacacacacacacacaccctgctctggagttgggcaactgacttatgctgtctgatctgcagtttcctcaaactttacaagattttttgaaggtcatatgcttttctgtatgtggagcaatttgaaaaaagtatattctaagccattaagtgtttcccatgtgtgaattatctcagtaatctctcaatcataaagattcagataactgagttcctcctggttttgggtcaggtctttgttgaaccattatcacgtctttcatcgttttcttaaattttcttctcacttg
